United States Patent 10,870,889 (IMMUNOGLOBULIN EXPRESSION LEVELS AS BIOMARKER FOR PROTEASOME INHIBITOR RESPONSE) - sequence listing, part 10

SEQ ID NO: 688 - DNA, 14263 bp, Homo sapiens
ggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgaggtgagcggagtctgacgctcgcggaaaagccccgaggaggcgggggttcccgggatttgggggattccaagggcggaatgcggctccggccggtgactgctcagtttcgcggaggggatggctgcctaggctggtccgccggagcaggcccggagatctagggctagatcgatccagcgcccttgtatcaatgccatcggtggtgcggaagtttctggaaatttctagttcgggaattgtggcgtcctttaggtttgcctcctgatttggtggcacttccacgccacctttgcactaccaagttagcatgaaatattttatgtttgcaatgggacagttcggaaagcatatcctgggatatgcgtctgctgggccccaggaaactatatttgccacatgagataatatatcagcacgtgctgtgttatttatacgttaaagggacttgtttgctcattgcttttgccttattactgattcttaatttagaggtccgttcagatgagcaaacattttctcttaatttgccattgggaaaatgcgctcaacgtagtgatggtgttgcctaggttacatagccgctcagaagttcctaaggcctggtgaattagggagcgtgttgctttgtaactggattggccttgttctggaacacgttggaattgctggccaggcaatgtgtttgaatgcatgtacaggacacacacacgtttacacgtacattcagtttgttgcaactagctagggctaggtttaatctcacctgtcttagctgctatctagaggaggaatttttacagcttttgcttcagaggttgcatgaggcagtttgctcagagcacaaaggctgcaggtatacgtaacacgtggcaagtccgcccacccaaagactgtttaattttctcccgttggttgcttggtgattggaaattctcagtacctcttgaagaaattactcaggatttaaaactatttgtatttaatgatatctcttacatggtgctaatcttttggctactataattggttatgatccttagtgtaatgtttcaaatctgtttatatacatacatgacagtaggtagactaaatttgaatattagaataaaataagattcactaattctagtgagtatattcaaaggaaatgaagtttgtatgtcaaagaggtatctgcactcccatgttcattgcagcattattcatgatagccaagataatggaatcaaactaggtttccatctacagatggattttttttaaaatttgatatatgtgcacagtggagtactattcacccataaaaaataatgaaatcttgtcacttctgacaacatgaattaatatggaggacattatgttacatgaaataagctgggcacaggaagacaaggcatgatctcacttacatgtggtttctaaaaagttgaccttgaagtagagaatggaatggtggatttcaggggttgggtagatgttgatcacgagagacctaatttcagttagaaagggggaataaatttaagagatctattgtataacataatgactatagttagtagcaatgtgttgtgttcttgaaattgcaaaaaagaaaaattacagtaaaggggaacttggtaattcatgattgatctgctaccataattataccaaccttctttttatcatttgtctatttggttgttttgcatactgacaagattttcttttcttttagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaagtatgtgtaaattttcttaatcttgttattcttcatacagacaagtcctgttctttaggatttggggaagaaaacactaagtaggaagtgaagcttaaaaagtactattagcgtccatgtctgaggcagtaacgcagtttcgtaaaggttaggctgtgcgaggtggaattacttatggtactaaggtttatctatagagaaatggactcccctagctttacccatcctctcattctccttcactctaagatgatttgattgagaaaggaaggccgtagtcaaccaaccttaggtagcttcattgcctggtgacaaaaaagttatgcatagaccgggcgcagtggctcacgcctgtaatcccagcactttgggaggctgaggcgggtgaatcacgagatcaggagatcgagaccatcttggctaacgcggtgaaaccccgtctctactaaaaatacaaaaaataagccgggtgtgatggtgggcgcctgtagtcccagctactcgggaggctgaggcagtagaatggcatgaactcagaaggtggagcttgcagtgagccgagatcacgccactgcactccatcctgggcgacagagtgagactctgcctcaaacaaacaaacaaacaaacaaacaaacaaaaaaatgcataatttttgggcctgagtgcttgggaaggcagcagatttgaagattcagtgttttgggcacatgggtgatagtgtggtcaaaatatgccatttcatactgcttattacactttgtaatgaatcatacttttgtttagtgataatggttctcccaatagactgcaggctctatgagttcaagaactgtatgttttcaccattttgtttttggcatctaatacagttattgagtaagaactcagtaagtatttgtttaataaataggcaaataagcaataatcacaagagcaacattttttaaacgatttattaagaaaaaattaactttttaaaaaatatttaaaatgtttactttcatgtttaataaaaacttgaaatatgctaataaactatatgcagaaaatatttaacatagcaagtgtgagactgctatctttagaaaggtctgcctgcaagagtagcacttgtttggagtctgggaacttgacacttgtaccatttcctaaatagtaatggtgatttactatgcctagcctatttgtacaaacatgaatgtgtgctctcttttggggagtctggaattttggtacatgctaggtagagtgtgcccaataaataccttgggtgctgagtctctaattggctctcctgggcagaaatactgtgtacatgttgctgcatttttgttgctgggggaagtgtgtgttctgtagcacttcatgggacggagaaagcataaggaagcctgcacatggatttttccagactctgcctgtgtctttcccgtcatctcgctgtgtatccttaccactgtgatccaaccacatactgatttgtgtgagctctagggttctctgaacatgaaagcaatcttggtaacctttgacacaaagtgatatatttgctgaaaattttccattagggtagaacaaatctactgggaatcattggtctgtattcagcagacattattgagtaactaatatgtactatgtgtacatgcacatagttataaggatgtaaaacaatacagttggtgtacttaaggagatcattgctggaaggggcagatcataatgccatatgttatgtaggcagagtcaagatactatgggagaaaaattaggacatacagcttagggatttcagtgacagttttataggggaggtatcatttgaaccgattttctgaatgttagcagggatcaggcagtgaaaataggttggattcagatggtgaaaagcctgaagcgtttggagttgcggagacgggtggggagcgacaaacaggagagagacatgactagagtcatgcactacaaagttgtcttacgtacgtatccattagtaagcattgctaaaggcatccatgtctcagtcactaatagccattttccttttttgtagttattaagaaatttatgattcagggtggagacttctcaaatcagaatgggacaggtggagaaagtatttatggtgaaaaatttgaagatgaaaatttccattacaaggtaaagtagagaaaatgcatgttattgctgataaaaagattgttatatatctggaatacttgttggattaagacaccaaaaaatgtttcaagtgtgcttagattctccatttcttgtaataggaatcacttttgtaaataatggttctttaatatggaaaagttttcattcagtaatgattaattcagcattatttcattgtgatccagtttttatatgcttcagttaagccagtgagtttttaaatgcgaccagcatctggcaaaattgtttccaggaaaaatgtttccattgttggaaggatggtaacttgtgcatccttatccttgaatttgaagagcaacaaaaccatcactaatatccaggatgtcaggggatttgcacactagcagatatagttaaatgtccaagctcctaaaggacttcagtggtgcctgtgccttcttgtcttcgttgtcccaagatgtaattggggtatattgcatcattcaagttataagaatggacatgtaagtacaaaagtaaagtgatatttttggaaataaggaatatgagcaagggtattaggataatttgaaaaaatgtcgtcagtcttccagtcagtgtttattgagccactatcactggcaccaaagggtttataaaaatgaaaggccttgatgacaaggaatttataatcctacctcagagacaagattaagatacatgggactactggagaataatagtatataaataaatgctaaattgattgaatatccttgcttgtataacattgctaatactgtctatatactgcaggagaaagatgtgatttatgcagtctgaattattatggaagtcattgaggaggaatggctacttgggctgtgcagactgggtcttgcaaggcggcaacatgtctgagatttggttaggcaggaactgtagtattgatgcagaatttaaaaagggacgtcggtgaggaaagacaaaggcaagagacgttgaggaaataaagttctagttactgttgtaccaaaggaagctaccagaaggatgaaaactaaaggtgatgtgatgatcacattgacatagagaaaaggggcctatagacaagacacatgattcttgctttctataaacgtggtggccttaaaatctgaatttgatttagactgaggggagtaaaaggcattttggtggggtggggggtgtcatgaaacattatataacatgagagttacggtgcatgcaccaacaaggaatacatttagaaagcctaggagataaagtgaaaaggttaagaaattgggtttcatagatcctttgacaggattatgccaaggtagaattttgatttcaagatgtatgcagcagtttcttttgagcactctccgaagaggtgattcatctgggatgaaaacctaatccaaatcctgtatgatttggattcttttgagattaggaaagtaccaaactgaatgtcttgggtaaattcagtatcccattattgttccagtttattgatgttttgtaaaggaagacttatactgtaggcatatttatgaatttggaagaccgttcaggtcttcccagaaaaaaagagcattcatcataaagagggcaaaatatattacaagagtttcataatgctgcatcttcattttaaaggtgaagtgtaagtattttctcatggccaatttagaaataaccctccccccgactattgtttctgttacctatttactttgataaggttttttaaagtttaaagtgattaagtgccccatgttttgtgaattaaaggttgcagtttataaaaaaataaaaagtaattaaaaaattttataagtgaaaagtaaaaaaaagtagtttgatctaaatggtagtatagtgcaccccagttttatgttcagtaaaagaacagttcagactaacacacaattcagaaaagaacacatctaaccttggttttcttttaatttttatttctacagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaagtaagtaaaaagttacagtgaaatacacttattatcttagttgctatctttttgagacggagtctcgatctgttccaggctggagtgcagtggtgcggtctcggctcactgcagcctctgtctcccaggttcaagctattctcctgcctcagccttctgagtagcagggattacaggcgcgcgctacaacacccggctaattttttctgtatttttaatagagacggggtttcaccatgttggccaggctggtctcaaactcctgaccttgtgatccgcccacctcggcctcccaaagtgctgggattacaggcatgagccaccgcacccagcctgttagttgctatcttaaagaaatataagtaaaaggatcaggtgattattagctggaaaaatgttataataattttgggtataggagccaggatctgccactttttttttttttttttaacttttctacaatgggaaagacaattagggtagttttaaaggagatttttattatttcaactttcatttggtgatctttgctagtttacgttaagtcttcctatacctgcaaaactgttcagttggtatgtatagtagtacatagtggaatgaggataataagcccaaaatcttgtctggattgtagcattaactagaggcttggccttgactttgttacttaacttttccacacgtgttttctcctgtctaaattacttatgggtttagactagattatctctgaagacccttgtgtacttaatgtctgtgaatcaaaatgaccttaatattggctgggcatggtagctcatgcttgtaatcccagcactttgggaggctgaggtgggaggatcacttgagaccaggagttggaaaccagctttggcaacatagtgagatgctgtctctattaaaaaaaaaagaaaaaaagaaaaacccctaaacgaccataatactacccagcctaagtgacagggttgtgagtgggagttggaagctcagttacttgtaggaggtaggctgtcactcagtgtatgacaagaatagtagtaaaccggaagctcatgccccacctaatgccacttacatagacaatgataaaattgccaacttattctgtgtttattgagctcctgaatagcaataaaatgcttatgtaaatactaacattgtcgtattagttggaatgtataaaaacagcattatagtacataaatgagccttctcacataaatctgtgaattggacagtgctgcacatgacttcagctgtatagcttttatctctcattattacgatagtgcacttctacaatttagggttatttttacagttgtgcgttattgcagaatgtggagaattgaaggaaggagatgacgggggaatattcccaaaagatggctctggcgacagtcatccagatttccctgaggatgcggatatagatttaaaagatgtgagtactttcagattagtcaaactttaattaatttagtaagtgaaaatatttagtactaaaagtttgagcttttgtttcagtctctcatatgatagaatctagcattaaaccacattacttactaaaatccaacatatttgtatttttttatacaggtagataaaattttattaataacagaagacttaaaaaacattggaaatacttttttcaaatcccagaactgggagatggctattaaaaaatatgcagaagttttaaggtaatattatttctaacaaattatttttaagaaattataaattgaattataaactaaaattaagaattgctcattatatttttgcaaattacttgtggaataaccaggtgtgttgaaatagttgcatttccttttttttcccctcagcttgttttgagaaatttcaaaagacagaagttgaacgagtagtacataattactcataagttttacttacattcaccaatttttaacttttgctgtttacgtttttacagaactattttgataggaagttgttgatactgtgatactttaccctaagtatttcagcacgtatttcctaagaaacaaagacattctgcataagttcaataccgttaaaacaccccaaagtaatattgatagataatatcaatccatatttaggctgggcatagtggctcatgcctataatcccagcactttgggaggccaagctgggcggatcacctgaggtcgggagttcgagaccagcctggccaatatggtgaaaccccatctctactaaaaatacaaaaattagctgggctggtggcgcacgcctgtaatcccagctacttgggaggctgaggcacaagaattacttgaacccaggaggtggaggttgcagcaagccgagattatgccactgcactccagcctgggcgacagagtgagattctgtctcaaaaaaaaaaaaaaaagtaatccatattccaacttccccagttgtttcaatttcttagaaaaatcaagggtccaaactaagattatgtgttatatttagtggtagtatctcttacgtttcctacctcccctggttttttattcatttgcatttttgtggagtccaagtcagttgtttttatagactttcatctgtatgtgtttgtttccttaagattagtttgaggtgaaatattttggcaagaagacttaggtgttgttttgtattacctatgatatcacatcctgaagacacatttcgctttggcctgtttgagttcacacacatggttaaagtagtgtcagccacaagcatttgttagtctgaggtggtatcgtgaaattgtatgaatttctagtccccaacaacttttcacacagtggatcttagcatcattgaaaatccatgcctgaatctgttatactgaacttctaagtttatcatcgtacagttattaactagcattcttctgtttgcaagagcctcccgcatattttttaagtatcactatagacctgtggatatttttcttttctttttttttccttttatagaaacaaggcctcctttatattgcccaggctggtctggaacttttgggcccaagcaatcctccctcctcaccttcccaagtagcagggactagaggatatcttatgggtagttttcaattccgtttgttagtacgctattattgtcattctttttcatgcccaaagggttccaaatttgttcagtggaaggcccctttcctttggcatgttcctattagtctgcgagcacttgcttgctctaagctcatcttaccttactttcacatctgatatggcagtttctccaaggacctctgatttcttttagagaaagaaaactttagaaaccaaattctgggggccaggtgtgctcagttttggggcccttttcagggacaatgcaaaatcaacacaatagagttctccttcatctttcctctactgaattcccttctcctattatgagaatcctggttccaaacataattatgttggaaagtacatagtggggacctgagttttaaaaatagaaaagtgttactagtgcataattagatttgggaattgctcttaaattggcctctttgaacactttggggaacaaaaacaattttttttaagccttcttaaaaattttaaaaagtgtgatcattaagattattaatagcatttttagagctttttatatcagaaatgacataacacttctggacatagagaagagtaattcctgtttatgtggtctttcatactgcttttattaatgcattctgcagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggtaagtctgtttgattttgaactttttgaataagttggattaagacttagtttgaatagtagcaacttttatatacattaatatatcttattgcataggacctaatgaggcttaagaaaacattttgtttctaaatattttggaccctcagttctttctctacattcattttgcttataactctgtgtcacttaacagctatgaagatccttgcctttttttctcaaagcacatatatcagctcatgtattcacttaagagcacctattgtgtgttaggcattagaagacaaagtcagaaatgattaagatgtgggttatggagtcagtcaggcatggcttttttcttcttcttttttttttgagacggagtcttactctgttgcccaggctggagtgcagtggcgcaatctcggcttactgcaacctctgcctcccgggttcaagtgattctcctgcctcatcctcccaagtagctgggattacaggcatgtgccaccatgcccagataatttttgtatttttagtagagacagggtttcaccatgttggccaggctggtctcaaactcctgatctcaggtgatccacccgccttggcctcccaaagtgctaggattacaggtgtgagccaccgtgaagtagttatagagagttatataacacaatgtaaggcatttagtgtagtgcctggcacattttaagcacctaacagagacgagttattttaattaaaagatccataccctcaagaagcttaataagtgattcaggataggagggggtcagtttcaatttaggttcatcaggacttgtgtatggagaatgggttctattggaacaggtcatttatctttaggaggtcatccaggtatgctaactgataaagctagaaaggtggcagttttaccttcctcaaatagagcaattatgactctcttccctgttgtatagtttgaaaagttttccaaatgaaactttaagaattttacatattaagccaggcacctagactagctatgctcagagcaagtagaactaaaatgagatcctaattttgtagggtagatggaataagggataggaatatatttagaagggatcatacaacagaggaaaaaacttatcaaaagaaaagatgggtcttcactctgggtttttttttgttctctgtcacccatgctggagtgcagtgatgcaatcaaagctcactgcagcctcaacctcctgggctcgggtgatcctcctacctcagcctcctaagtagctgggactacaggcccttgccaccatacccagctgatttttaaattttttgtagagatgggtttttgacatgttgcccaggctggtctcttaactcctgggctcaagctgtccacccgccttggcctcacaaagtgctggtattatagttaagagcctctctgcccagcctcgatctctttttgacctgtgaggcaggtaaaatctgagtattggccattaaaagatgttacataaacaaaagataattttaaaatgtttgttctaggggagagacctgatgcataaagtctcttaggttaaaagacctgttgtaggtaagaacctaggttgggtatggtggttcatgcctgtaattccagcacttagggaggccacggcggcgggcagatcgcttaattccaggagtttgaaaccagcctgggcaacatggtgaaaccctgtctctaaaaaaaaaaaaaaattagtctggtgtggtggcacatacctgtagtcccagctacttggaggctgaggtgggaggagcacttgagcctggggggttgaggcagcagtgagctgtgatcaggccactgcactccagcctgggccacagagtgagaccttgtcttaaaaaaacaaaaaacaaaaacttaagagtttataacttaagagttattaagttattaatgttcctaaaaaacttataattcaagtaaaaagtgtatacaaatgtttcttcaaaatgattttatcttaaaagtgttagttcaggcccattcgggagattgaaaccacagtggggagcatattggaaactagagaaatgtctttctcctccatgtccattcagtgccctctgctgacaaaacttagtgcccactggcagaggagagctatttgcatgtttcagctccattttcacagagcagtgaaggatgggtttggagttgataggcaatgaattgaaatctggcatataagcttaatactttgatataaatactagctttatacttttttgtaggctcttgaactagacccatcaaataccaaagcattgtaccgcagagctcaaggatggcaaggattaaaagaatatgatcaagcattggtaaattttgttccaaatgtttaattttttaaaatagacaactacctttataaatcatacacctaacttaaatgtttttttccaattaaaggctgatcttaagaaagctcaggggatagcaccagaagataaaggtaagttggcagcttttgtagtgaaagttaattttgttatttaaatacttatcctcaggaaccattgttcactttgccagattttagatgtttgttcaacagacactacagaatgcctgctgttgggccaggcattatcatatagcaatgaacaagacagtcaaagtccctgccctcaaagagcttacattctactcccattcaagaatatagtagtttttcacgttatttattcttcaagttatcatctctgtagttttttatatgtctaaatactgtttgtcttatggtatcctttgagactgtgttcctattctggttagtctagtcgagagctcagcattgtaagacacagtattcatggtaaatttaacatttgggaccattcaagttgaatgtggctataaccttagtattgatgtactggttatatgttttaggaaactatgacaaaaataagcttgtttttcaaataaaccaactatgaatagtgacactagatctgggtattacaaaatgtctttggtctcttattactaaaatgaaacaagggaagcaattactgttctctaatgtagaggcagaaggcaaatcttgatgtacttgagttctctcagttgacatcctctaaaattacgtttcatttctgtgtttgtgtgattgctcagattttctgttactagggcttagttactttgtagagaagttttttcaaggggtagttaacattaaaatagtttgttagtcaccataattttttggatattttgagaaataactcacattgcatatttattttacagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattggtcacgtcacgttggtcttgaactcctgaccttgtgatccaccccgccttggcctcccaaagtgctgggattacaggtgtgagccaccgtgcccggccaagtaaaatgttttttaaaatggttatgtgcattattcataaaaaataatggtgtccagtctttttaaacttgtaaagacacatcttattgaataaagagatgagagcttaa

SEQ ID NO: 689 - DNA, 36584 bp, Homo sapiens
actgcgttttcttcgcctcgcagaggaaggtcggccttgcacaaatccgcccccacgaatcccaaagaattggagaaaacttccactttgggattatatgcagttgggattatatgagcccggggcttgcaccatgggtacgtgaggtgaagacatctgcagcagcaggattaattagcctaagatgggcatatggaggccactgatggagtgaaagcgggatatgcgggcccaactctgtccccactgggcgcctactctggcaaggctgagttttccttctgtctttcaatcagtacctattgagcgctgctgttccaagcattgtttcgggttttgagtgcgtaggccatggtctcagggcaccaaatgtacgtagtcgttttagccccgggactcaagagttgaggctgatgcctgcctgagagataaaatatcctttctcggatcagtttcctcacctgagaaatgggaacgggaatctccgccccttttctcccggggccctagtgcccactgaatccattaaggagctcttggaagggtggggtcttggaacacgcgtctacctcccaggaccctcgactaggaatctctggcccgccgcgcacctgagctggggggcgcggccaaattctccctcccggtcctcgaagcttctggccccgctctagagggggcagaaagatagcagatttccccggaggtgcgtctctaaacccagaccgcctcaccaaagcggggaggtcgtccttttttttttttttttgtaaagttgcgggaaataggcgaagacggggcgcgcaagggagctgagcctgggtggaccgcgtcagggcgcggggagctcgaggcgcagcggctgcagctccggcctcagagcccgcggcgtccaagtggcccgagctgcgctgggagggaggcggcgggaggagggaggggagccgaggtggagggggttggggggaggagggagcggcgagtccggtccgggttttgccggcagcccccgggcagcgttcatagctcctgcccgggcgggcgcgcggcggcggcggcagaggcggctgagcctgagcggggatgtagaggcggcggcagcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctccgcccgcgagccgcgctcagctcgggggtgattagttgctttttgttgttttttaatttgggccgcggggagggggaggaggggcaggtgctgcaggctcccccccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccggtaggtgtcgggccacggccctccctcgaccccccccggaggccggccccctccccttccccgcctacctccctctcctcccccggggttcggtgcgcggccggggccggagttcgctgcaagtcggcggaaagtttggctgcgcgggttcccccgaagttcaggtgcggagagccggggacggggaaggaggggtccgtatttgggaggggcggggggcgcccgcaccgtaagccgcggagccccggagcctgggagacctagcgccggtgatcgcttggtggccgctgctatacccaagcctccctaagccgcagtatgctcggtcgcagatcactgagttcagacaaaaagaggggttttagggtctgggacggcggcttgggcgccgtggagtggggctgggacgctccttgcggggtgccgcccccctcccccccactactccagttcgcgggcgctggggcagcgggcgcccggggtcctcacctcttggcgttgggcgggcgctcagcctgcgggggcggctgcttgtagatctctggcgcgcactccccccatcagaccccgctcgcagccctgtgttgaggggcgacgttaactgctctgggcgccctcgaccacgcgtggctgagcctcccccaccacttggaagaagcggcggctacttctgcatttttcctccggctcctcgcccccgctgcccgcggggtgcccggcgggctgatgaagtttgaccttttttttccatcaaagtatctcccccaccaccacggtgccccgcggcccctccctccctcctttcccagccttggggagtcttttgagctgtctcccgagccccgcgtgggccacgcagcgtgcagagcctgggagggagaatgggggtgttcctctagctgcggaactgtggggggcgtacgtccccggcgcctgccacgctgcactggccccaaatttacccatgaagttcggcccgacccccctccccttcgcttccccggagcggagtgaggggctgaaccgccgcgagaggaatgtgttaattttctggctgggggaagttgtcctcgcccggaatgggctgctttccggcggggagcgcggggtgcgcctggctttgtttatttgtaggatcgacggaaagcgagtgaccccggtttttaaatggggggccaccttcgggacctgtcagaagagctgaaacgcccaaagtgggagcaagatctctttttgttcttttttcccccccgggaatctgaaggggtgcgcggagttgggctggtgcctcgggctgcaaggaagcaccagtaaatttggggggttctgtagtgactcattcggaaagacccgctccctgaagtctcccgcgacgggggtctgaaggtttggcaaccgcgccctcctttgccccctggactttgggtggtctgagagtcgcgccttcggatggggggggagctaagggggtgaccagcggaccagactcctgacccccacctttcctcgcgcggcgggcgctgtttggagcccttggatttgtggtgggccctgtcccccccacccccgcattttctttggaagcgttggggagggggcgtgtgtgagatcgctcggccctcgcccccgccggagccgccccagggccgccggcaaacagagtccctttcaagttttccgctggggccgcctggcgggggctgcgagcgcggtcgctgcggacttgtttggagcgcgatttgaacgcccggctccacctcagctgccccaggccgcggggtggggggcgtctgtcctttgcagttgggagtatttaaattagacgtcttgggggacctactggcctaagcttcacctgatccccctcctgaaagatgcccgtgccttggtttccaaccgccactagaaaaccgggaactgagaccgaagccccctctaaacccctttctgagagccgtgcggggaaactcaggccggcgggctacctacccgtaactgcgtattgttgatttagcagtttccctagatgagagtcaggctggagcttgggggggtggggagtggcccgctctgcagctgtcacccccctcccagaacggaaattgtcctctccttggggaggagggagagggggtgatggtttgatttttgccctgggaagagatgggaacagctgaaggagattggcctccgagttcccagccagcccccggaacttgggtagaacccccctacccctcatcctcgcagtagctgggtctctcccagggacgcccctagtcagccttggcctccctctccatgccacctccctttccaaggtgagcctctgcagaagacagacccttggctggctggctgtcgggttggtgccttatttatgtgtgtatctggtcctggccgttttccccgctcagcaggtgaccctggccagggcctcctatctctcccgcgacagagcctgttgacttacccgagggccagtggcctcgtctttatcacgtgaggcctggaatgtccacccagctgggctaggctgggctgggctgggctggggtgggtgggggaaggggaggggaggattctgcatccagggcaccggccagcacaggcccatgttccatgggttcccactgtgaccctcaactcttgctgcccctttcctgctctgcctgcctcctactcatttggcacatgtgaaactgagacccataggagtgtgggggcaggcttgtatctgggtgaagaaacaagtccaggggaatgaaataccctgccttcttcaggactgactgcaccttgttgtttatgggaggatggagtggagggagtcttgctaggagggagagagggatgtgggctgggctgactttccaggttgcaggatagggtggaggaatgagggaatacgggtgagccagacccaagcctgggttcctagagcccctgtctggtggcttgatcatttagtccgaattaacaagcatgatgctctggggcatgccctaattgaacaagaatgggggggttcacacattgttattacgttactattgcccactctttatatgttattcatttgttggcccaatatgtttgtattgagcacctactgtgtatcaaaccccacccttctggtggtacacaaatgaatcactgctccagctctggaggcaggcccaggatagaagctccgccccgtttccccgccccctggggccctgattggggctttccctcttttcttttttctggggctctccctctcttacccccaccacctggtcccatcctagccgccggcgcgcgcgcgcgcgcgcgcgcgcgtgtgtgtgtgtgtgtgtgtgtgtggctgtgtatgtgtgtgtgaagtgtccttgattaagtgtattaatagttaaactctcactcatagctggaactcaccagaccacaaaaagcctcccccgttactcacgcgctactgcccaacaagaatatcccactaaagtttttttctgctttctcttacttccccctcacctccccccaacgctgagcccacccttcctggattcgagcaatgagaaaggactgccccctaaagacccaggaatctccaaccctccacctgccccctaaagccagaggcagtgtcagctgacagagatgaggctgtgtgggcactagtctgttgttctgggatgtgggaatctgggtgatgtgtgcttatgactcaggacatgtgtgtctctaagtagtgtatctatatctgtgaatctctgtgttgaatgtctgtctcagggtgtgggagtctgaacatacatggatttatgaatcagggcatgtatatttgtcctgatctagaagtgtgtggatctgtagtgtatgtgtacatgtgtgtttgtgaatctgagattgtatttctgaagattggctatgtccctgtgaatctgggaatgaatatattctgtgagctgtgtgtgcttggaattttggagagtttggatttgtgatttgtgtgtatctgtgtgctttgtatatgcttataaatctgggggatctgactctgagtagagtgtgtctgaattgtgaatgtgggagtgggcctgtctgtgctgtatggacagtggtttctctctgtctgtggtggcggctggctatgttttcctttctctttctgtatctccgtcttactgaatctccccctctggttgtttgaggccctgaatgtgtgtgtagcatggagtgtgtgtgtgtagaactgaacctctcacacccagtccttccccctgcaacccctacaccccttccctccccagcagtaactgggcagcctccccgtctgcctgcctgctgggagttttggaagccgcagagggagacaggctggggctggggtgacagcgtgtatccacggcaatggtagcatgtgattacgggaataaaaggattttaaggtcatgggtgggttttctggagggagggggttgtgcccccacaacccaccatttggtggagccagtggcagcaaagggccagcctgtgtgtctccatgctgggaagcctgcccctatgcaggtgaatgtggatatgtggggcttacctgggagtgtgagcacatgcttgcacatgtatgaacggagcctgtgagagcatgtgtgtctggctgccagatccccagatgagagtccataggcttgttccctgggggaggattcccaggaaaacttcttgcttctgggtattacatggagctggaaccccacagtcctctgtatgttgagaagcagtctggtcccaacctttccctgtacccatactcccaaccccaagtctagtgtctctggccagagactgactgggccaagtcacctgggccaggccacatcttggggtgtcagtgccctggccccgctccagcccctgtaattgcattctgccgcctaatcccccgccagctcaattagatcgcaaattcttcttcatttcctgcctctgatgctggcctccctctgggctcacagggcctaggagggagggaggggatcctgccccgccttccacagcactaggggctctagagaggtgattagttccaggcacactggccccagagcacaggttagaaccctggggaccaacaagacagggctccactggccctttttgggtcagcctcagtatcctcacactagggcagggctggtgttacctggtatgggggctctgggtagaccaagcagatcactctagccaggaccctagcttgtaccctcacctggggctcctacaggctctgcccctctcccatcctcaaagcagttgccatctccccaaccccccacggcagttgtgaccttgtttttgaccttttctgggtgtcccttgtcagagccaattgaaccactgagctccactgctaccggctcctcctaacctccacccagacaagtgtgtatgagcagtggctctagagtccatcagatctgactccaaatcctggacatgtcactgcctagctggatgtgtgacatttgggccagttgtgttatctctacaaacctcagtttcctaatctctgaaattggacggtaagagaatgcctgcctcacaaggtcattttcagatggacacagatggttgcatagtgcctggcagggagaggtgctcacctacaatctgtattcagtaaacactggcttttatagagacaaggaatgcatgtcccccgtgaatcctaagaaaataacatgtggctcacacctcgcacttctgtctccattcagctgattaccaggtgtgtgaccgtgggtgcatcactttgtctgactttctcttcctcatctgtaaaatgggactgataataggacagaccccatggggcacatggtagccttctctgagatgatgtgtgcagatgcttggcctcagtatgttttcaaggtgttacttgccttctttctttcctcaccccaagcctagggtggggtagagctggtgaagacacaggctcagggacaaggggactgacccaggtggtgaagctagtaatggggccaggctggggtagcgtgggagggctggggggtgacctgctggctcagctgagctgtgaggcccagccgtccctccccacaggtctctgtggaaagtggtggcttggctgatttttcctgggaaggagaagctggatgtctcccgctccttccccaggaggtgccgtggcagcggctgtgttgacaggcctcctggctttcttgatagggtggctggcagctctggaaggccggctgtacccagatcagccctagggaagagggaactgcagaggtctccctgccatcactaatccccgaggcccatcccaccctcagcctgtccctccatcgcaggaggagagctggggagactggctgtgatggaggtggtggagagacaggccagaggtggggcagccctccgcctcagggttccccattgctccctggctagtctcctgcttcctatgacctttgtcactcactggcctagctcttcaatatttcatggcccttcaagccggccccctaccccagcccacacagccccctttgtctctgcctgccaccccccgccgcccccctgggcatccctgccgctgaattactgacccagaggctgcctctgccttctcctaactgtcccccactgtgcctgcccctgacactttccctatccctcctgacctacctccccacacctctccttgtgacacccttcatctcttcgggattctctccccttcgctgacatctctgaccatctccctgcccttttcctccatttccctcttttgttggcctcctccttcccagtggaacagaaaccgcggcaactggtccgcctgcctgtccaccccccaaccactgtccaccccttcctgccccctcccccaccagctgtgccggccggccgtgagagctggttttatttatttttctgtttgtttgggaagagggcagtggcggctctgggccctggctgctgcgctctgcttagagcagcgggcaggcgggcctcactggcctcccaggaatgtggctgggacgccccagctatatttactcccctccagctgccggccccagcagggcagagccaggcctgcctggtggcccccggggagccctgtacccgccctcctctgtctggcagaccctacatcgcccttgggcccagcactccctcccttgcctgtgaccttttctgacctcctcagacgtgcccagcctgccagcaggaacacttgtgtgccatgccagtacgggcgtaatgttcgggcactgggggcctgggttcctgtggggcaacccctagcggcccctacacacccaagtaggggcctaggctgggcctgtaatccgatggccagaactatgcaaagcatctttccaggcctttctctgtgggcctggcccctgctcttgccacagtccccttggctctgctgtgatcactggcaggggtggtgtcaggtgggggcctcagtgggcttgagtggctgtgctcctggcatcactggatccccaggtctctcacacaggcacacatatgtacgtgtaacacacctaagtgcttacatacacacacatgtgtgcagaaagacaccctcacccatgaaaacatgctggcttataccttccttgcaggcagggccgtgcctcctgtcattgatcccctcattcatcagatgcttattggggctgcttattgggcctgctccttgccagccttgcaatgggatatggcagtgattacttcttgtacccccagtgcctggcaccaaataagtgtttgaagaactttagctgctgctgtaatcagttgcggcccccgttaactgctattttgtttttgtttttgtttttgtttttttgagatggagtctcactctgtcacccaggctggagtgcaatggcgccatcttgactcactgcaacccccacctcctgggttcaagcagttctcctgcctcagcctcccgagtagctgggattacaggtgtgcgccaccatgcctggctaatttttgtatttttagtagacatggggtttctccatgttggccaggctggtctcgaactcctgacctcaagtgattcacctgcctcggcctcccgaagtgctgggattacaggcgtgagccaccacccccggccaactgctattgttgtaatagattgtaacaaagccagtggtaatgggtagcccaacgaaagtcctctctgtggcaggcaccatgttaacagctttctgactttcactttttttcatccccacagtagcctcaggtgacatgggcccatacctgggacagatgcatgttgttagcatccccatatacagataaggaaactgaggccttgggagtttgtggcttgccactgcctagtgggatggagtcctggcagagcccttgacaggctgttggcctctgtgtgctgtttcctgcaccttccacactatctggcacacagaagggactccttaaatgcttgctgggcacaggccttgctctttcctctttgaggcccccataacccttggcaatgggctggatgtgttgggagatgggctgataggctagttgggcagacaaaagtgaatgaatgaatgactggatgactggtggtgaggataagtactgtcaggggacactggggtagggggttgctggtgaacaggctggcaggtggagacctactggccctgtggaggattctgggaagcaaggtaggggcaaggcggagagatgtggccagagagcaataggctgctaagccaagccagtggggcgggtcctatcttctttgaggaccacaatttttccatctgtcagatgggcttgggagcctttgtcctggctggctgccggctggcctgggctgggactggcctgggaggtgaggggactgtggcgggaaggaggaagcagtgggtggtgaagacaggaagataaagcgtggagcttggcttggaacctgagaagcagagaccagccctgacctgacgcccgccctccctccctcctagccgcaggatggggtgcaggcatgcaaaccccccaccacccactctcactctggtgcgggctgacttcctgacatctgtggcattagtggctgtgtgtgccaggaggaggtggcctgtcccctaggactagaccagcttctctccaggccaggggctcccgacagcttcatgccagttcctgttgactctgatgggagagacccagcccctctcctgcctgacccacctcccccagaactagatgggaaattagttaactgggctcatagcagtaggcagaagtggacctggccccctttcttcctggggcggtcagatcttggtggcctagaatttcttagtcatgggagtctagaatcatagatagaatgcttggaatggaggcatttttcaagtcaggattctcgttgggattctggaatcacagaaccatggattttgctgctagaaggaagtgtaaatggtcatgtttcagtctccttgtttgatgctaggggacactgaagctctaggggtcaggctgccctgaggtcacagggcctcttgtcctcaggtgacatgagcccatacctgggacagaaatacctgttctgcccctagccagcccctctctggagctctagccggtgtggagagtgggctgtgggcccagtcaggcagtggggggatgcggctggcccacaggcacaggaggggtcctcttggcggtgcccgcccgcccgctgcccacgcttcccgaggcaccagcgtgaggaggaaatgcaggctgttgcttccagcaacagccggcagggccgggcggcttcccagctccccctctgactcatggccgcctgcagctccccctcccttggggtcctcagcagccccatctgtgcaatggggagaggaggcttttttcaaggtctaacatcaccctgacaataccttgggattcttttcaagaccactgttgaactgtaggagagttaggagtgtcatctagagcagcctagctgggcgtttgaacccagaacactgagagattctgtttggagtcatcctaatgcctccagaagcctgggagggctcaattgactcctgaggcagaaagtgtggtgggaggcaaaggaatagtgaagggacctgcagtcaacccctttcaggaagagcacagtgggggatgcgtggctctctgggctctccctgaccttggtttgcccatctgcagaatggaggtggttacccatgaggtcattcattcagtgtctgtgctgtgcctggatgctggggctagtggcagatcggctgggaggggaggattcctctgctgcagacgggtaggggtgtgacttggtgactcccggggaaggactgaggtggggggaggtaaggagccggccagtgaggcgcggtgtccagcggaaaatcccagctgttgtcaggaagtgtttcctccactggtctcctgggagggagacaggctagcaggaaggagggcaatgggggcaaataaggcccccagccagtccaagtggagacatcccaagcctggcagctgggcgggtgtgccccgcacactgcaggagggctggaatgcaccccccatgctctgaggctgggcctatgctggggggctgggactgccaagaggggctgggccctcatccagatttcaaagccttccccaggggccttgtggtgccctccaccctgtcctgagctgccgctgcgggggtggcagatgctgtttcatcggtcgaggcaagtgggagccctccggaaggtcctcctgggaggttccggggggcagcaggggtgtccgggggcagtgggggtgtcggcagctgctgccccgcctgggctggctctcagtggcctcccaggtcctttaggccccggggcctggaggtggtgcttctgcattgaggctggtccctcctgcccttgctttctcccactgcccaccgagcttcttggttggctctggccccctccatccctggctgtgtctgcaaagccccccgggaaggcagggaggaggcgcagcaggctcagaacagcgggtgcccgcgcagccaagtatttgctcgagctgtcagagacagacaggcatgtggggaatttggtgcgtgtggggctgggggaagcagccgggtgggcaggcaggcaggaggagggaagctggggctgcctcccagcctgtggaaccctgcagagaccacctctccccagtcctagaggcaagctgcatccaggcaccttcctcctgcctgtgccagtgcagtgaggggagcgggatgatcctgtggggtctgataatagctctgacacggggaagggggtgccttgtcgagggcctgcaggctcaaagaggctctggtggagtgtggagccaggcaggaatccgggttgtgcccgactgtggcctccaggaaatagcagctgtcatgctcccgcccctccaccccaagcctggcacaacttgtttcctggccaggatccggccagggcagattggaggagcctggtattgcccggcctgggcaaggaacaggcaggatgcaggggccatgtttataagcctaaaggcgtttggggtgctctggggaggggacctcagcccttatctcctatgcgaagaccccaacccagtcacctttgtggtctacactccaaaagcacccattaggtagggtagggcccagagctgagtaatgcttggtttttcgtagcttgagagcccagagagggggatacgctgccccaaggtcacacagtgggctcctcagccttcccctctaccctcatgtgggtggggccactgggaattggtgaacatgggggggtttgctggggtggggggcctatatttagtcagtcctgcagagccagggcgcctctgggagcagctgctggggttggggggagtacacagacagaggcctagagctgcatttagtctggacagaaatatcctccccccacccacccacccactggctgggaggccaggctgcgggcctgtcccctgaggggcagcttgcctgggcctggtggccggcgggacaggcaagatgacccgataggcttttcccagctcaggtttcgatgaaacaggaaccccggagctgcagcctgggccgagggggccagggcagccggagtctgggggaccaggacagcctcccccacctccgccctcatgctcttccccatgctgcagcctccccttttcagaggcctggggaagcagcaggttatttatcaagccagcctccccgccgcggctgcccgcgccgcccccccacctcttgcgctgtcggccatcagcccagcagagcagggtgagctgggcgggcgggcggcaggattagctcaggagacgtgagtcaccccatccccagcagccccgagaggccctgcggcctggcagttagagtgcacactcacgcaccccacacgcggcacacccaggcacacacttaggacagacacagtcacttgcagcacacgtagttccacacgactcagcacacccagccgacacgcgtggtacagactcggtcacatgcaccatgcacacacagctcccatgtggtgctccagaagcacactcacggttccagccacagcccagcctctggcacacacacccactggcacgtacctaggcgaatgcacatacacaggcacacataggcgtgcacacataggccactctcaccccattggccccacacactggggcctgatcattctcaggccatagcttacccctagatgatgccatagagtgggccagggcactggcacacacaggcgcagctgctgtggtcagggctctgttcccctagacgccccgtgtttaggcttacacggaagaggcccggccttcagccatgttgtgtccaccgggttctgcaaggtgtgggtggggaagtggagatggttttttcccatagccaacctggctctgccctctctggggaggaggtccaagtatcaggcatgagagtgttaaacccactgccctctagtacggggcctctggcccaggcagagtgggttgggtacatgggggagagatacaggggagctgggaaaaggaaaggctggagaaggagtgccagggaaagtcgatttccccaggaccactaagtggccagctggttccctgacctggggcatggggtccttgggaggtgacagggtgtgccagagatggggggaagaatgagacctctgatcaaatgggcccaggagtctttctgcctaccttccctgcttaccacacacctgcttctccctgtccccttagttgccaaggccctcattatccagtgcccccacttagattttggccatgtccctggttcttagtctacagccctgcaaaatgggtacagagctggcttatgtataaggaagtcctggggtgctgagagctgagggtatgccctcagggagcctttttaagcctctgcccgcctttggggttggggcctgccttccttgcactgggcagaaataaggatataccccttttccatatgctgccaaaaaaaaagccgtttttcagatgagagaagtgagtctgatgggaatggcttcatggtcatgaagggctttggatgcaatctcctaacacccagactaccggtcattctgggcctacagtactgagacagcctagcagtggtcaaagggcatgtggctataaggactcaggcccagttgggctccctcctcctggccacacagttctccataaacgactggaccgtggttgaggaggagagagggacccaagcatcctgagggacacaaacagcagtggccagtcaggaaactggatgcccgtgccgcggactctggagttggacaggcctgggctccacacctggcttggtcgctgcctgctatgtaatcatgggccagtctgctcacctctctgacctcatgtttgtcacctgtgagatcggtatgactctcatctctgtctcaaaaccgcaggacctgaagtagatggtggggtgtgttgtcatcagttctcattatgtcacctggatctccaggcgagcatgcccctccacctgctccactagacctggcatttttctgggggtggcatcccacaacaagggctccttaattagaatgtcttggatttagccttctctagggctgttctcagatggggatgctgaggtacctgagtgaagaggctgagctgggggccaggggttgggggagggatgggaatgggttggacccagggcaaaggaacccatgggtgttgggtggaaaatcctggaggcttcctaatatcagagggagcagagagagccgactgtagtttcaaggctttctctgtctcccaccccctatgctcacacagcaaggctatatgttagacttgagcagggacttccaggtggcaaatggagcctttgcagggtggcgagaggcttgggatgtgcctttgtggcagggctgtcagggctgtgggagatctaagaagagccgacatgagctggcagggctgagggcgagggaggtaggaggaaaggctgtctagaagtgtaggtaggccttcttcctttgggcagaagaggagatgcaagcctggccagtggggtgctaccctcgttgtaaccttcaggcttctaccacatgtccatccccccatggtcctgcaggctagacggggaatgctttgtatttggggctggggaaactgaggcatgaaggattgcctcagagctcaaaagcaaatggtgagagaaccagggccatgacctgggttacccaacacgcctggcctgacttgtccgtgacgttcacacttatgctggcagatgtggacagtaaaaacaacaacatggctatccttagttgagcacctactgcatgtggacgctacactgaccccttcacataggtcctctccaggacctgacgaggtgggggctgtcagcggctgcatttcactggctaggggttgggctcagcgagggtcagcaacctgtctgaggtcacctaggctggaggctgcagagctaggagaggaatcctgactccaaagccccacttggaccctggcatggcctgagcctgtgtctctgagatgaggggctcccctcgccccattacacacaagatgtgtagtgttcctagttgagccagccccctcccccatgcccagctccttaactctcctaggtccctctgctatctcaaggcactttccaggtttgaacctaagagcattggaactgctaacctaaccccttaactccagggaggagggtggatgggtgggtgggggatcccctgaggagcagatggatgccccttggggtttctgggttcttcctgcagacaggttctgggaaactccatggttaggcctgtggaagctgcctcggggcctggtcagggttgcgcacctcctccaccccctccccaggggctccatttccctctcctgggcaccctgcagggaggagttgagcaagtgcccttgagctggcacttcctctttggtatacagggacatagccacaatgaccccccatcccgtggtccgtgtgtcacttagcaccaggcgctgcatggccctgggtcagggctcactaaaggtcacttcatcgggttgactttactagaggctagtcccagcctcagatcatttcccctttctggtctcagtttcttcatctgtgaaatgactgtgcgagtctgccctgcgtgctctctgaggcaggggtaagttcattccccgcagacagacacacttaggagctttgtgactggtgttccagtcccccaggcccagagctcctgtagccctgacacctgcacaggggtccaggggaagaagtgtgggctctagagttgggccagccttcttttcagcctcacctccactgtccacacttgcttgaccttgacccacaccagtgccccactcagctctgagcctcagtgtcctcatctgcaaaatgggagaatcatgatgcctacctctgtgggttgctgtgaccatcaaacaagatgatgtggacagagcacatggcacagaactgatagagtgtggtgacagcggagcccttccccccagactatcctcctggtcactgtaccccagccttggtcttgaggattctgggaaggagatggtgccaatctgctggctcagccagcttggccactgaccttcagagcacccaggctgtcaaggccgccaactgcctgctgggcgggcaggggggagtgccagccagctcctcgcctgacgctgcccgctcctgctcccactctcctctccctctctgcgcctgtgtgtgagctaattaatctcagcccctttgggaaattagaacgccgcagccgcggcctcctcagcctcgcggtgcttgtgctgctactgggccatgccaagacccgctgtggtttaggggcaccggggtgggggatgggggcaccgggatgagctgggccggccatgggtctcccagagcccccacctccttgctggaatgctctggtctctcagccccctcctttcccagatagcatccataaggatgccaggccagtgcccaactgtggtaaaacctaacccccagtggcctctctgacctggtcccagggctgttatggccacccccttacaccacattccatctcattgcagggtcctcttgcctgcccagcttgggctgatggagacagatgtaattatggaattttgcttgggaaattaatttgaaaaagttaattaattggtggttccggaggtggcgggctccacgcccggccagtcttgctgacgtcagtgctgacccactggagacgtgcagcttccgggcaagctgggcagagggaccccggtgacctggctgggcagccctggaacaggtagatggacagcgaggagcaaagggcagaccagtgtcctggcccagagtgggcacctgggaagggtttgttgaccagacctgctgaggataagaacccggccacttgtttgtgtgttcaacaagccgttgtcaagctgctatggtacactgaccccagtgtctcaagtgcccccaaccaaaaatagaccagttcttccaaaccccttttctcaaggaaaacctctaaacctattctcaaaggctttttcaaagggctcaaaggacattatcgggccagtgtgcagatgaagccactgaggctcagagagggtgggccttgcccggcttctcagcagtgtcctccagcagggtggagcagaggtgggtagagctcagtctcatttccagaggacgtgtgccccagcttcagaatcccatgggcggcctcctcccaagtatgggtgataggggccttgaagttgactcttcccagggaggaagccacagaatatggccagccccttcacccccttcacccccatccctgtgtgtgcctgtgggagcttcccctactaccccatccaagcctcagaagacccccatgccccaggggtctcagggtacacagagacccccactacctcctggacctcctgtgggtcttctgaccacaagcctcagccagatcaagtcctagtttctgcaggagcgtgggctttggtgtggtctttgtccagacaggagaagggtcagggctggggcaagaatggccaggcctgggacaggtcagggatactgagccacaaagaggccagggagatgaacgtgggcgctcctgagctatgtggccttgggcaggtcccttagcttctctaagcctcattttgctcatgcgggaaatggggatgatcacagatgccattcagagagctgcggagaggtgcagggacgcataaccacttgaagtggtgctggctctggcgcaggctgtttcactgcccagtggaggcaggctgggtggaagagcagtgagctgactgagactgtgctgtggctggggcctgaggaccagtgggttttgagaggggagcctggtgcatgtgtcagaggaactgaagaatacaggagatgatatttgtgagaccctgggccctgctccaacggagtcagcccacccagcatttaccctctgacttgtttcttgtgttccctcacctccaggatttccaggggccaggtgggccctgctcagtttagtatgcctcacctcccatagctgttcaggatcaaagggagcatcatgggcaggctgagctgggcactttgcatccctgtcactctgatgtggtctgtagttctgggtttcttcaaggtccaaccccagtcttgggtttaagtgggtcacacccactccctgagcatcctgtgtaggctggttatggggtcagaggagaggcatttcctcctcccacctcacctcctccaagaagccctctgggtactgctccccagcactttgcccattgactgagcactcagggttctctgcacagacttttttaaacctttctctgtgtgtccctacactgggagctctctgaccacggggtccatggtatctcctgtctatcctagtgcccagcactgggttagcactcaatgtgggggcatagggctcttgtgcccctattttacagatgggtcagttaaggccctgcaaggtcacacagcctgttgaggggcagagccagcctggttcaggtgggtgtggggccacttggtaccggctggggtcttctttcaggcctcaggaccattcctaggcttccttaggccctgcagctcctgaccctcctggcactattcctggagggtgaatagtcagtcctgtgctcttaagagcttgggggtttgggggttaaggggttgtggcatcagactgagggtcagagggcaggcctatgagcttcagtttcttcatctgtaaaacagatcttagtgtttgggggagcaggggtggctgaaagagatcacgcatatgttgttctcgccatccttattattactactgacactgttattttgttatcattacattattattcatgctcccagggccccagcagctgcggtggctccaggcctggatgcagagctctggtgtgctgaaaagaagttgcagttcctaattagtcagcgctccaaggagagggcctgggttttaatttttgctgcagggtcccacctgcccgaggcctcccagcccctctcatcccttcctgggctgggcctgcggcaccctccccaacctcaggtagggggcctggcccgaggcaaaaacctccccaaatttcccctgccactccctccgcctcccagacctctggggccatgaatcatttatgaggcaaaaatgaaaccaattaaggacaaactttgaaagcctctaattgctgcgcctggtggcaccgtggaatgaggggaggccagccttctcggtgcggaatctccttggcccaggccttcccaggctgcccgtcccgccgcggctcagggcgcctcccggctccctgccgcctcccagccggacgcggacgtgcctgcgcggctctggcggccgcgtctgccgccccggcgcccgcccgggtcccaggccgactaattaggcccggctacctcccgcgccgcccactgcccgctccaggcccgctgcccgctccaggcccgaggtgatggcggctgttcctgccgttctggggcctgtgccccagagctggccgcgtttctcggggcgggagccagctctgctcgcctggcttaacccagacgagcccaggacgccctatccctgaaccccatcgtggcgtgcaggtctgagtaggctctgggccatgccggggtacctggcttggaggctctcttcagtctcgggagagatatgcttatcccaggcggagcggagaaggctgggggatgactgatagggggagtcgggaggggatgttgagccctgaggtgttgcactgagcacggatccagttcctcttggctttgccacaaacacagtgaccttatgtagagtccttagcctcggtttccccgtttgtaaaccatcagcaccagcccattttctcctgaatttgggatttagggagctgggctttgtatacccctcccagtctcctctcttggggggttgctgagggggtggaggtaatgtctggacctagcagggcctgccttactgccatgagccctggatgccagtggccagcctgctcgctgtgctgagggccaggcaggccctgggcactgaggcacgttgtttgctgaaaccaaatttctgtgcttgtgtttttccataattatattagcaggtgggatttttcctcggggaagcagtgggagggggagcgccatggcagtgtccccgcccgctctaagcgtgagctcacactcagctctgcccgcctgccgtaatgattttttaattatgcagccagtgctcggaattgctaatccccctccagccctgcatcccctcctgcaactcacaccccagcccctggctgatgtccctagagtggcggtgcccagccccgtgcccatcactgagtgcttgggacaaccgccatagcgggagagagggtaggtcaggaagggccggaggggcgcccctccgccatctgcaagtgacaagacttgtggctctctttgtctcccaccctacccctagacccagcatggctcacacctgccaggacagctatggctttaaatgagtttggggagtgatcggtgcccacaccaagtgatgtggccacactcatttcatggacattagcctgtcttcccagccttgtgtgaccccaaggacacaggcacacaagtacaatttttgtcacacccatactcacgctttacttcccttctacacacacactcagccccacagccaagctacacacacacacacaatggcaggctctgcgtgcttctcacacatgtagccttacctgagggcgggggcaccctcaggagaccccactgctgcctcctgtgccctgcagtggccctgctcccactcccttgcctccagaccccccaaccccatccccatccaccctactgggaggtgctccgaggtcttctggctcccgcctcatggggtggctgcctgtggctggggccagcctgagcctccatcgaccctggcctgggggaggtgctgggggggttctgcagcactgtggcggcggctcctctccaggcgcccagctgtggcatctgtcaaggtcagatagcgactccggaaccagccggctcggccccatggcccctctcgcctcattatttttgtgttccggggctgcggcgacacctccctccctcctcctcagcctcccgcctctcgcctgcctcccccacgcctctgcagggagggcctgcggtctgggggcttttgttttccagttttttccacgctcaggccaggcaggcgggtagacactggccagagctgttggaccttgaacagcagacaagacaggtgtcccccttagagctgggacagattctcagctagtggaaccctgggttggtttctcagaggcacaaactgaacctggatggaaccagcccccaccacagcccaggtgcacctgtgggcagcttcctgtttccataggggccctagcagctggcaccagttcctgtctacaccatccccgtcccagtagggccccagactcatacagcccagagctcctgacacaactcacagtgcatgcggacatacacacactggcattcatgcggcaaagatgtgttgacacgtacagaccagaagactccacaaacatcctctcaccacgtaaaccaccctattcgcacacacgtgcacttggacatccatgtacattcacagacttgggtcgcacacacatgcctccactttaccctcagggaggtcacagagtcaaagatctcccccagcactgctacatgatccccatatatgctttaatgctgtggtctgtagagggcgacatcttgagactacacactcaaccgggcacattcacagtccactggacacacacacagttgtgcagcacacctcccaggtagacacgcgaaaacacactgtatgcattgctctcgtcaccatacacactccagccccctgagcccgctcccaggtgcccagcatccttgggtagttatgccacccgaggggcttttgtcccccgaaatactgggaagtgagcttgaggcctcagcttgctgagccctgtgtccagggagcctcggagagtgggaaatggtttgacaaggactgcccggcccctgcccaacctcactgtgtacaccactttaggcccaagagcgccaggatggcgtgggatggggcggggggttccaggtgtgtcatgatgggcttggtggctgctggcagaggcagactctggggggtgacctcagctctgtctctgggtccctcctcccacctccagcccctgatttgggtgtgtaaatgttggaggaatggggtgtgggcagactccaggcccccagggtctctagagtggccctggccatcccctctcttcctcctccagctgtggactgctgtgactgcccccgggagaggagctagatggaggcttagcagtggctgggcccccaccccccaggaaactcaaaaccctgggccagccgcgggtggcgggttggggcaggcacaaagagggcctctgtgcggccggctgggctgcccacaggattctgggggaggaggccggagccggtttccgtcccgttctgcttcctgcggaggctgcggaatgcccggagctctggcccagcctgccccgtctggcccacccgcagccccttccccatcttttccagggccttggggtacagctgcagacttctctgcaacagggccctgagagccaccctccaggacccaagggaaacctaggggatttccccaagccgagagctgaactggacctcaccctttagctgaagtcttccttccctccatgtgctgtggaaccctcagccagggttggagcaccaggccctggagtcacacagacctgggtttaaatcctggctctgccacttactgaccttgtgaccttaggcaggtggctttatgtccctgagcctcagttgcctcatctgtaaaatgaggataataataattgtagtagaatccggtgagaaaatgcatgtgaaatgcttagcacagtgcctggtggacagtgagtgtgcattattaggacctgctgtttatttttttttatttatttgtttgtttgtttatttattgttttgagatggagttttgctcttgttgcccaggctggagtgcaatggcgtgatcttggctcactgcaacctctgcctcccaggttcaggcaattctcctgcctcagcctcccgagtagctgggattacaggcatgcaccaccacgctcggctaatttttgtattattagtaaagacagggtttctccatgttggtcaggctgttctcgaactcccgacctcaggtgatccacctgcctcggcttcccaaagtgctgggattacaggcgtgagcctgtacaggccagggcctgctgtttattttaatgtcctctggggaacttaagagtggaagggactggatgctccttgccacgataggtctcacctcttctacggttcagtctcagccctgcgtcctgctcaaaacccttctctcaaatcagtttcctatctgcagatcatatcagtgactgatctcggcctctggggccttcctcctgaggtctggagggtggaggggatcgctgtctggaatcctttttttcccctctgtatctctacctccttccccatgatatgccctgggatcgtgacttctgcagtagtttggggtgagaagcaagagccattcctttccattttacaaatgggaaactgaggcttagtggcggaaagagcttggtcaaagtcaccagtcagggagggacagggtggagccacaaacctaggcctcaggcctccagttccctagccagtcctaggcacatatgcctcccccaaccccagacacacaaacacaccccacacaggagccccagaaggacagtgcgccatctctgatttcttgactcgtgcatccctggactagccttccctggcttgtcccatggtgaggcccatcagtagggaggtcctgagggggtacgtgggcctgatttctgattggtgtcagctcagagatcaccacattgggaaatgtttactacaagattcaggggatcccagatagacaaggcgtcattacacctgcttaagcaaattgcctgctctaaatggggcaataataggacttccttcagagattgggtatgaggataacatgagataaagcatggacagtgtggcacataggaagagccccatacttgttagctatggtcccaggtgacagatgggaaaactgtctcagaggccagttttttcccaaggtcaaaaaatggggaagggtcttcctgaacctttgactcttccaggaaaggaacctggcctgagggaggtgcctattgaggaaagggcctgtctttatcagaggcatcccaggcatctcagtccctagagccccaggtcagagcttactccctgcccggggcctcagtgttgctgtgcatgaatgggctgatcccctcctccagctgttttggggagcaccgtaaaacagaacagagcctggctgggtgcggtggctcacgcctgtaaccccagcactttgggaggctgaggtgggtggatcacctgaggtcaggagttcaagaccagcctgaccaacatggtgaaactccatctctactaaaaatacaaaaattagccaggtgtggtggtgtgcgcctgtaatcccagccactctggaggctgaggcaggagaattgcttgaacctgggaggcggaggttgtggtgagctgagatcgggccacgcactccagcctgggtgacagagcaagactcttgtcaaaaaaaaaaaaaaaagagagagagaaaacagagctctacatactccaggtttgctcaaaccctttagtcctcaggccaaggcatggttggcacccaccccagcaggaggggtgtaagagggtcaggggtgtggagtcggggatatagaaatgctgtcccttgttctgtccttggcagtcagtcttggggtgactctagtggggttgaggccatgtctcaccccaggccaccctctgggtgctcgcagtggccagtgtgtgggggtatgtgtgtccatccatagctggatgtgtgccctgtgctctccgcctggggctgcgtttctccctgcctccaagaccagtctccctgggcttgagcagggcttctttttccctctggaaactccccaggctgaatcatggaaatcagagacgggacaccctcccttccaccccattgcccagcttggttcaaccaccatagcctgtggtctgctttgcccaccatcagcctgtctgcgtattttgcctcacttggaggcaggccaaggagaccggcccaccaaggtgggggggaggagacaagggccgggatgtcaagtgctgcatggaagcgtggaaagtggtgcattgagccagggtgtgcagctctgctgggccagtgttgggggtcctgaaacgcagcctcttccacgagcctccctgggcaggcagaatggctgcaaggctggtcagccagcaaggaatggcggggatggtgccttggtcaaaccctgcccttggtagtggtgatggttgcacaactttgttgatttactaaaaatcattaaattatatgtatactttaatgtggcagaattttatagtatgtaaactatacctcgataaaactgttttttaaaaatcctgccagccaggcgcagtggctcacgcctataatcccagcattttgggaggcccaggtgagaggattgcttgatcctcataggaagacctcatccctactaaaaattaaaataataataataataaaaattctgcccttggcctcaaggccctgcacaactgggaccctgacagcctcatagacacacctcacatcttcttccccacctgcttaggctctctttcatgcctttgtcccctctcattgcttctccttatccttaactctcaaactagcagtcccttcctccaggaaggcctcagatagctcattgtgtccccttccggctcttgtttcacgctggttcatgtgactgtgggcccagctcctgtgcactcctggaaggcagtgctggggtctgggtctgtgtgctctgctgtctctccggtatcataaggtacagggctgctgtcgaggtaggtgcagggaagatgtgtgcaaaggaatatctagaacatccagctgtgggccacctgtgtacatgtctgtgtgcagatggcactatgtcatcccaggatgtcccctccttcccagtgctttctggcccgagagttcaagattgaaccctgcggggggtgaagtgaggctcttctagggctgagggttgaataagggcactgccaccacctccagtgacctcactgccagctggcattatgatgtcactggcttagcattccaggccctgggcatctccaagtgccccaggtgggggcactctcctggggtctgtgacagcttgcccccaaccacggagaggtgacaggcacggtaacaatcctggggagtgagagcagccttaggggtacctaggtcacctgccttgggccactctgtcaattgcaaaagtggccacagaacagggtgactaacacttgggctctgggttcaagctctacccctgctaggcaccagctgtttgacctgaggctgacagcttgaacctctctgagcctaaatttcctcatgtctgaaattggcaaatagtttctgtctcccggggttctggggaggcattcagaagctaagacatgtaaagcataaaagcacagggcctgggacacagtagatactcagtaaatgctggttgataggatccgttggttaaggaaaccagagtggcaacacaggtggtgggggctggctagaagggggcaggctccgtgccttctggggctggccagagccttagggtagaggcacggggtggcctccactgccaggaaggtggccccaggtatgagtctccctccttccagctcagccagttagctggagcctacaggaggcattgggccctgcagccatgctctggggccaagaacccattaccccccacctcctcctcggtactccccagtcctcctccccagcctcctccccacctcctcccaagtcctcctcccctgtcttctccccacctccccccaagccctcctccccacctcctccacagtccttcttgccaccctcctccccacctcctccacagtccttcttgccaccctcctccccaccctcctccccagcctcctccccccaagccctcctccccacctcctccccagtccttctccccaccctcctccccagccctcctccccagactcctccccaccctcctccccaggcctcctccgcagattcctccccatctcctctccagcctcctccccacctcctccccagcctcctccccacctccccccaagccctcctccccaggctcctccccatctcctcctcagtccttctccccagtgtcctccccaccctcgtccccagccctcctccccagactcctccccatctcctccccacctcctcttctcaggccttgggctacacagtgggtctgatctggtctcctcgccacttctcctctacccttccctctgcctccctctcctgtgggcatgcccagctgccttctgggattccctccttagggctgtttccttgtcttttagaccctcaagtccctgagcctggacaaggtgtcctgggtccctgggtctctgaaccctgttaccccagacactgcttcccatgacactgtctccactaaccttgaccctctgccccttcctctccagctccccttttctctgatcctcccctctagttctctgtctcatgattctgtccccaccacctgtctctattctgcccccgcatgcccctctgccccccagctttccatgactcgtcccccctcagccccccgtgctctgtccccgcccgtcagcccctggtcccagctcccggctggccggctcctgcatggacaaaggggtcctttgtgggctgaccgcggctggcggggcggcggggcgctggctccgcattgctgatgaaacggagccctttgttgtccctcctcaggcgcagtatttctttttgggggctggatgtgttcctggcagggccgatgatggatgcgcccgccgccgcccgcctgcccgccagctttccctcccgctcattcccgctccgcttcaacgcagccctgactcctcccctgctgcctgggcactgccaggcccttcctggcctggaaggggatggctgtgtgccctagagtagaagactgggacctgggagaacgtcccctctatgtcctcctcttccatgagtagggcaaatggggcttttggtcaggggtccactgggaccaggacatcagtttttcctaaggtctgaaggagaagatgagccaggtatcagggccgatttggaacaagcttgaggaccagatgttcatgtctgtctactctggatttgaaaacagagttgtccctgtgagccagtccctccgtgtacccacctcccttcaacttctgtggctgaaaaaccatagtgttctgcctgcagcacctgtttggtgacatatcacatcctctggtcccaagctcagtatgtcccaggacctcagaggctgggggtgggtgggccctgaagaaggatagaatagtggaagatcagagaaattccaagagaggaacagaacatgaggtttggtccccaccaggagagactcaggacggagacaaaagccgagacactcagccagagcgccagccctgagcgcaggccggctgtgttggaaggagctgacttctaattgacctgcccgccccgcacgcagagccagatcctggagctgggaggagggagggggtgagcagagcaggaacagcgttaatgcagctatcgatttctgccaccagccagcaggccgcagaggcgggggacgcacacaggggctggggcgcagcctgctcccctccccatctctgcagcccacaagacacctgccttctgccttctcccctcacccagtatctgggctgccggggttgtcgtccagggcagggcagatgagcttagttgggcaggagctggatgagctgacttgacggtttttgtccctgatctcactgaccctggtccccaacaactagccagggtcactgattcctgaaagggtcaccagtctctgaggagaggggctgaaaagaccatcctggtcttggccgttatgaggtgggagggaacacagctatccttggacacacatggtcttcttgcttcagctctgacctctgatgccccccaacccagcctggattccctgccagggccccccggctctgtcctggtggaatctgccatcttgcccagctcttcctcctcacccatttccctctgctaggaaggagccctaggtggtctggtgcccactggggagggacagggagtatctgactgttgatggcggctactcgcctcaccctagagacagagcttttcctttccccacacccggtcctctttggccactccttagtcctggggaagccccccctcccccccgcttggggcctcagtttccccctctgtaaatgcagagggttggactagatgctctcttgggacaggcttgagtcctgtgactaggggggttttggggttgcctggggacaaagatccagtgtgtgctgccctcaagcccagggcgtgatggggcccgccagatgtgcgcctcccccttgagcctccagctgctctggggctgggccctgtcctcccacccctctcttggggcatgctaggccacagcaggcagacagggaagcaaggctggagagccgggactgatgaggaaaccgccgccttgctccatctggcccagtcccttcagctgaggaggcagctcagacgccttagccttgaaacctgagtagagcaggccctgccccgggatgggctgccttggaaatatggaggtggccagaggacaggctcctgctgggctccattcccttgagggtcacgcctactcctcagtgccagcctgccccagccagaggtccctcctggcaacagcccaccccggctctctgggttctcactgagacctccacccaggccctactctgcaggccttgtgaggcctctgcccaccaccgcccccaatctgggagccaggccagagcaccacagtgaggcctgagtagagacaagaatgaggtctgagacgataatgattgtggttcgggggttgagaaggaagcgtgtgccagggtgtgcacaagcatgtcctctcactgtggcaggggacggctggtcctctggccctgtgctgctcgccctgtagcaggcggggagaagatccctgaaataagggttctgcactcattggcaaactgggttacacaaaggcaaccaggttcctttgcctgcaggacatgtcagagccttgaaataactgatgtgtattagtaatccccagatgaggatccaggggcagccttccagacttaatgatctgtaccatcaagcactcttctcctcagatggagaaggaagattaggatgtggaggtggtttttttcttatttttatttttttgacaggatctcactctgtcatccaggctggaatgcagtggcatgattataactcactgcatcctcaacctcctgggctcaagcagtcctcccacctcagcctcctgagtagctaggactacaggcatgtaccaccacacctggttaacttttgtattttttgcagagatagagtttcaccatgttgtccagggtggtctcaaaactcctgagctcaagcgatctgcctgcctctgcttcccaaagtgctgagattacaggtgtgagccactgcacccagctaataagcatctccaacactctcccaccccagcacaagaaggactgcctgcttctggcaggtcttcctagaccctagcagagcagatttgggctgtggaggcctggactagggcctccaccatgccgcttggtggctgtgtgttcatagactggtagttctcctaaatcttgtttccctcatctataaagtagattaccagccactgcttctagagttcttgtgggtcttaactgagatagtacaaataagaaatttctcaccaggatggatctggtgcttaataaatgcctggtcaagcacatggtggtcaggatgacaggaccgttgatagtggcggtggtggcgatgttgaagggggaggtgttcactgctgccctgaccctgtatcctcttgtgacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggaggtaacggcgccttagagggaggtgtgtgggctcttgtgtctgtctggcagtccaaacccacccccatcccctgaccccacttttcctacctgggcaagtgtctgggggatgccccctcccagtccttggggcctgggggtctggcttcaagacaccagtttactgccccaaaagtcagagccacattctgagaatcctatcaggccataatttgcaaggcaagcataaaactccaggcaaggacctagcattctcagccaggccctgggattctgattcctctcctgggttctgggtcaggtattgagatttccatacaggtcctaagtttctgatgctcagacatggcctaaagcatccagtccatgacctagaactctgggtctctcccctgccctgtttaagggattctgtttcacgggccctgtgcccttaagcccttcatttgcccctccagggccatctttcccccaaggccacccaaggatagagctgttccagtgctgggtgccctgctctgaggcctggaaggacccttggtctgggcacctagttgacagatttttggggctggggtaaggggaggtgaccatgagcccggagtggacaagaacctagccactgtaggattggcttggagaaggcaaggggttcccatgctgctatctctgcacccctgtggcagggcccgtccctgtgcccccagatgcagcaacctagctggagtgccaggcctgggtacaaaagcatcttttcagcctgcagtccctgcccttgtccccgcccctctatgagtgggcttgacgcaaatgtccagaatggttggaaaacaacagtggtatatcccagccatggcctcctggttaccctcccccaaccccagccccagccccagccccagccccagcccttccatttctgctctcctatgtacacacaaaggcacccactttagtccagtgtagacacacatgcacacacacatagacacggccgcttgagaaatagctcaaatacccacctcccacagctccataccacacagctcagcatagcacgaggcacacacccatatgcacacccgtcgcacgtgctcacacgctcatttacagaaacatgccacagccacctggcgctgttgcctttgggccaggggaagggacttcttctctggaaggagggttcctgggcacagtggctcaggaggcctcagagtcctcggggccttccagcagcccagcaggtcaagcgcctcctttggcctggctggggtggcaggagctccgaggggtggctgctcttcctccatgcctgtccctccgccatgaggccatccatgggggaacgtctttgctccaggcctacccggaccctgactgaactctctccttgtttttgtctcccgcccccgccagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaa

SEQ ID NO: 690 - DNA, 71650 bp, Homo sapiens
gagtctggaccacgcagactcagaacagcactactcacagcagggcctcttgctcgctctagctgctgggaggaaaacggcttgctaatctccacgcccagaaattcagacaagagcattctccttatctcatctgcacaggaagcaggtctaaggtaaaagattatttttgtggaagattcttgcttttcagtctagtggttgaagtgtgagcctggcaggcgttggattagagagggcaacaagagtggaggttgtgaggtggggggttgccttggggcttccactctaaaatgtggccttaccttggccacaaaggggtcgggggggtgggggagagagagagagagagagagagggagagagcagcctgatcatagctcggagcgtagaggttctggtaagttccttgccctaaagaacacttagttcattctggctcctttcctggtgaccatcctggcttcctgcttggccttcacctcaccttgagaaattcaagtttcatgttcttgtccaggccaaagacccagaagaaccttcaaggtgaggcttggccccttagatccacgccgtgatttcgcttctttttcctgaagcctgcacagatgccagtgtaagcccactcccaggaagtcacagcagtggtctatgctcctcctcttcacactggccagtgctgggcatgcctggacaatcagccctggaatggctgctctcagcctacagaagaagagagggaagagggatggaggggctggggagaagttggtgagaggacacaaaatttgggttagacagagaaataaagttttttttgttttttgtttttttctgagatggagtttcactctgtcacccaggctggagtgcagtggtgtgatctcagctcactgcaacctccacctcccacttggcttcccaaagtgctgcgattacaggcatgagccaccgctccccagcctcctcatgggatttttgaggatgacataaaggaatacatttaaactgcctagaagggtgcttggcccagagtatgtgctaattaacgttggctactattattttccttcaacccagtgccggtgcaggtctagaggaaagcatgaggtgatacaggggcacccagaggcggagtgctcccaggagctgaggggcatcggaggcttccctggaggactggcacctgagcagaggaatgggcagcacagtggcagtgccacgtgtgcggcacagatggtgcagaggggatgggtgggcacactgcggggagtttagatttagccaggggatggcagggcctgtccaggaggttaagtgaggagctcaggtgtgcctcccagcaggcaggggaggctaattttgaagaagagcaaagtaggtgcaggaggtgagttgggatctcatgcagtaattcaggccagaagtgacaagggcctgaactatggcgctagggttgaggaggaaggaacagagagtgaggagatacaacctggcaactgattgcatgagagagagagaggggccaggaatagcatcatactcaggtttctggccatgcagttgggtgaatgagggtattgctgttgactggagcagcaaaaaaaggggatcccctctggggtagaggaagaagggagcaggggattggaaaatgccaaaatcagtttgctgtggtttggaatctgagactctgatgtgttacctaagtggagatgtcctgtggtcagtttatttatactctcctgggtcctaggtaggatttaaggtgacatatgaagataacacaaagtagagtaagatattataaattaagtaggagagaaagcagacagaaaagaacgagatgtaaagtagaggaaggaatgaggttaaatataaagtacacagcagaaagcagaagtcacaagctggccagcattcgctgaatttcctgtttgagttgtcctgcagtcttatgtttgtctgttgggttttggtgggttttgtttgtttgtcttgagttgcagtcttaaaatccaggaattcttaaaaattaaaatttctcactttttcttttaaaaaaaaaaaaagtgaagttctgggagctctgagccatatcccatctggcaacgatgatctgggtctgagaagcagtctcgccttcttgggagagcacgggctctccaatttcccactggcctccactccacttggctgtctggcactgaagcagtgtcggtcctcttatcagcatggactatttctctgaactcacccttctatcaaatgtaataaaaaaaattagtcaagatattttttttttcttagtctcaattttgcctgtttacactagcagcctggccgtggaagcaggctgatgctccctgttcacaactgcttttcattctgcttagtgcctctgttgtatctgttgttaaatagtttgggctgggtgtaatggctcacacctgtaaccccagtactttgggaagctgaggtgggtggattgcttgaggccaaagtttgagaatagcctggccaacatggtgaaaacccatctctactaaaatacaaaaaaatagccaggaatggtggtgcacacctgtaatcccagctactcaggaggctaaggcacaagaattgcttaaacccaggaggcggaggttgcagtgagctgagatcccgctactgcactgcactccagcctgggtgacagagtgagactctgtctcaaaaaacaaacaaacaaacaaaaaacagcaaagtttgaacatgacccggctgtaggtatttgagtttgcagcatgtggtaaaatcaagtattcggcctaggtggctcatgaacttgattctaggctttctagcagccaaagaaaaagaggatacattatctgtcttatcctatcttatcagctgggctattcatagtatccatgggatgactgcttaggcaagtcaggactcttctcaacacaagaaccagagcaacatttttcccctgagagtcttcatagagagggaatgaaaagttcaaacaacattcatcccagagtcgattcaagtctaaggctgatgattctagcagcttcaagcagcatttcccttgaagcacagctgcttaaacaattctaggaggggccaatgtgatacagttcagacacctaattttctactgatctggctatattaatttcagaaactttagaaaaatctagagaaatgcctggactccctccaaataatcctccatagatggtctgaggatgtgatgcctggaattgcagcagtcatcttgtgactgtgcggggacaagtcagagatgagagctggcacacagaagatagggaagaagaaagatagatcttgggcccttgatagcattgacaaaacactgaaacaaccaacttttatagtaagagatagcaaattaccttattaagcttgaactacttttatttgcttattctattacttgctaatatggtttggatctgtatccccaccaaatctcatgtcaaattgtaatccccaggccggatgtgttggctcccatctgtaatcccagcactttgggaggctgaggcaggcagatcatctgaggtcaggagttcaagatcagcctggccaacaaggtgaaaccttgtctctagtaaaaacacaaaaaattagccaggtgtgatggtgcacacctgtagtcccagctactggggaggctgaggcaggataattgcttgaacccaggaggcagagattgcagtcagctgagatagtgccactgcactccagcctgggtgacagtgcaagactccatcttaaaaaaaaaaaaaaagaaattgtaatccccagggttggagtggggcttggtgggaggtgactggattatggaggtgtagttctcatgaatgggttagcaccatccccttggtgctgttctcatgatagtgagtaagtgaggtagcgtgagatctggttgtttgaaagatctttctttcttcctcctgctctggccatgtaagatgtgcctgcttcccctttgccttctgccatgatcgaaagtttcctgaggcctccccagaagccaagcagatgctgctatgcttcctgtacggcctgtggaactgtgagcccattaaacctcttttctttgtaaattacctagtctcaagtatttctttatagtagtatgagaatggactaatacagaaaaatagtaccaaggagtggggcattgctgtaaagagacccaaaaatgtgaaagcgactttggaactgggtaacgggcacaggttggaagagtctggagggctcagaggacaacagaaagatgagggaaagtttggaacttcctagagacttgttgaatggtagtgaccaaaatgctgatagtaatatggacagggaaggccaggcggagatgaggaacttattgggaactggagcaaaggtcacttttgttgtgcatttatcaaagaagttggaggcattgtacccctgccctagagatctgtggagctttgaacttgagagtgatgatttagggtatctgacagaagaaatttctaagcagcaaagcattcaagatatggactggctgcttctaacagcctatgcccgttacaggagcaaagaaatgaccagaaactggaacttatatttaaaagggacacagagtgtaaaagtttggaaaatttgcagcctagccatgtgttaaaaaagaaaagccctttttcaggggaaggattcaggcaggctgcagaaatttgcataactgaaaggaaggcaaatgctgatagccaagacaatgggaaaaggcctcaaaggtatttcagatatcttccaggcagcccctccaatcacaggcccaaaggcctaggagggaagaatggtttcatgggccaggccccagggccccatcacctaccctgtgtaagcaggcttgggacactgcttcttgcatctcagccattccagttccagctccagttccagccatggctcaaagttcctgccacttcaaaggttgcaagctgtaagccttggtggtttccacatggtgttaagcctgtgagtgcacagaatgcaaaagttgaggcttggaagcctctgcacagatttgaaaggatgtatggcaaagcctgtgtgtccaggcagaagactgccccaggaatggagccttcatagagaacgtctgcaaaggcagtgtggaggggaaatgtggggttgtagcccccacacagagtccccgttggggcattgcctagtagagctatgagaagagggccattgtcctccagaccccagaatggtaaatacaaggacagcttgtaccttgtgcttggaaaagctgcaggcactcaatgccagcccgtgaaaacagatgccagcctgtgaaaacagatgctgtaccctgcaaagcttcagaggccaagctgcccaaggccttcggagtccaccccttgcagcagtgtgccctgagacttcatgtgagacatgaagtcaaaagagattattttggagctttaaaatatttaatgactgccctgctgggtttcagacttgtgtggggcctctggcctctttttgggggctgatttctcccttttggaacaggagtatttacctaatatctatacccccagttgtatcttggaagtaactaacttgttttgattttacaggcttatttgtagaagggagttgccttgtctcagatgagattttggactttggactttggacttttgagttaatgctggaatgagttaagactttgggggactgttgagaagggatgattgtattttgcagtgtgagaaggacatgagatttggagtagccagaatgatatggtttggatctgtgtccccatcaaatctcatgttgaattgtaatccccaccattggaggtggggcctggtggaaggtgattggatcatgggggtggagttctcatgaatgggttaacatcatccccaaggtgctgttctcatgaaagtgagtgaatgagctagcatgagatctggttgttcaaaagtatgtggcacctctcccctctctttcttcctcctccttcctcctcctccggccacataagatgtgtctgtttcccctttgccttctgccatgactgagcatttcctgaggccttctgagaagcagaagctgcttgcttcctgtacagcctgtgaaactgtgagccaattaaccttctttacttttttgtttttgagatggagtcttgctctttcacccaggctggagtgcagtggcatgatattggctcactgaaacctctgcaccccctacctccaaattcaagcgattctcctgcgtcagcttcttgagtagctgggactacaggtgcatggcaccacacctggccaatgtttgtatttttagtagagatggggttttgccatgttggccaggctggtctcaaactcctgacctcaggcgatccacctgcctcagcctcccaaagtgctgggattaaaggcatgagccaccaaacccggcctaaccttcttttcttacaaattaccgagtctcaggtatttctttacagtggtgtaagaacagactaatacgcttgctgacaaaagtattgtaactagtatagccataacaaattcaagtccaaagaaagagaaccggaagccacaaacaatttaattttttcggaagagtttaagtataaaagcaagataggcaatagctggctatgaaaaacactggcatgttgcaagaagttttaagtctatgttccaggtgagtggaaataaaattgtactgatacgactctcaggggccttgggttaggattggggaagtagagttgaaaattgaaataatttaatttataggtaaaaccatcacagtagatgaaattgcctaggttgactatgtagagctctggagaaggctcacatccaaagggcagttcttaaaagataaggctgtggcttagtaaagaacatgaaggaagaagaattagagaacttggaggaaatccagcatagtgaaaggtcacagaggctgggcatggtggctcatgcctttccagcactttgggaggccaaggcaggcagaacacaaggtcaggagttcaagaccagcccggccaacatggtgaaaccccgtctctactaagaatacaaaaattagccaggcgtggtggcaggtgcctgtaatcccagctagtcgggaggctgaggcaggagaatcgcttgaccctgggaggtggaggttgcagtgagccgagattgcgccactgcactccagcctgggcaacaggcaagactccatctcaaaaaaaagaagaaagaaaagtcacagaaaccaagtgaatagaggcttttagaaaggtaggaatagggaacagtataaaatacagcccagtaatatgaggatgcacatatcaagtgatacccgtgcttccatatatatactctctgagatggcattttgtcagaactgtcttgggtaggatttgcccccacctcccgtcctgcccccattttttttttttttttttggagatggagtcttgctccgccacccagactggggtgcagtgatgagatcttagctcactgcaaactccacctcccggttcaagcaattctcatgcctcagccacctgagtagttggaactaccggcatgtgccactatccccagctaatttttgtatttttttaggagagacggggttttgccatgttggccaggctgatcttgaactcctgacctctagtgatctgcctgccttggtctcccaaggtgctgggattacaggtatgagccaccgtacccagccctattcttgttttaataaccaaagctgcagtcttctacaagaaatttcttacccaagagtttttagaagtaattaataagtttataataaaatgtaactccatgagctactaggaacttctttcttatttggtattaactaccgttttccttagctaacttaaaaagtggcttctgggaagtttttatttaaacagaagtgataaagcctgtacttgctaaaagatgggactgccagaaccagttttgctttgtcagttatcttttgatataaggtataaggcagggagcccctctcctgaggctatcaaaatgaggttccagaagtgtgtgagagtgcaagggattccaccacactcatttcaggcttctgccatcttctcttgccagtccagtcatggcaccaactggcttagggaacatgtcaagaatgagatgatgggctaagtgcggtggctcacacctgtaatcccagcactttgggaggccaaggtaggtggatcacctgaggtcaggagtttaagaccagcctggccaacatggtgaaaccccgcctctattaaaaatacaaaatttagctgagtgtggtggcacttgcctatagtcccagatactagagaggctgagacaggaggatcgcttgaacctgggaggcagagattgcagtgagctgagatcatgccactacattccagccggggcagcagagtgagaccctgtctcaaaaaaaaaaaaagggggtgatgggaaatggctgatccaacttaagtccagcgtgcccatcatccattgtcctgcctggacgatgacaagtagggtgggggctaattgttacacagtctaaaacacaaagtcttcacaattagcttctaaacttttatttcacaatgataaattatgtttataaatgattaagattgggagtttttcaattcacatccctatagagagatgatacaaaagaaacactgtaacttccaaagagaaatatcttaacttggtggatacacagactataaaataatctgaggccctgctggatggctcaggcctgtaatcccagcactttgggaggcccaggcaggcagatcatttgaggtcaggagtttgagaccagcttggccaacatggtgaagtgttgtctctactaaaaatacaaaaaaaattagccaggcatgagagtgcacgcctgtaatcccagctactcagtaggctgaggcatgagaatctcttgaacccagtaggcggaggttccagtaagctgagatagcaccactgcactccagcctgggtgaaagagcgagacagtgtctcaaaataataataatgatgatgataatctgaaagattattaaattatagccagagagtttgcattggctggagagatgtaaatattagaacatatgatgctcatataattaggagtgaaatcaagataggaggaatatatccttattacaggaactttggaacccagtgttgactaagattaggattcggagctgctttcaccaccacacaactatgtctgaactgctgagaaaagaaggagttagcacattgaaaacaagagaatgctctttctagaatcgaggtcttttggagacaggtagtattaaagctcccaagaaaagcaaataatgcaggatctttaccctcaggaccgcatccagctctgtttaaagtgagaagcctcggccgggggcagtggctcacgtctgtaatcccagcactttgggaggctgaggtgggcagatcacctgaggtcaggagtttgagaccagcctggccaacatgatgaaaccccatctctactcaaaatacaaaaaattagctgggcgtggtggcgggcgcctgtaatcccagctacttggaaggctgaggcagaagaatcgcttgaacccggaagtggaggttgtagtgggccaagattgcgccactgcactacagccagggcaacagagccaaaaaaaaaaaaaaaaagaaataagaaaatgagaagccttcatcacagggaggcgaactcccaactccagggaaaccatctgtctagaatgatgcaaccacaattagcctctgcaactctgggactttgagtaaattgggtttgtaacctaacccaaaactggcaaatccagtcttttaaggctaattctttgtggagaatctgctggttttctggatcaagggcagggcactctggagattcaaccagcttggcagaaatcagtcttgaatgaggtatatcagacagggctcttaattgccggcaataaaagttgactctagatgctgaggcagagaaagaactctgggtggctcacagaactcttttgagagcttcaggtgaatcttccaggaatgatgtccaaaaccacagaacagaattggccagatgagaagaccgctcccattgtggccaccaagcaccgaggctctgcttgactctgcagccattgccactgtagccagtatagatgctacatcgactccagcaactttcacctcatctgtggcagaaaacagagggaaaatatgggcttgcatcacagatcaaatttcaaagacagaaaacttttagagttgccatttatgaagggagctatagatagagtgaggagcaacttttctcctggagactctgagatggcccgaccctctcagctgctcaagaggggctgatgggaggcttttggagttctatgttgcaaatcacagaaacagactcatgacaagtaagccctaattatttttagtgaattatggaaataatcagatatgctccaagcagacattgctcagctgatgctgaggagggacagggtaatgctttgtgatgtgaggtgatgcttcggaatcagaaacaatgatttttgtttaaactgtgataagttaaaagcctattattaattctgttaagatattcaaggaggtcatttgcagaaaactcattgttacttcccataaattttcatttccttgattgtaataaaaggtgctatacaaaataggaaacagcgccttctcctgtaagagcatgacatgtgtgctttttgagaggccacgcatgatttcattacatattaatttctggaacattctaatagaagaaacgtatctatttacattgcactatttttctgaagagtcatgtaaaaaggattccaaacttttaaataacaagctatattaggatctattgttccgtaacaatttatccctaaatttagcataaaacagcaacaaacatttattgtttcatacagctgtgggacaagaattcaggagttgtttggttatggctctggcttttgattctcacaaggttgtgttgcagtcagctgaaggcttgaccctggctgaggatccactcctaaggtggttcattgcgtgcctggtcagttggtactggttgccagcaagaggcctcagtcctttgtcctgtagatctctccgtaggacttcttggatatccttacaatgtggcagctgattgcctccagagtgagtgattcaagaggaagcgaggcaaaagccaggattttttttttttttgagatggagtcttgctctttcgcccaggctggagtgaggtggcgtgaactcagctcactgcaacctctgcccccgggttcaagtgattcccctgcctcagtctcccaagtagctgggattacaggcacctgccaccatgcctagctaatttttgtatttttagtagagacggggtttcgccatgttggccaggctggtctcgaactcctgacctcaggtgatctacccacctcagcctcccaaagtgctgggattacaggcgtgagccactgtgcccggccaaagccaggatgtcttttatacccccgtctcagaagtcactcacagtttcccactgggaacacattctatgtgtttattttaggcttggccaatgtgactggctgaggttcagatcaagattcatctacttcatttggctcaagaataaatttgggaaataaataagcattcatgttatacttcttagtcatcagtataaataacgcattttcactccctattttcagagaaagaatcttcttagctgtcttctccagtatcttatttcaatgtttaacagccttcatggttagggatttttttttcctttaacattgtttaagttattcaccttcatctgactgcagcagtgacacaaagaagtttcgtatttctcctctgtcattaattctccatgtattcaatgccatgaaattacttctcttcttctggtgaaataattccagttttgttacctttttttctcatgctggcagggataaggagtgtgcgtgtgtgtgtgtgtgtgtgtgtgtgtaaactttattaggtagaatttcaaatatatagaaaagtagagtagcctaatgaactcccatgtacccagctgaagaaggagaatagggaattagggtaatgaagggttggggcataagcaaggaatagcaggggcagccagatcgcataagcaagggaacagaaggtatagccagttctaggcaagattgggcagcatacaggccacatcctcactcctgtgataacaagatggaagtctccacttcagccgctgattggtcacaggccaatccttcatagggtgtagccaattggaggcctctgaagagcacctaggagtgttacagaattctcttggctttataagaccctgaggagccaccaggtgcggtggctcacgcctgtaatcccagcactttgggaggccgaggcaggtggataacctgaggccaggagttcgagaccagcctggccaacatggtgaaaccatgtctctactataaatataaaaaaaattagctgggcacggtggcgcattcctgtagtcccagctactctggaggctgaggcatgagtatggcttgaacctgggagtcggaggttgcagtgagccgagatcaagccactccactccagcctgggcgacagagtgagacttgtgaccccatcgcgaaacaacaacaacaaaaaccctgaggagcattgcaataaaggggctcttgagctgcttgctcaagttcactcctgctctgtgaattgtaccttctcttaagaaatctgtgacttccttactctgttcttttgttgttttgtctttcgttgcttcttttttgctttgtttctgtgttttgttcaattctttgttcaacacaccatgaacctggacaactcacagtcaagaccttctatctggtaacaataggcaacaccatttaaagaagagagaacactttctgtagttcctggagtagagagacatctgactttcctggcagaaatgtggggtgaattatctaaacctgtttttctggacggtaggggccaggaggaaaagagtatagtcaaggctctccttgaacttcctccagggacctttgacctctacttcattgtctgaattgttttgctggaggaggtaaaacatgcacaccagtgtgcacacacacaagcactcactcacacagtggtccttaacacactttagaatcaaaaaattgtttaaaggaaagggaacttcaaggtcatttagcccaaggttgtcattttacgcttgtgaaaaaggaggcccatttatatcacataacttacggttggttagcacttaataataacctgtaatgcatttttagtaatattttgagcatgtgtcctcaattatattatctcttattttgttttattttattttatttattttttgaggcagagtctcactctgttgcccaggctggagtgcagtggcgcgatctcggctcactgcaagctccgcctcccgggttcacgccattctcctgcctcagcctcccaagtagctgggactacaggcacccgccaccacacccagctaattttttgtatttttagtagagacggggtttcaccgtgttagccaggatggtctcgatctcctgaccttgtgatccacccaccttggcctcccaaagtactgggattacaggtgtgagccactgcgcccggccaattatattatctcttgaaggctccagcacagggcaaatggttgccctaagtatgtgaaagaagccttataaactggaaacttaaatctagaattttatatgctaaatctttattcaacattataccttaaaagacagtgcttaatatggagataggttacaattttaaatactgtattattacaattaatgttttaactgaaaatgcaatttgtcagcagcattaaagaatttctaaatcctccgtaattctattaaacaatgaataaaactacagtcatgtgcccataatgacattttgctcaatgatggaccaaccacatatatgacaatggtcccataagattataatagaactgaaaaattcttcttgcttagtgaagtcacaccatcacactgtcataacacaacacaatacttacatgtctggggcgatactggtgtaaacaaacctgctgtgtttccagttgtataaaagtatagaacatacaattacactacatgatacctgataataaacagctatgttactgcttaatgcatactatatttttttttttttttttttttttttttttttttgagatggagtctcactcggtcacccaggctggagtgcagtggcacaatctcggctaactgtaacctctgcctcctgggctcaagcaatcctaacacctcagcctcccagaggcaggtggaaccacaggcgcatgacaccacatccaactaatttttgtatttttagtagagacagggttttgccatgttgcctaggctggtctcaaactcctgagctcaagcgagccacccgcctcagcctcccagagtgctgggattataggcgtgagccactggcctggcctcatttattatacttttttcttcttgaaagggaatctcgcctgtcacccaggttggagtgcagtggcacgatctcggctcgctgcaacctctgcctcccgggttcaagtgattcttctgcctcagcctccctagtagctgagactacagtcgcacatcaccatgcctggctaattgttgtatttttagtagagatggcatttcaccatattggccaggctggtttcaaactcctgacctcatgatcagcccgcctcagcctcccaaagtgctgggattccaggcatgagccaccacgcccggcctactatacttttaactgttagtttagcgtgtactccctcaattcataaaaaaagctaactgtaaagcagccttgggcaggcccttcagaaggcgttgttatcacagatgccagctccacaggtgttattgtccctgagaccttccagtgggatgagatgtagagacggaacacagcaatgatgattctgaccctgtgtaggcctaggctaatgtgtgtgtttgtgtcctagctctttttttttttttttttttttgagatggagtttcactcttgttacccaggctggagtgcagtggtgcgatcttggctcactgcaacctccgcctcccggcttcaagtgattctcctgccttagcctcccgagtagctgggattacaggtgcacaccaccaggcctggctattttttttgtatttttagtagagacaggatttcaccatgttggtcaggctggtctcaaactcttgacctcaggtgatccacctgcctcggcctcccaaagtgctgggattacaggcgtgagccactgtacccggcccatgtcctagtttttaatgaaaaagtttacaaagttaaaaaaaaaattaaaaatagaaaaaacttatagaataaaaatataaagaaaaaattgtacagctgtacagtgtgagtttcaagtgaagtgttattacaaaagtgtcaaaaagtttaaaaaatttaaaagcttataaagctagaatgttggctgggcgcagtggctcatgcctgtaatcccagcactttgggcggttgaggtgggtggatcacttgaggtcagtagttcgagaccagcctggccaacatggtgaaaccccgtctctactaaaaataaaaaaaaattagccaggtgtggtggcgggtgcctgtaatcccagctactcaggaggctgaggcaggagaatcacttgaacccgggaagcagaggttgcagtgagctgagatcacaccactgcactccagcctgggcgacagagtgagactccatctcaaagaaaaaaagaaaaaaaaaaagttacagtaaggtaaggttaacttattttgaagaaagaaaaatttttgtttgtttgcttgtttttgagacagggtgttgctctgtcacccaggctggagtgcagtgtagtgatcttggctcactgcaacctccacctcccagcctcaagtggtccccccacctcagcctcccaagtagctgggactacaggcatgcgccaccatgcccggctaatttttgtatttttagcagagacagggtttcactatgttgcccacaatggtctcgaaattctgggctcaaatgatctgcctgcctcagcctccccaagtgctaggattacagatatgagccaccacacctggccatgaaaagtattataaaataaatttagtgcagcctaactgtacaatgtttatgaaggctatagcagtgtatagtagtgtcctaggtcctaggccttcacattcactcaccatttacttaccaactcacacagagcaacttccagtcctgcagcctccactcatggtaagtgtcctataaaggtgtactattttttttatcttttatacatatttttactgtaccttttctatatttacctacacaaatactattgcattacagttgcctgcagtattcagcacagttatatgctgtacaggtttatagcctaggagcaataggctatgccatatggcctaggtgtgtagtgggctgtaccatctacgtgtgtgtaagtataccctatgatgttcacacaatgacaaaatcacctaatgacgcatttctcagaatatatttctgtcattaagtaacacaggactatttcattttccctctttaggtacacaacatttatccattacagcatatgtataatttctactttgttagtttcacttaccattttcctgaaattttttttgcatttttgtagtctttataattctaattttaaatggctgcatgattttatcttttgtcagacaagcatgggtctgagtctcagctctgctacgacatagttgtgcgattctaggaaagcttctttctttccttttaaaaatagctttgagttataattgacacacaataaactgcacgtatttaaaatacacactttggtaagtttgacatctgtatacaccagtgacaccatcaccacagtcaagataataaacatactcaccaccctcaaaagtgtccacccttctgaggtccgtccctcccactgagattcctcatgctgttgctaggaaaatgatagaacatttgaatctggttacataaaaagacaaaaactggagagtttaggaggaagcaacttagcctcctgtatgactgtagtcttggccccagggcagttcctggctcagacactctgggggtatcctcagtctaaggagggtgtctgcctgcccggttgacaggatgcctcttcttcacatacgtcttgtctttcagagtccatgaccaatgcctcacttacaaatatcttttctccttttgctcccacctttgtggatatttaccagttttttttctctaaaatcatccttactttttttttttctttttttttttttgaggtggggtctcactctgtctcccaggctggagtatagtggtgtgatctcagctctctgcaactgagttcaaatgatcctcctgcctcagcctctcgagtagctgggattacaggcatgcataaccatgcccgactaatttttgtatttttagtagagatggggtttcgccatgttggccaggctggtctcaaactcctgacctcaggtgatccacccaccttggcctcccaaaatgctgggattacaggcgtgagccactgcggccggccacagtcattacctttaagctccccccaaatctgatcatttctcccattctttgcacactatctcagacctttacgccctaagggctatgactcataccaaaattgcaaagtgcaatggaaataattaatagagcaagcaaggtgcataggataaccctctgtgctatcaacaggtgtgtctccccctcctgggatttcatgtcacccgtaaatttgtgtctctagcctgacagattctttttgagccttttgacattgcctttgtttctgaaagtctcctggagggcaggggctgaggctgggttatataaagataagcccctgaagaaagggctttataaataggatttcaagtgcattctgggaattagagggctgccaggtgcagtcctggagattgacactaaggggcagcatgtaccaaaggatatatttagctctgccaaagcccagtagaaacaaagagaaaatcaccttgcttttaaaccccaagagccaagatgtagaagccacattttcatctcttgaatcaaattacagcattacaattttcaatatctattctattaggagttttacctgccaactgagttctccgagtaaattattttatggttaaatatgatataaatataatactgttgagacccatatactctgtaagatttactgattttagtgcatctataacttcaacaacttaatttggaattaaataatattttattccaaattcaaactcttttttttttttttttttgcgacagagtctggctgcaacacccaggctggagtgcaatggcattatctcggctcacggtaacctctgtctcctgggttcaagcgattctcctgcatcagcctcccgagtagctgggactacaggcgcatgccaccacatctcactgctttttgtatttttagtagagacggggtttcaccgttttggtcaggctggtctcaaactcctgacctcaagtgatctacccgcctcagcctcccaaagtgctgggattacaggcgtgagccaccacatccagctcaaactctttatattcattgacatgactgttgtctgtctgtctgtttctctttctccctttgatgaagcaaatttttatgtggaataaaggcaatcaaataattatttggcagttaaactagacaaggccaactcttggggaatcttatgtttccctctctgattgatttgtttatgaattcatccatcagtgaggatttctgagcacttccatatgcctgtccctgtgctaaatgctgtggaatgcatagatgaaccagatatcaaccctgacatcaaggaactcattcaaagtgtggagggtggggaacatacggcagacaaaaaaaaacgtgatgttgggaatgtatggtaagtgcaatgatgagaaaaacaaacataaggtaggaaataggagaggacagagaaggcacctatcagagatggggggatgtggggtgggtagttgggaagagtgcaggaaaatgtccaagaggagatgacatttgaactgatcttaaaggagcagatggaattagctttccacacagtgtgctcagaacctgcaaaggcatggaagaatgggagctcccaacaccatggtcagtttgcaggcagggccaaccctttgaatggccaggagcgtgggtgttgatttgtgatttagatcagcttctctgacagcagaatagacgtgagaatggaggggcatggtagaaagtagaaagagcagtaaggaagccactgcagtaatagggaccaaaaattaaaaggccccaaaggtggtgaagaatggagagaagtggaccagtttagctggtatttaagaattgtggctgggtgcagtggctcacacctgtaatcccggcactttgggaggctgaggcaggtggatcacttgaggccaggagttcaagaccagcctagccaacatggtgaaaccccatctatactaaaaacacacaaaataattagcccagcgtggcggtgcccacttgtaatcccagctactcaggaggctgaggaaggagaattgcttgaacccaggaggcagaggttgcagtgagctgagatcctgtcactgcacttcagcctgggtgacagactaagactccgtctcaaaaaaaaaaaaaaattgtgacagaagctggtgtgaccaaggaactggatgtttgagatgactgaggggatgagttttgcttaggtcccgtgagataaagtagaaaacgtaaaaagacgtatttactcatttctgcttgccagtgtaatttcacaagcccctgactctgtgtagacacccagctctccagaaaaatgctttgaagacaaaggatacagcatacagtcccgtgtctcggctgagtcatcgcattccttaataggtaaataagcctaattaatgccttttcctataggtaacataatgtctgatggggttagggatgatgcctctgtaatctataccagatgtactcttatacacaaaccttgatgtgattctgctttaatgtaacttctgcaagtttgatgtgactttgcatgtagtgaacccccaaggcctgtgtagaagctgcgggtggagctaccttgctggagcagtctcacagaacccctctgaagggctgctcccaggatgtagaccttggtctatagtcctcagtaagattcctgagtaaaactagttttaactttctaaaagcttgatttttttttttctttagtggacagtccgaattgagtttgaaaagcttgtgggacattcaggtagagatgtggtccagcaggctgttggatagatggttctggagcttagcagacagatctgggccaagaaatataatcttgggagagactgaaattataggagtagctgagaccacagtgggaacaacatttaagagctggagaggggaaagtgctttaaaaaatgaggaggaggctgggcacgctggctcacatctataatcccagcattttgggaggctggggtgggaggattgcttgaggccagaagtttgggaccagcgtgggcaacatagcaagactccatttctacaaagaaaaaaataaaataaaatcctaagctcctcaactgactgaacagaccctctcttggcccaggggaccccagagaaacctgaacaactgaattccaggccttgatgggaagagaggtcagacaggcctcattgtacctctttccttttgggataccaaattccaacctcactctggtagcatcacatgacagatagcagaccatgaaggaaatcaaaatattttaccccaaaatagacttctctgacatattttgaaatggtcctgtaaagccgtcttttatgggggaaattttgcatctatagagaatctccattaatgcagctaggcctttccagatctaggagaaattaactaggaatttgacactttttaaggtccaaaaagaaacatttatcatttattctctctgaaggctgctacctggaggtttcatctacataagaagaaccttggcttccacagccccctttatcttaactcaagaatttctttctgctgacttcaagtctttagacaacaatgcttaactctttcaacaaattgccaatcagaaactctttttttttttttttttttttagacagagtgtcgctttatcacccaccctggagggcagtggcatgatcttggctcactgcaacctccacctcccaagttcaagtgattctcctgcttcagcctcctgagtagctgggattacaggcatgcaccaccacacccggctaatttttttttgtatttttagtagagacagggtttcaccatgttggccaagctggtctcgaactccttacctcagatgatccacccaccttggcctcccaaagtattgggattacaggcgtgagccaccgggccctgcccgaaaatctttgaatccacttgtgatctgtaagccccatacccctgcctttttgagccaaaccaatgtacaccttacatatactgatttatgacttcgcctataacttaacatataaaaccaaattttggccaggtacagtggctcatgcccataatctcagcactttgggaggctaaggcaggaggatcacttgagcccaggagtttgagaccagcttgggcagcatagtgagacctcatctctaaaaaaagtaaaaaataaaaaattaaccaggaatggtggtgtgcacctgtgtgtggtctcagctattcaggaaactgaagtgggaggattgcttgagcctgggagttcgaggctgcagtgagccattattgcaccactgcactccagtctgggtgacagcgggagaccctatctcaaaaataaataaataatgaactaaattgtaacctgccaccttgggcataccttcttaggacctcttgagacagttccctgggccgtggtcactcatatcggctcaaaataaacctctttaagtatttcacagagacaatgtaaggtggctaaagcctgtaatcccagcactttgggaggccaaggcaggaggatcacttgaggccaggagtttgacaccagcctgggaaacatagggagaccccatatctacaaaaataaaaaaattagtcaggcatgataacatgtgcctgttgtcccagctactcaggtggctgaagcaggaggatcgcttgagcctgggaggttgaggtgcagtgagccattactgggccactgcattccagcatgggtgacagagcaagactctgtcttaaaaaaataaataaaataaggctgggtgcagtggctcacacctgtaatcccagcattttgggaggccaaggcaggcggattgcgtgagctcaggagttcaagaccagcctgggcaacatggcaaaaccccatctctactacaaatacaaaaataaaaataaaaattagccaggcatggtggtgtgaacctgtagtcccagctacttgggaggctgagatggaagaattgtctgagcccaggaggtcgaggctgcagtgagctgtgatggcaccactgcactccagcctgggcaaccagagtcagaccttgcctcaaaaataataataaataaataaataaaataaatattgtatagagtttgttttttccattctgagtaggtgctatggtcatccccatttagactaatggggaaaatgcagcatagatgctaattgaccagcacaggatcacacaactagtggcagaggtgagaggtaaagccaggcagttcatgcttttagccaccatgatactgcctcccacacaggaaaaatttacaaagggtaattactagggtagggaatggtgagagagaattttactatttcatactcctaagtattcaaaatattattttacctatattactttgacaataaaaactaacaattttttttttttttttgagacggagtctcactgtcacccaggatggagtgcagggacgtgatcttggctcattgcaacctccacctcctgggttcaagcaattctcctgcctcagcctcccgagtagctgggactacaggcgtgcaccaccatatccagttaatttttgtatttttagtagagacagggtttcaccattttggtcagggtggtctcgaactcctgacctcaagtgatctgcctcccaacgtgctgggattacaggattgagccactgtgcccagcctgaatatgtttgaaaattttgtgttaggtgtacagtgaacacctcctgggaaccttgcagggaggttgcagtggagtagccaggcagcaaggccaggggcagatgggatggttgaggttacatactgactactttgttgaagggaaataaaaaggagatcctggcttgctttccgtataattaagtttcagtcctgagagaacaggcaggatttaaaagcacagtggccaatatctggctttggtttttacatggactctttctttattaagtttctctcacttggaaatctgttgtggattcctgcacacacagctgctctgaggtttatttcaacttttttattaggtaatacattcctataactgaaaaagttaaaatcacttaaaaaggtgtacactgggaagtcttactcccaaccactctgttctaccctttccccccttacccctgacagctcccaacatagtattatattttgtttcctttcagtgactccttaggtaactgcaagcacacatacacatgtattatttcttttttacacagttgggagcactgctttgtacctttctaaatcagtgcgtggagcacttcctctttttttttttttttcaactgtcctttgggttagtttaatctactatgaatttactcccttgtccttgctattggctttgctgagtcatctccaggttggaactagtgtttcttctttgctcccctatttttagagttcttccccatcatcagcttcctagcaactaattgcatttctatccacactcccctaaagagagataaggcttcctcttgctttgtctttgccttcttatctaatgcacccaatgagcactagccttcttcaatgacccttggggcagcagctcacacctgttcattttggtgattaaatacggagcagaggcacctccctttgaatctcttgtcactggcaattttcatcttcccggaaacaggtgtgctggggagaacgtttccccctcccccacgtataaatgcttatagtttaatggtaaacaaccattgacagagctgtgtatctgttgaacaggtaggtattttccttcctatttttatttatttttaaattctatattttagtttgactttgtacctgttacctggttgtcttatgaatatgctggagctgctacctcttgggggtgtagggattagcgaggagaaacaactcagctgcgaagtgcttatttgcagcttgccccagcaagggtggaacactctttaatgaaagactattattattattaattttttttttttgagacggcgtctcgctctgtcgcccaggctggagtgcagtggcgcgatctcggctcactgcaaactccgcctcccgggttcacgccgttctcctgcctcagcctcctgagtagctagctgggactacaggcgcccgccgccgcgcccggctaatttttttttgtatttttagtagagacggggtttcaccgtgttagccaggatggtctcgatcttctgaccttgtgatccacccatctctgcctcccaaagtgctgggattacaggcttgagccaccgcgcctgcgcagactattatgtttttaacaaccatcacttgtgtggcgagctgactcgggggattgtaatattctgttttaatgaaagtgttggtgtttcctcatctgtttattctgaacaagtgtcttctccccgggtttggtggcctgcttctggagtggtcagttctgctgccgacatgcccacccagctcgagatggccatggacaccatgattagaatcttccaccgctattctggcaaggaaaggaagagattcaagctcagcaagggggaactgaaactgctcctgcagcgagagctcacggaattcctctcggtgagtcaggcctttgtaaatgctgtattcatttgagggtagatgaggtgcagattccaggacagcctttgggttcatactgtcctgtgattctgtcacaaatgcagccaaatttgtacagagattcaaaatataggggaagcaaacactggagacgtttgttttctgtgtacataggcatgtgccctttttcgtgttacctggggttagggtttctaagtggtaaaaattgtatttttgactttcaccaattaacattctggtgcggcaaagatgtagctaattatagccagagttatagttataactagttacagctagttatacctggagcttggtccagctgtctgtaaattatgtattgggccagaggtgaaggggtactttaccttcagaggtggggtacttcatgctatggtggcaaattttctagtgaatggcaaatacttagagagctttgtcagccgagcacagactgattgggattgatagaaggatgtgtttggccagtgaccagtggggtagcaaacagattcatttctcaaaatagccaggagtttgagagattaatatatgaagccgtacattgtagcgtttggggcctcctccaaggaaaacacttcacgctggtgtttatagagttgacttaaactgatttttagcacaatatgctaccctcgtgtgatgttattctctccaaaccttgtgttaagactacagagactgttaattacaacacatgtttctccccaccctctatttgggaaaagctctataaagtattttttaacttagtcttcacgacatttttatagtgatcttagaattcccacaaacttttcttttcctctcattccgtttggctactgtatttttttttttttcggagatggagtcttgctgtgtctcctaggccggagtgcagtgacacgatctcggctcactgcaatctccacctcccaggttcgagtgattcttgtgcctcagcctccggagtaactgggattacaggcatgcaccacgacacccagctaagttttttgtatttttagtagagacagagtgtcactatgttggccaggctggtctcgaactcctgacctcaagtgatctgcctgcctcggcctcccaaagtgctgagattacaggcgtgagccactgtgtggggccaactttggctactgtactgtttaacatttagcataaaaactcagtaggtcaaacttcgcacatttatttaatcaagtacaatttataattgttttaatcaagttggttttgatcaattaagtttttctctgaccatttaatggttagcagaaaatgaggggggcatggggatttcctggaggaaatgaactgcttttggaaacactcctcatcaacaccagtcacaggagaggtgggtgcttcacagttccaaccttcgtgaaccttgtcttccctcttctctttgctttccacccataaaatgcaggcatctttataagacctacctttctttgggtgcctctcttctgtgtgtcaggcacactgtgctaagtaggctgccagataaaatattttgtgtcctatacaatacttgagacatactaaaactaaaagttatttgttgtttatttgaaattcaaatttaactaggtatctagtatttttatttgctaaatctagcgaccctggtgctctaagcactttcaaaagtgtgatgaagtatccctgaaatgtgtggatagaaattatcctcccaattttataaataaaagcatttaaaatgttacgcgatttgctcaaattcgctcgttggtatttttctcctttttggcttcaaatcctccctctttctatgtcactcgactatctcctagtgtcctggctctcaacctgtgatgtcctgtaaatgtgtttttagcaacagtcactcactttgatcagctgctgtttgcttttcttggtttctaggtctgagccaggattatatggagctggggcagggggctagattcgtttagaattcgtggctggtttacacctacctgtaaataggttcttagaaaatgtctttagatgctataaatggaaattaggaatttaatgtaaataaaaggaagatgaatttcaattgtcatcatgaacctcagagccagggagttagaaatttcctttctcattttagtgccaaaaggaaacccagttggttgataagatagtgcaggacctggatgccaataaggacaacgaagtggattttaatgaattcgtggtcatggtggcagctctgacagttgcttgtaatgattactttgtagaacaattgaagaagaaaggaaaataaaggtaagtaataagctcatctaaaggcagaaatatatccaaagttatgtacttaatgttcatttataccgttcagatctatagacccagtaatgtcatttatagctataatatccagtgcatatattaataattaattgctactattgaattatgtgccccttaaaatattgactttatgtagatattctaaatctcatatgccctacttgaaacttgcctgtattattaagaggctatatgcatctttttggtttgtcaaaacgagggcattacaaaaatttagctactttcaaatgagacttgaatttggcaaatttctaagatggacattcatatccttaaattgtattttgaacttcttaccctattaaaaaaaattaactgggtttcctcattctcttgtgactgtgtttcagatggaaggtgtgagggtctatgagcagaaaggcggctaagcagaagtgctggctttttcagtgatttcgtcagggaatggataggttcagggctaggtggtcaagccgagagagctgaagccagcagctcttgtgagctggcatataaataccctcctttgccccttgggttggataattctgaggcaagtgtttgacactatttcccactgtttccccctggggctgagcctcggtaggccccaagggaggccaccttttcttccttatctcactttcctgctccaaccctgagttttctgcatctctcaaataaatgacttctacacgaaccctggcctcagggtctccctcttggggaacccaaactatgatagatcctttggagaattttaagaaagggagtgatatgattatatttatgcgtgtaaatgattaccctaactactgtgtaaagaaaggactatagagatggcaatcgtggcaggcaaccagctaggaggttgttgctgtggtctgggtaagagatgatggtatatcagaccagcagttcagcactggagatgaagagaagcagctgaattggttaagtattttggagctgggactgataggacttgctgatggattcatagtgaagtgtgaggaaaagagagaagtccaggatgacaaaacaaccgttgctgtttgcccatctgatatctgttcttcctttcttctatgtatcagaaccctggtttgtgcagggtggcaatgtgcctggctaaaaagccatatttcctagcctctctaacagccggtgtggggcttgtaatagttctggacaatgtgagacaagcagaaggctactgggaatttctgggaatgttttgctattgtagacaagaacccatgtagctctttgtcttccaccttgttgagtctttccttgtctttttttgttgttgttgggatgtggatgtgaggctggaggtggaactgctatcttgcaactatgaggaccgtggagaaaaaagatagaaggagcctgggcattgttgtcatggaggagcctctgcacagccttgcttgcctgcttctggtcctctcattatgtggggggaaaaaaatgacagctctctggttatctggttctattacatgcaaccaaacacaatctgtaaggtttagggttttgatcaagcaaatgatgccttttactaaatgggaaagactgagggaagaatcactttggtgtgaaggcatgtgggcagatcaatagctctgtttaaggtggtattggacatccaggtggagatatcacatgggaagttggaaatatgatctggtctggatctcagggtaaatgggggactggagatagagttgggagtcatttgtgatcttaagccacaggattagaggaggtcactccggatgagaatgtggatagagaagaagaaacgtctgacagtttgctgtaaagaaaaggaagagcccataagtgatacaaaagaggcatggccagggagaaagaaggaaaaccaggagagtgtagtgtctcagaagcctagagaagacagcacgtggagaaggaaagagagaaatccattcagaggtgaagtaggatgagaacgaagacttgaccactagatttgggaaggtggaggttgtctcacgcatctgtgtgaagagacccccagacaggctttgtgtgaacaacatggctgtttatttcacctgggtgcaggtgggctgagtccgaaaagagagtcagcaaagggtggcggattatcattagttcttataggttttgggataggtggtggagttaggagcaatgttttgcgggcagagggtggatctcacaaagtacattctcaaggatggggagaattgcaaagaactttcttaagggtgggggagattacaaagtacattgatcagttagggtgggacagaaacaaattacaatggtggaatgtcatgagttaaggctattttcacttcttttgtggatcttcagttacttcaggccatctggatgtatatgtgcaggtcacatgggatatgatggcttagcttgggctcagaggcctgacattcctgtcttcttatattaataagaaaaataaaacaaaatagtggtgaagtgttggggtggcgaaagtttttgggggtggtatggagagataatgggtgatgtttctcagggctgcttcgagcaggattaggggtgacgtgggaacctagagtgggtgagattaagctgaaggaagattttgtggtaaggggtgatattgtggggttgttagaagaaacatttgtcgtatagaatgattggtgatggcctggatgcggttttgtatgaattgagaaactaaatgaaagacacaaggtccaaataagagaaggagaaaaacagatattaaaggactaagaattgggagtacccaggacatccaattacagagtgtccaagggagttcagcataattatttgcttggttgttgagtttttgggtgctatccttgagtttttttatgttgtcatataccaggccagattgatttaggtaaaaacaacactcttcatttaaaaatatacagagtcccctttttttcttcatttaaaaatatacaagagtaccccttttttagtcagggcctcgggaattttggaggaaagagaaaagcaaagccagcaattgtttgttaaagaaggattagaaatggctaggagagagtgactgagactgatatagtgtggtggagatagctggggagaggtagagagtggcataaaaatggggacaagaataagagcaagtataaaagtaaagaataggacttcatcagggtgaaagtattggagtgtactttgtcactgaagaacttctatccacttaaagagagacttaagggtggcagtttgaggtaaaacctggagccactaaataccaagagcctgagaaactgcttgggtgatttgactaataaaggccggtctgttattggactgtatagaagtgggaaggccaaaccaaggaattatgtttgacagaagggaagaaattaccacggtggccttctcagaccctgtgggaaaggcctctacccacccagtgaaagtgtctacccagaccaagaggtattttagtttcctgatttgaggcatgtgagtaaagtcaatttgccagtcctgggcgggggcaaatccccgagcttgatgtgtagggaagggaggcagcctgaacaatccctgaggagtagtagtagaatagcagatggaacactgagaagtgatttccttaaggacagatttccatgatggaaaggaaatgagaagttctaagaggcgggctagctgcttgtaacctacatggaagaggttatgaaatgacgatagactagaatgggcttgtgaggctggaaggagatattttccttggtccaagaaccatttgccttgtgtgggaagagattgataggtggaagtttcagtgggggaataggtgagaatgaccagatgagaaggagaaaaactgccatgagggttagaagttggaactctagctgcttttttagctaccttgtcagcataagcattgccctgagtgatggcatcttatgccttttgatggcctttgcagtgaatgacttcagcttcctttggaagtaaagcggccttgagaagagtttttattaaagaggcattaatgatggaggacccttgcatagtgaggaaacctctttcagcccttataacagcatggtggtgcaggatatggaaggcatatttacagtcagtataaatattgacgcgtagtccctttgcaagagtgagggcttgagttaagacaatgagtttggcttgctgagaggtagtggaggggggcagaaattatatgcgtcaggtgtgaggaagaaaatagattttggaagttatgagaactatagagagtgagttgagcacagtttgtgattttgagggcctctaaaagtattaaggcagcggcagccactgcacacagacatgaaggctaggctaaaacagtaaggtcaagttgtttggataaaaaggctacagggcgcagtcccagctcttgtgtaaaaattccgactgcacagccctgcactttggctgtgtgtaatgaaaaaggattgggatgagttagggagagctagtgtgggggcagcttctagggctgtttttaaggaacggaaaggagtggcaaaaggatttaggatctgtggggtcagctaggtttccttttgtgagtttatataatggttttgttaggatggcaaaaccagtatccaaaggcaaaagtatccaaccatgcccaggaaggaaaggagttgttgttttgtagaaggcattggggtttgggagattagtcagacgtgatcagcagggagagcatgtgtattttcatgaagaattatgtcgagataggtaatggatgaggaagaaatttgggcttgactgaagtaatgggggctgtccgtgaagccttgtggcagtacagcccaggtaatttgtgagtctaatgggtgtcagggtcagtccaagtgaaagcaaagagagtctaggatgaagggtgcaaggaatagtaaagaaagcatgtttgagatccagaacagaataaggggttatggaggggttgtggagggtggtattgaggataggagagtatatgggtttggcaccatggggtggataggcaagacaatttggttgataaggcgcagatcctgaactaaggtaaggcttgtcttgttttaggacaggtaaaatgggggaattgtagggagagtttacaggctttaaaaggccatgctgtaacaggcaagtgataacaggctttaatccttttaaagcatgctgtgggatgggatattggcattgagtggggtaagggtgattaggttttaatgggatggtaaggggtgcatcatttgtcaccaaggagggagtagaggtatcccatacttgtgggttaaggtagggggatacgagaggaggatgcaaaggaggctttgaactggggaaaagggtggcaatgaggtgtgcttgtagcctaggaatagtcagggaagcagataatttagttaaaatgtctcgacctaataagagagctgggcaggtggggataactaaaatgagtgcataaaagaatattgtccaagttggcaccagagttggggagttttaagaggtttagaagcctggccgtcaataccaacaacagttatggaggcaagggaaacaggcctttgaaaagaaggtaatgtggagttggtagcctccttattgattaagaaggagacggacttaccctccactgtaagagttacccaaagggtctgtgatggtccagggggcttccgaggtgatcaggcagcgtcagtctttagccactaagctgagaatatctgggaatgagtcagtcagagagccttgggccagagttccaggggctccgggagtggctgccaggtgagttggacagtccgatttccactggggtcccgcacagatgggacatggcttaggaggagtcccaggctgcgggcattgcttggcccagtggccagatttccagcacttgtagcaagctcctggggaaggagtttctggaggaacccctggcagtggcggttcaggtgtttggagttcttgtgtgctggagatgtggctggggtttgtctcacagtggaggcaaggaattgcaactcagaaatacattgctacttggctgcctctactctattattgtacaccttgaagcgaggttaattaagtcctgttgtggggttcgagggccgaatttaatttttggagctttatttaatgttgggagcaaattggttaataaaataaaatgcatattgagattaagacggccttctggcccctctgggtctagggcagtaaagtgtctcagggttgctgctaagagggccatgaactgggctgggctttcgtctttacctcgggtagtttctttaagtttgtcataacagctttgtaagctgcctttttaagccctttaactaggcaggaaaccatgtaatctcgcctagctatacctggggaatctgcctgatagttccattgggatcttctcggggaactgctctaatgccttcctggaggtctggctcatgaagccagtggttatcagtgtgagattgggctggagaaaaaactctttcccattcatccggggagagggtagaagtcaggatgacatttaagtcactccaggttaaattgtaggacagagttagatatcggaattcctgtatatatttagtggggtctgatgagaaagagcctaaacgctggctgatttgggaaaggtctgatagaggaaaaaggagcattaacgttgactatgccttcagctccagccacgtctttaagaggaaatagttgggcaagtgggggaggactagtcacggaacaaaactgtaaaccagactgggtgtgaggaggggaggtgatagaaggattatagggtgcggaagcagaggctgaggaagaattgggacctggcttggcctggcgaggagcagcctggggagaaggggagaggtcagatgagtccgtagaaaagaaggattcaaaggactcaagagcttggggtggagactgaaggaacagacaggagagaaagaagaaagatttgggacgagtctcactgggagcagagactagggaggaaccaatgtgtaaaagaatgcctggacgtcaggcacctcagaccatttgcccattttttgacaaaaattgtctagatctcataggatggagaaatcataagtgccgttttctggccatttagaaccattgtcgagcttgtattggggtcaagcagtattgcagaagaaaataaggcgtttaagttttaggtcaggcgagagttgaagaggttttaagttcttgaggacacaggctaagggagaaggaggaatggagggtagaaggttgcccatagtgaaggaggcaagtttaaagagaagggtagagacatggagagaaggggtagggggtgcttgccccccaggaaagtggagaaggggtgggaggtgcttgccccccaggaaagttgaaacggggtgggaggtgcttatctcccaggaaagtgggaatgaggtgggaggtgcttgccccccaggaaagtgggaacagggtgggaggtgcttgtccccaggaaagtgggaacggggtgggaggtgcttgccccccaggaaagtaggaacgggttgggaggtgcttgtcccccaggaaagtgggaacggggtgggaggtgcttgccccccaggaaagtaggaacgggttgggaggtgcttgtcccccaggaaagtgggaatggggtgggaggtgcttgccccccaggaaagtgggaacggggtgggaggtgcttgccccccaggaaagtgggaatggggtgggaggtgcttgtcccccaggaaagtgggaacggggtgggaggtgcttgccccccaggaaagtggagaagggatagagacacagacagaagaggtgggggctgcttgccccccagaaaagtggagagaaaagacagtagaggcacggagagaaggggtggggggtgcttgttccccagaaaagtggagagaaaagagagagtagaggcatggagagaaggagtggggggtgcttgcctcccaggaaagtggagagaaaagagagagtagagaaatggagagaaggggtggggggtgcttgtcccccagaaaagtggagagaaaagagagagtagagacacggagagaaggggtggggagtgcttgccccccaggaaagtggagaaggggtggagacatggagagaaggtgtcaaggggtgcttgccccccagaaaagtggtgcttgccgctaagggtgaaggaccaaggcaggtgtccccgtgaggtcagacacctctgaaacgtgggtgaataatcaggcaggcgacctgcaatgattaaacactaagggaaggctgccttcccgagtctgtgacctgcgccggagttttgggtccacggataaaatgtgtctcctttgtctctaccagaaaatgaaaggaattgaaattatgagaagggacagattgaagggtggcaccaagatttaaaggagaaagaggttgagggatagtgagagagattggagaagagagtaaaaagaggccacttacccgatttaaaatcggtgagatgttccttgggctggttggtctgaggacccgaggtcgtaggtggatctcttcatggagtgagggcaagaacaggggactggtctcctgaaggagtcccgctgaccggggtctttggcaccaaatgtctcatatgtccgtgtgaagagaccaccaaacaggctttgtgtgagcaacaaggctgtttatattacctgggtgcaggtgggctgagtccaaaaagagagtcagcaaagggtggtggattatcattagttcttataggttttgggataggcggtggagttaggagcaattttttgcaggcagggggtggatctcacgaagtacattctcaaggatagggagaattgcaaagaaccttcttaagggttggggcgattacaaagtacattgatcagttagggtggggcagaaacaaattacaatggtggaatgtcatcagttaaggctattttcacttcttttgtggatcttcagttgcttcaggccatctggatgtatacgtgcaggtcacaggggatatgatggcttagcttgggctcagaggcctgaaagagatcatctgcaacatcagtaacactgacaggagttgggttttggttacaaaagagcctatctttctttcttttcttttcttttttttttttttcgagacagagtcttgctctgtcaccaggctggagtgcagtggcgcaatctcagctcactgcaacctctgcctccatggttcaagcgattttcgtgcctgagcctcctgagtagctgggattacaggcacccaccatcatgcccagctaatttttgtatttttagtagagacagggtttcaccatgttggggccagaaaggtctcgatctcctgaccttgtaatctgcctgcttcagcctcccaaagtgctgggattacagtcatgagctactgtgccaggctttttttttttttttttttttctgagatgaggtctcgctctgtgcccaggctggagggcagtggcactatcttggctcactgcaacctccacctcccaggttcaagcaattctcatgcctcagcctcccgagtagctgggatcacaggcacaccaccacgcctggctaacttttgtctttttagtagagacggggtctcaccatgttggccaggccagtcttgaactcctgaacacaagtgatccacctgcctcggcctcccagagtgctgggattacaggcacgagccactgtgcccagcccagaagagcctttcaatctggcaggtagaagttgctcaataaatctatgcttagggaacaaatgaaggaatctgccaattgctgactttctagtgctaagacctgccatttttttcccccttaaatagaatatttttgtctcccttaagccagttctgagcagataggacagggagaatttagagggcagaacatttaagagaagaaatgtagaccattggtgtttactcacttctgtctttcaaaagttatgttgtaggagttattaagaaattattggccaggcacggtggctcacatctgtaatcccagcactttgagaggctgaggcgggtggatcatgaggtcaggagttcaagaccagcctggttaatatggtgaaaccccatctctactaaaaaatacaaaaattagctaggcatggtagtgtgtgcctgtagtcccagctactcaggaggctgaggcaggagaatcgctggaacccaggaggcagaggttgcagtgagccaagattatgccactgccctccagcctgggtgacagagcaagactccatctcaaaaaaaagaaaaaaaaaaggaaagaaagaaattattttaggcagatagagaggaaaaggggtccttgggaagttttctttttttttttttttcctgggaaagtgctggtattttttttttttttttttttttttttgagacagagtcttgctctgtcacctaggctggagtgcagtggcgtgacctcggctcactgcaagctctgcctcccgggttcacgccattctcctgtctcagcctcccaagtatctgggactacaggcactcgccaccatgccctgctaatttttttgtatttttggtagagacgaggtttcaccgtgttagccaggatggtctcgacctcctgaccttgtgatccgcccatctcggcctcccaaagtgctgggattacaggcgtgagccaccgcgcccagccatagtgctgggattacaggcgtgagccaccgtgtctgacggaagttttcattttttaaagcatctctggaaaagtttcttgtaaagccccggctcttagagccaggccagcaacctctgatatgcaaatgaaggccattagaaactgggtccacccaacatggccaggctggcaacctttaatatgaaaatgccagctgttagaaacttggtccaccaaacatggtgattctcccgcctttttgcccttgccccacatgtgactggctacacggccacccccacatgtccccatgtgtgtagaacattaaggtgccctacatttgcatattaagagcctagggtgggagggccagcgtttttggggctacctgagtgacatgcctggtcaaaccaagcccctgagccctatgcaaatcaagcaccgcctcctctagccatcgcatgtaactggctgatattacctgagcaggacttccctctctcggctttggagcccccttccctctgtctctgtacaggcgagcttccttctcccttctttcttgccccttcttgcctattaaactctctgctccttaaaaccacttcacgtatgtctgtgttgttttatctaattcaacgtaagacaagagccctggtgttcgtccgctcattgaagccgtatcatttagaagaaaaaattttttaaaaattgaacacatatgttggatgtgtttaagtttgttttttacaagttaatatactactcatgcaagagaagatctcgacatttcgcaggggcctttaagcttttcattttaatttactgcaaagtttacatattctaaagtgagtcactaaaacatgaaaagtaaatccagaattttcttcaccttctagtccaggatagacattattaacacagagaaataaatggaaaaacaatgttaatttcatggcatttctaaaaatcgattaaaagtggggaaaagcaatctctgtttcaaattagatttcaaataagtaagaattacatgatgtaccaaaagctcttttccagtaaaggagaggctttcttttcctcatgttaggaacacacaattttgtagaaggcaaaattggttgtttcttatgcccgggggcactggcctttgcatttgctggagtttaaataaatttgaagtttaaaattcaaggaccatctctgaatgagcagctaatgtttaacattttctcattgtggttattagatagagcagcttatggagacaaaagcctaggcttgcttgagaccctgggtttgagatgtgactgacaatgccaatagtgagaaagcttaaacaaaacaaaaccttaaaatttaatttaattttgttttgtttttctagatggagtctcgctctgtcacccaggctggagtgcagtggcacaatctcggctcactgcaacctctgcctcccaggttcaggttattctcctgtctcagcctcctgagtagctgggactacaggtgcatacaaccatgcctggctaatttttatatttttagtagagatggggtttcaccatgttggccaggctggtcttgaactcctgacctcagggagtccacccaccttggcctcccaaaatgctgggattacaggtgtgagccactatgcccagcctaaaatttaattttgaaaatatatatttctttttcccccaaagatagtggaaacaaggaaggcttcccagaggcagaggcttgagtcaagtctttgataaggcaaagaaatggaggaagattattaaaaaagagaatatgatttcatacccaaatcacacgggtatgaaacaacaggatctgctgatgtggtgacgtgcacctaaagtcccagctgcctggaagtctgaggctggatgattgcttgagcccaggggtttgaggctgcagtaatctatgattgtgccaccacactagcctgggtgacagagtaagacccggtctcaaaaacaaacaaacaaacaaaaacaggatttgtttgggagaatgcaagttctgtttgtggcatccctagggtgtggggtgtccaagggcatgagatggagctagagaggtgaacaggattcagaatcagaaaaggccttgggtgctaatgtgagaaatttgaaatttatcctccatattatgggaagccattataggatttttcagtttcttcttttatttatttacttttttgagacagagtcttgctctgttacccaggctggagtgcaatggcacagtctcggctcactgcaaccttcgcctctgggttcaagcaattctcctgcttcagcctcttgagtagctgggattacaggcatgcaccaccacgcctggctaatttttgtatttttagtagagatggggctttaccatgttggcaaggctagtcttgaactcctgaccttaggtgatctgcccgccttgggctcccaaaagtgctgggattacaggcgtgagccaccatgcccggcccccagtttcttcctttaaattaaagcagttgtgtttatgtttctaaatatcctcctaaaaattttacatcttaaaagcagtaggtttgagtccttactttacgttacacttacctgtggtattttttaaaatatagatgaataaactccacctcattcagattccaattcaattagtctagggatggggcccaggcatcagcattttttaaagggcatcaggggattctaaattcaaccagggttgaaaattattgcttttatggtgaattgcttcaaccaaataatcagatcaacatctgactgagaactgtctaggacggcagctgcttcaactttgatgtgcatgtgaatcacctggaaatctgactcagcttcagtaagtcggggtggagcctgagattctgcattcctaacaaactcccaggtgttgctgatggtgccaatagagatggtctagactctaggatgaagaggaaggggtttgaatggaagtatggaggagtcgtttggaaacactggcacctgtagagtaattcttgctggggcatactttctttggaaaaaatcagacaacacaagaacagtagatagacagagggtgcaggggaagaggagagaggtgggagacaccaaggaagaacatgcattaggggcctgggagagggaggagggggagggaaaggatgtcaccagaccatctcagagtaaaggtcttgggcaacttatttaatttctttaagcctcattttctagcatgtctcaaatacagtggctcacctgcatcagagccaactaagggtacttatcaaacattaggatttgcagtttttccaacctagtccgaatgattcagaatgaaggaggaggaagggtaagaacctgcacttacagcaagcacaccaggttattattatgtaccttcaatgtggagaactggaactctgattgttaaaataagatagcaagcacccagaacacatgaagtgctcaataggtggtaaccatggtgatgatgatggtaatggtgatacagtaaacatctctggtccagcccagacttggcagaacaagagttttatgcatcctactctttcagatgagatcggtaggatggtatggttgtagaccatcctactctttcaaattggtccctaccaaagatgtctgccagctgcttgccacaggaaaagtgggggcacttccacatgattatatttctcttgacttctccagctttctcaaaaggtccttttcaaggggaactcattaaacaatgtgttctcaaagaacatttattatgatggtgtaaaaccgaagaaaatgaggtgagtctcaactactttagaggtttattttgccaagattgggggcatgcataacaaaaagcacaaaatcacaagaacatctgtgatctgtgcttttttccaaagagggtttggggacttccatttttaaagaggaaagagtgggcagtcagggaaagaagaaagaaaaaaaaaggcaggggcaggagaataaataaaagaggcaagcagttgcattcttttgaggctttgatcagcgctcattgaattcacattttatgtgctaaaagggggtagaggaatagtcaactgtgcattcttctgtagctctgtgaatctgcattttacagaagataaagtaaacttagagtagaagaagcaatcaagtatgcatttgtctcaggtgagtggagggatgactctcctcctctctttgtcccttacctatgaagagacgttgttgatgtacatagggtgaaattcagcagaactctgttttagggtaaagatcttggggcccacaaggaatttccaggccctccaggagacttatcgttgtagctctctatttaggaacaaaatgggaggcagttttgtgcaattcagttcccaatcttaatttttccctttggcacagtgagtttggggtttcaagatttctttttcctttcacaatggaaagtgtctactatataatattaactttaaacaacagaatgtttgattggcccaaatttggtgtaaaaattgcggcagaatgaatttttaaggtattgctttgtttctacttgcagtttttaattttctgcacccccatcaagaagagaacaggctccttttcaaagggaaggtctgtgatggggtagaaagcaaaagttcagcctggccaacatggcaaaacctccactctacaaaaaatacaaaaattagctggtgtggtggcacatgtctgtagtccctgttacttgggaggctgaggtgggaggattgattgaacctaggaggtcaaggttgcagtgagctgtgattgcatcactgtactccactctgggtgacagaacaagatcttatctcaaaaaaaaaaaaattgccagaaaaccacttcactttctagcttttgttttcaaaagtctaaaccattgagacaattatgttcggtgcctccagggaaactgtgggaattgctcttgaagtaaatactcccctcgccctgaggaaaacactttcttagggactaaaaagagattcccttgagcactaggagaaagaggtgtgtgggtccccaggggcagatgggcatatgacctttctggagaatcctcttctaatagctaaccttttctcagcttctccttcatcaactaagggtgcaccctgggtttctactatctccttttgcaaatcttggattgtgttctctgattttcctttggaatacagaatccattatcttgaggcatttaaacaaaaaataaagttctaagcccctctaattatctaaatggacttcctcctcacccagggctcttaaaatttaacctgaaagactggttcaggtcatgaagggaagtgggggtctgacgtgcctcattgtacctctttggcattaatatcaacacagactttaagactggtaagaaacattttacaacctattctctctgaagcctgctagctaaaagcttcatctgcatagtaaaactttggtctctaccacctcttattgcaacctagacattcttctctgttgatcccaggtcttcagacaaactcaaccaattgtcaaccagaaaatgttaaaatttacggcttttctggaccaaaccaatgtatttcttaaatgtatttgattgatgtctcatgcttccctaaaatgtataaaaccaagctgcaccaccttgggcacatgttctcaggacctcctgagggctgtgtcatgggtcatggtcactcatattttgttcagaataaatctctccaaaacatgttacagagtttgacttttttcattgacagacatcagccaaaattttaacatccatatacgtacgcatggaagaaagactggaagactggaaacccaccaaggtgtttaccacagatggtgacattgtcggtgatttaaattttttttttttttttttgagatggagtttcactcttgttgcccaggctggagtgcaatgacatgatctcggcttacagcaacctccacctcccgggttcaagtgattctcctgcctcagcctcccgagtagctgggattacaggcatgcactaccatgcccagctaattttgttttagtggagacagggtttctccatgttgaggctggtcttgaacccctgacctcaggtgatccacccgcctcggcctcccaaagtcctgggattacaggtgtgagccaccgcgcccaccctaaattttttctttatattttaaattttgatgtttcaacaatgaacaataatcagaaaaaagcgctatgttgtttatttttagtagagaattccctgaagtctaactttaaatgtctctcttcctcccttacaaaccctattcttacaaactgtagtgtctttttctctgagaccacttatttagccatgcgtggccactccccctctgcattgtcagttatttcttaaaatgaccctagcacctagcatagcaccaacaaatcagagaagtcaagcgcatgttttctgaaatgaacctgtcttgagaatgcccaggattttctttgttaatatcatcaccgttttaaaacttgtttacggtacaagtatagcaccaaccaaataacagagccatttgccccttcatggaaagagagcaacttataatatgctagtccctggagttcctcaggaataaggaaattatctaaaggaggagttattgccaaacatccctatcaacaattcccaaatgatagaaatttggtcatcaaatattatctagtgccatcaaagaaacaattgaaagttaaagcccaatgacagtttaaaaaaaaacccctgatgtccaacttaccctgatgtccaatggcttaccattttaattttttaatttttaaattatttaaaattttttgtgggtatatagtaggtgtatatagggtatatgaaaggttttaatacaggcatgcaatgtgaaataagcacatcataaagaatagggtatcctttcccccaaacatttattctttgagttaaaagcaatccaattacattaagttattttaaaatatagaggggtttttttgctttccctttctttctttcttttcttccttttttttttttttttttttttgagacagagtttggcactgttgtccagactggagtgcagtggcatgctcactgcaatctccgcctcccaggttcaagtgactctcctgcctcagcctcctgagtagctgggattacaggcacccaccaccacgcctggctaatttttgtatttttagtagagatggggtttcaccatgttggccaggctgctcttgaactcctgacctcaagtgatccacttgcctcggcctcttaaggtgacggattacaggtgcgagccaccagacccaaccattatacagttattttattattgactatagtcaccctgttgtgctgtcaaatagcaggtcttattcattccttttaactgttttttgtacccattaatcatccccaccgtcctccccaaccccctgctacccttcccagtctctagtaaccatcattctactctctatgtccatgagttcaattgttttgatttttagatcccataaataagtgaggacatgcgatgtttgtctttctgtgcatggctcatttcatttaacataatgatcttcagttccatctgtgttgttgcaaatgactggatctcattctttttcatggttgaatagtactccattgtgtatatataccacattttctttgtacattcatcggttgatggacatttagattgcttccaaatctgagctgttgtaaacagtgctgcaacaaacagtgcaggtttctctttgatatattgatttcctttcttttgggtatatactcagcagtgggattccagtagctggatcacatggtagctcaatttttagttttttgagaaacctccaaactgttctccacagtagttgtattagtttacatccccatcaatgcatacaaggattcacttttctccacatccttgccagcattcattttacctgtcttttggatataagtaattttaacccggggtgagataatatctcattgtagctttgatatgcatttctctgatcagtgatgttgagcaccttttcatatacctgtttgtcatttgtatgtcttcttttgagaaatgtctatttaaatcttttgcctactttttggttggattattaggttttttttcctatagttatttgagctccttaaatattctgattattaatcccttgtcagatggggagtttgcactgtaggtgtggggatttgtttccgggttctctattttgttccattggtctgtgtgtctgtttttatgccaatgccatgctgtttggttactatagctctggtgtataatttgaagtcaggtaatgtgattcctccagttttgttctttttgcttaggatagctttggctattctgggtcttttgtgggttcatttaaattttaggattggccgggtgcggtggctcatgcttgtaatcccagcactttgggaggctgaggtgggcggatcatgaggtcaggagatcgagaccatggtgaaaccccatctctactaaaaaaatacaaaaaattagccaggtgtggtggtgggcgcctgtagtcgcagctacttgtagaggctgaggcaggagaatggtgtgaacccaggaggcggagcttgcagtgagccaagatcgtgccactgcactccagcctgggcgacagagcgagactctgtctcaaaaaaaataataataataataataaaaataaaaaaataaataaattttaggattgttttttctatttctgtgaagaatgtcattgttatcttgataaggattgcattgaatccatagattgctttggctagtatagacattttaatattaattcttccaatccatgaacatgaagcatttttctatttttttggtgtcctcttcaattttcttcatcagtgtttcacagttttcattacagagatctttcacttctttggttatcttaattcctatgtatttaattttatgtgtagctattttaaatgggattactttttaaatttcttttttttgcattgttcgctgttggcatatacaaatgctactgatttttgtatgttgattttgtatcttggaactttactgaatttgtttatcagttctaatagttttcttgtggactccttaggtttttccaaatatgagatcatatcatcagcaaacaaggataatttaacttctttctttccaatttgaatgccctttatatccttctcttgtctgattactctagctaggacttccagtactatgttgcataacagtggtgacactgggcatccttgttgtatcccagatcttagacgagagactttcagtttttccccattcagtatgattctagctatgggtctgtcatatatggctttaattatgttgagttatattcttttttttttttgagatggagtttagctcttgttgcccaggctggcatgcaatggcatgatctcggctcactgcaacctccacctcccgggttcaagtgattctcctgcctcagcctcccaagtagctgggattacaagcatgcacatcatgcctagctagttttgtatttttagtagagacggggtttctccatgttggtcaggccggtcttgaactcctgattcctgaggtgggtggatccaggtgatccgcccacctcggcctcccaaagtgctgggattacaggcatcagccactgcgccaagccaaggtatgttccctctatccccagttttttgagggtttttatcataaagggatgttgaattttgtcaaataccttttcagcatcaactgaaatgatcatatggtttttatccttcattttgttgacatgatgtatcgcattgattgatttatgttgaaccactcttgcattccaagaatacatatcatttagtcatgatgagtgatctttctgatgtattgttgaatttggtttgccagcattttgttgaggatttttgcatcagtattcatcaaagatattgccctgtagttttctttttttgatgtgtctttggttttggtatcagggtaatatgggcctcatagaattagtttaggagtgtttcctcctctattttttggaatagtttgagtaagattggctttagttctttaaatgtttgatagaattcatcagtgaagccattgggtcctgggcttttcttttctttttttttttttttttttgagacagaattttgctcttgttgcccaggctggagtgcaatgacacgaccttggctcagtgcaacctccacctcccaggttcaagtgtttaagtgattctcatgcctcagcttccctagtagctgggattacagacacgtgccaccacacctggttaatttttgtatttttagaagagacaggtttctccaggctggccttgaactcctcacctcaagtgatccacccacctcagcctcccaaagtgcgggattacaggtgtgagccactgcacccagcctctttataggtgaattgtgtttcttgtagacaatagatcaatgggtcttgttttttcatctgttcagccagtctatgtcttttgattaaagagttcagtccatttatagtccatgttgttattgctaagtaaggacttactcctaccattttgctatttttttttttttggtttttgtggtcttctcttccttctttctttccttccttttgttatctagtgaagtgattttctctggtgatgtgatttagtttcttgcctttttattttttgtgtatccattgcatattttttggtttgaggttaccataaggtttgcacatactatgttataacccattattttaacctgataacaacactatttgtataaacaaacaagcaaaaacataaaaactctatgcccttaacgttgtcctcctgctttttaactttttcttgtttctatttatatcttattgtattgactatgtcttcaaaagttgttgtagttattatttttggttggttcatcatttagtctttctacttaggataagagtagtttatacactacagttgcagtgttattctttgtttttctctatacttactattatcagtgagttttgtaccttcaggtgattatttattgctcattattgtccttttctttttgattcatgtactcccttgaacacttcttgtaggataggtctggtattaatgaaatcccccagcttttgtttgggaaagtatttctcctgcaggtttgacggatattttcactggatatactattgtagggtaaaagcttttttccttcagcactttaaatatggcatgccattctctcttggcctgtaaggtttccactgaaaagtctgctgtcagatgtattggagctccattgtatgttatttgtttcttttgctgcttttaggatcctttctttttggttgacctttgggagtttgattatcaaatgccttgaggtagtcttatttaggttaaacctgcttagtgttctataaccttcttgcacttgaatattgatatctttctctaagtttgggaagtcctctgttattatccctttgaataaactttctacccctatgtctttctctacctcctctttaaggctaataatcttacatgtgcccttttgaggctatttctagattctgtaggattacttcattgttttttattcttttttcttctgtctcctctgtgtattttcaagtagcctctcttcaaccttactaattctttcttctgcttaattctgctattaaaggactctgatatattctttagtatgccaattgcattttttagcttcagaatttctgcttggttctttttatttcaatatctttgttaaatttgtctgatagaattctgaattccttctctgtgtaatcttgaatttctttgagtttcttcaacatagctattttgaattctctgtctgaaaggtcacatatctctgtttctccaggatttgtccctggtgacttatttagttcatttaatgaggtcatgtttttctgagtggtgttgatgctagtagatgttcttcagtgtctgagcattgaggattaggtatttatcatggtcttcactgtctgggcttatttgcagccatccttgggaaggctttccagatatttgaaaggacttgggtgttgtgatctaagctgtatctgctttagaggacaccccaatcccagtgacactgtggttcttgcagaattgtaaaggtacctccttgaatgtcttggacaagatctggaagaattctctggattaccagacagagactctagttctcgtcccttactttctcccaaacatacagagtctctctctctctgttctgagccacctacagctagaggtagagtgacacaagcactcctgtggccaccaccacaatgactgtgctgggtcaaacctgaagccagcatagcactggatctcatctaatgcctgctttaaccactccctgaatactgcctatgttcactcaaggccctggggctctacaatcagcaggtaacaatgccagccaggcctgtgtccttcccttaagggttttaaggtcccccaagcttcaagtgggtccagaagtgctgtccaggagtcagggactagagtaaaaaacattagaagtctacctggtattgtattgcagccgagctggcactcaaaccacaagatgcagttcttcccactttttcatcattttttccaaaggcagaggagcctcacctcatagccaccccgaccccaggtcacaagtacggccagactaccaccaatgttcccttaaggcccaagggctcttcagtcaactggtttgtaaatgctgcctggcctgggtctcacccttcagggcagtgcactcccctctggcccggggagggtccaggaatgctgtccaagagtcaagtcctggaattggggatcccaagaaccctcatggtgctctattcccctgtggctgtgcaagacaaagtcccctttactttaccctctgcttttctcaggcagaaggaacgttgctccatagccaccacagctgggaatgtgctgagtctaacctgaagccagcaagtctcagcagctcacccaaggcccacagtgtagtacctgggtatcactgctggttattcagggcccaagggctctttagttagcaggtgatgaatgctgccaggaccgggttctttccttcaaggcagcaggttccctcctggcccaaagtgtgtctagaaatgtcatcttggagcctgggtctggaatgagggcctctcaactctgactggtgccctgtctcgctgtggctgagctggtattcaagactcaagacaaaatcctctccactcttccctctcttctcttcaagcagaaggaagggggtctcttttggagcctccagctgtatagcccagagttaggaaaggggtgatgccagcacttccttggctgccccacgtgatgtctcagtatgttgcatgccctctcagcccactgtctctagtcctagttcagtcacaggactcactgaagagtttcagtccttatggtctagactgcctttcaaatattcttggagacacagagtgctgtagcgctctgctgaatttgatccagttttcctttctgctctaacaggacagcactgagttcaatgcttcacaattgcagtgttctccctctcccagtgcccagaaatgccctctgcaacacacactgctgccaggggtggggcaggggtggcattagctatttagaactgttttattaatctcttcagtgcctctttcagtgatttgaaatctcttcagtactctttcactgagtactgtgagtgcacacctgatttttggttcttatgaaggtgggttttttttgttttttttttgttgttgtttgtttttttttctgtgtagatagttattaacttgctgtccttgggggaggcaggatgattttccattccaccatcttggtctgccccccaccattttaattttagatgctctctttccacagaacattaggacagacttactatcttgaggaataaataaattttgcaaactatatacgttacctttcacgaagataatttttaaaacaaacattcttggatttttctgcttaaaaataaataaggcggctgggcacggtggcttacacctgtaatcccagcactttgggaggctgaggtgggtggatcatctgaggtcaggagttcaagaccagcctggccaacatggcgaaaccccatctctactaaaaatataaaaattagccagacatgatggcgggtgccagtgatcccagctactcaggaggctgaggcagggagaattgcttgaacccaggaggcagaggttgcagtgagctgagatcatgccactgcactccagcctgggtgaagagtaagactccatctcaaaaaatatatataagaataaggctggttgcttttcatcatcaccagatacttctgtcttatcccctagagaccactgattagttttttgttttcatggttttgcgttttccatcatgtcatataaatggaattaggcatgatgtagcctttgagtctggttttttttcacttagcagaatacatttgatattaatctatgattttgtatatacctttttattgctgtgtagtctttcactgcatggatgtaccacagtttgtttattcagttgaaaaagatttgggttgtttctggttttggttgactgaataaatctgctacaaacagattttcatatggatgtaaattttcatttctctttaaggtaagtagtaagtgtgggattgctgggtagtatggtatcattatatttaaaaattttacctttctaataggtgtaaagtgttatctcattgtaattttaatctgtatttccctaacaatgaatgattttgagcatttctttatgtgcttatttgacatctttgttttctttttttgttgttttttttttttgagacagagtctcactctgttgcccaggctggagtgcagtggcacaatcttagatcactgcaacctctgcctaccaggttcaagcaattctttgccttggccccccaagtagctgggattacaggcgcccgccaccacgcctggctattttttttgtgtgtgtgtatttttagtagagatggctgttagtagagaccatgttaggctggtctcgaactcctgacctcatgatccacacaccttggcctcccaaagtgccaggattacaggcatgagccactgtgcccggccgacatctatatgttttcttttgtaaagtatctgtttacatctttgagccattttttaaaaattgggttatgtttctattcttgagttttaagagttctttatatattataaatataagatctttgccaaatatgtgttttacaaatatttgtcccccctaaccccacttttctttttgagacaaggtttcactctgttgccctgggttaaactgcagtggtgtgatcttagctcactgcaaccttcacctcccaggctcaagtgatcctcccacctcagcctccaaagtagctggagtgcattggcatgatctcagctcactgcaacctctgcctcctgggttcaagcaattctccctgcctcagcctcctgagcagctgggatcactggcacccgccatcatgcctggctaatttttatatttttagtagagatggggtttcgccacgttggccaggctggtcttgaactcctgacctcatgagataaaatcaagaaaattattaacttgttgcttattaaacacacatttctttacaagtaatgatgggcttttactgactgcatttatgtttgaaatgaaattaatttcaaactagaactttcaagtagagttgagataaaacattatgctttttggtccacaggtgtataccaccatgcctggctaattaaaaaaaatttttttttggtagagatggggtctccctgtgttgcccaggctggtctcaaactcctaggctcaagtaatcctcctgcctcagcctcccaaaatgctgggattatagttgtgagccactgtacccagcctcacttttcattctcttaatattgtcttttgtagaacataaatttttaattttgaaaaagtcaaatttatcaaatttttcttttgtggattaggcttttgatgtatcaggaaatatttgcctaatccagtggttttcaaacgaagggcaactctcattccccagaacatttggcaatatcgaagacatttttggttgattggggacagagttgctgctggcctctagtgggtagaggccagggatgctgctacacatcctacaatgcacagtatgaactcttcaacaaaaaattatcaatctaagatgtcaatagtaccaaggttgacaagcttaattcaagatcacaaagattttgttctattattattatttagagacagggtcttactatgttacccaggctggcttcaaactcctgggttcaagcaatcttaccatctcagcctcctgagtagctgagactacaggcacataccactgtgcccggcttatttcttgaaaatttttttacaattttaggctccacatttaaatctatgattcattttgagtttatttttatttatttatttttattgttttttgagatggagtctcactctgttgcctaggctggagtgcagtggcatgatttcggttcatcgcaagctccacctcctgggtttgcaccattcttctgcctcagcctcctgagtagctgggactacaggcgcctaccaccacgcccgtctaattttttgtatttttagtagagatggggtttcaccacgttatccaggatggtctcgatctcctgacctcgtgatctgcctacctcggcttcccaaggtgctgggattacaggtgcgaaccaccgtgcctggccattttgagttaatttttgtagctagtgcaaggtatggattgaggtttgttctttttcaactttaaatcgaggttttatgtttagtagctgagccatcacagtactttacaaataataactttttgtttgtttgtttgagacaggatatcactccattgcccaggctgcagtacagtggtatgatcgtggtcactgcagctgcgactttctgggctcaagtgatcctcccacctcagcctcctgagtagctgggactacaggtgtgtgacaccacacccagctaattttttgtctttttaatagagacaggatgtcaccatgttgcccaggctggtcttgaagtcctgggctcaagcaattcccctgccttggcctcccaaagtaatgggattataggcatcagccaccacacccagccaaaaacatcttttatgttttattttattctttattaaggtataattgacaaaattgtacatatatatggtagacaacgtgatgttttggtgtatgtatccattgtgaataattaagctaacatttaatcacttcacatatttttttggtgatgagaacacttaaaatctaatctcttggcaattttcaagtatgtaatacattattattaactatagtcaccatgctatacaatagatctccaaaagtttttatcctgtctcattgaaactttgtagcctttgaccaacatcactccatttctctggcctcctcacctgccagcacctgctactatcattgtactttctgcttctagttcaacttttttatatttcacatataagtacagtaatgcagtacttgtctttctgtgcctggcttatttcacttaacataatgtcctccaggtttatcatgttgctgcaaatgacacaatttccgtgttttttgttgttgttgttttgttttttgtttttttttgagacagagtcaagctctgtcacccaggctggagtgcagtagtgcgatctcagctcagtgcaacctcctcctcccaggttcaagtgattctcctgcctcagcctcctgagtagctgggattacaggtgcctgccaccacgctcagctaatttttgtgtttttagtagagacagggtatcactgtgttggccaggctggtctcaaactcctgatctcatgatcctcccaccttggcctcccaaagtggtgggattacaagcgaaagccattgcccccgccaaatttccttctttttaaaggctgaatagtattccattgtgtgtgtgtatatatatatatatatatatatatatatatatatatatatatatatacatatatatataccaaattttctttatccattcatttatcaatgaatatggtattcattccatattttggctattgaaggttcttttttgatgattgcctaattgtttcaatattatcaagactatcctttttttctgttgaattatctttgcaccttttctgaatatccattgagcatatatgtgtgcgtctattttgtgaacacttattctgttccattgatctatatgtctatcctttcctgataccatatagtcttgatgactattgctttgtagtaattcttttgtttttttgagacagagtctaactctgtcacccaggctggagtgcagtggcatgatcttggctcactgcaagctctgcctccctggttcacgccattctcctgcctcagcctcccaagtagctgggactacaggggcccgccaccatgcccggctaattttttgtatttttagtagagatgtggtttcaccatgttagccaggatggcctcgatctcctgacctcttgatctgcctgtctcagcctcccaaagtgctgggattacaggcatgagccactgcgcccagctgctttatagtaattcttgaaataagatagtctgagtcttaaaattttgttcttctttttcaaaattatatttgctattctagtttactttattattatttttgattgctgcttatagtggttgccaagtagccaaacattaaattcaatatttggccaaagctgagactgaaattaagtatcatcattgcagaaaaaaattctaatgtaaaaaaattaatttgagatcttattgtaataaataaggccaggtgcagtggctcacacctataatcctagcagtttgggaggccaaggcaggcatatcacttgagcccaggagtttgagaccagcctgggcagcatggtgaaagcacttctctacaaaaaatacaaaaatatcagtcagatgtggtggcacctgcctgtagtcccagctactcgggaggctgaggtgggaagactacctgaccctggggaagttgaggattcggtaagccatgattttgccactgcactccagcctgggcaacagagtgagaccctgtctcaaaaaaattaataatcaaaggtctctctaacaacctgcaactctttggagttgggaacattggtttacctggaaccagtttctgcttttcctgtacttctgggctgagccaagggtcaacggagaggaagccattcagcttcggggtcctgacaacaagttggttgacccggcagccatgagcggaactctcaaagtcatgtcgcccaagcaagacttgcctatctatcctatctaccctgacccttgcctcctgggtcctaatgcctgccagacaaacttcctctcacttctcttctctgaggctagtcacgcttctaaaaaccactccctgtctctggtgcttttctagtttctcctatgagaatgatttctcgtataaacttcaggactctgttacctccttttggcacctgggctcaccaatgagaaagacatattttttgcccaaagccccatcataggtgggactatctggaattttcagatccctcctcagacaagcaggcctaacaaaagcaaagctattcctaaagctaggatatggggagcctcagaaattgtatccttcctattcatataaatgaggacaaaaggcatcactcttctaactctggagatccctttcctccctcagggtatggcccttcacttcattttggaggcataatatctttataggacaggcgtaaagtctcaatactaacaggagaatgcttaggactctaacaggttttcgagaatgcatcattaagggccactaaatccgatttttctcagtccttcttgtggtctaggaggacaggcaagtgtgcagatttttgagaatgcatcagtaagggccactaaatccaaccttctttggtcctccttgtggtctaggaggaaaactagtgtttctgctgctgtgttggtaagcgcaactattccgatcagcagggtccagggaccattgtgggttcttggacaagaggtgttttcggctactgcatcggtgagcacagctattccaatcagcaggctccagggaccgttacgggttcttgggcagggggagaaacaaacaaaccaaaactgtgggcagttttgtgtttcagatgggaaacactcaggcatcaacaggctcacttttgaaatgcatcctaagccaatgggaccaatttgatccataaaccctgaaaaagaggcagctcatttgtttccacactacggcctggccccaatattctctctctgatggggaaaaatggccacctgaaggaagtacaaattacaatactatcctgcagcttgaccttttctgtaagagggaaggcaaatggagtgaaataccttatgtccaagctttcttttcactggaggagaacatacaactatgcaaagcttgcaatttacatcctacaggaggacctctcagcttacccccttatcctagcctccctatagctccccttcctattaatgataagcctcctctaatctcccccgcccagaaggaaataagcaaagaaatctccaaatgatcacaaaaacccctgggctatcagttatgtccccttcaagctgtagggggaggggaatttggcccaacctgggtacatgtccccttctccctctctaatttaaagcagatcaaggcagacctggggaagttttcagatgatcctgataggtacatagatgtcctacagggtctagagcaaacctttgatctcacttggagagatgtcatgctattgttagatcaaaccctggcctttaatgaaaagaatgcagctttagctgcagcccaaaagtttggagatacctggtatcttagtcaagtaaatgatagaatgacagccaaagaaagggacaaattccctaccagtcagcaagccatccccagtatggatccccactgggatctcaactcagatcatggggactggagtcataaacatctgttgacctgtgttctagaaggactaaggagaattaggaaaagcccatgaattattcaatgatgtccaccataactcagggaaaggaagaaaatccttctgctatccttgagcagctatgggaggccttaagaaaatatactcccctgtcacccaactcactagagggtcaactgattctaaaagataagtttattgcccaatctgcagcagatatcaggagaaagctccaaaagcaagccctgggccctgaacaaaatctggaggcattattaaacctggcaaccttggtgttctataatagggaccaagaggaagaggcccaaaaggaaaagtgagatcagagaaaggccgcagccttagtcatggccctcacacaaacaaaccttcatggttcagagaggacagaaaacagagcaggccaatcacccgggatggcttgttatcagtgtggtttacaaggacattttaaaaaagattgtccaacgagaaacaagctgccccctcgttcatgtccactatgctgaggcaatcactggaaggtgcactgccccagaggacaaaggttctctgggtcagaagctgccaaccagatgatccagcaacaggactgagggtgcctggggcaagcgccagctcatgtcatcaccctcactgagccctggggacatttaatcattgagggccaggaaattgacttcctcctggacactggcgcggccttctcagtgttaatctcctgtcttggatgactgtcctcaaggtccgttaccatccgaggaatcctgggacagcctgtaaccagttgtttctcccacctcctcagttgtaattgggagactttgctcttttcacatgcctttcttgttatgcctgaaagtcccacacccttattagggagggatatattagccaaggctggaactattgtctacatgaatatgaggaacaagttacccatttgttgtcctctacttgaggagggaatcaaccctgaagtctgggcattggaaggacaatttggaaggtcaaaaaatggccacccagtccaaatcaggctaaaagatcccaccacttttccttatcaaaggcaatatcccttaaggcctgaagctcataaaggattacaggatattgttaaacatttaaaagctcaaggcttagtaaggaaatgcaacagtccctgcaacaccccaattctaggagtacaaaaaccgaacggtcagtggagactagtggaagatcttagactcatcaaaaaggcagtaattcctctatatccagttgtacccaacccctatagcctgctctcccaaacaccagaggaagcagaatggttcactgttctggacctcaaggatgccttcttctgtattcccctgcactctgactcccagtttctctttgcctttgaggatcccacagaccacacatctcaacttatgtggaccgtcttgccccaagggtttagggatagccctcacctgtttggtcaggcactggtccaagatctaggccatttctcaagtccaggcactctggtccttcagtatgtggataatttacttttggctaccagttctgaagcctcatgccagcagactactctagatctcttgaactttctagctaatcaagggtacaaggtgcctagatcgaaggcccagctttgcctatagcaggtcaaatatctaggcctgatcttagccagaggtaccagggccctcagcaaggaacaaatacagcctatactggcttatcctcaccctaagacattaaaacagttgcgggggttccttggaatcaccggcttttgctgactatggatccctggatacagagggatagccaggcccctgtatacttctctttatacatcacagagagtgcagggctagctcttggagtccttactcagactcgtgggacaaccccacaaccagtggcatacctaagtaaggaaattgatgtagtagcaaaaggctggcctcactgtttaagggtagttgcggcgttggcttagtgtcagaggctatcaaaataatacaaggaaaggatctcactgtttggactactcatgatgtaaatggcatactaggtgccaaaggaagtttatgggtatcagacatccgcctacttagataccaggtgctactccttgagggaccggtgcttcaaatacatatgtgcatggcctcaaccctgccacttttctcccagaggatggggacccaatcgaggatgatcaccaacaaattatagtccagacttatgccacccgagatgatctcttagaagtccccttagctaatcctgaccttaacctatataccaatggaagttcatttgtggagagtgggatatgaagggcaggttatgtcatagttaatgatgtaaccgtacttgaaagtaagcctcttcccccagggacaagggcccagttagcagaactagtggtgcttacctgagccttagaactgggaaagaggaaaaaaaaataaatgtgtatacggatagcaaatgtgcttatctaatcctacatgcccatgctgtaatatgggaagaaagagagttacctctggggggaacccccataaaatacgacaaggaaatcatggagtgattgcactcagtgcaaatactcaaggaggtggcagtcttacactgccaaagccatcaaaaaggggaaggagaagggagaacagcagcataagtggctggcagaggcaaggaaagaccagcagaaagaaaagagagaaagagacagaaagagagagagagaggaagagacagacacaaagaaggagtcagagagagagagagagaggagaagagacagagacaaatagggagtcagagagacagagagagtcagagagaggaagagacagacaaaaagggagtcagaaggagacaaagaagaagtcaaagagaagaaagagagatggaagtagtaaagaaaaaacgtataccctattcctttaaaagccaaggtaactttagaacctataattgataattgaaggtcttctctgtaaccctataacactccaataccaccttgttgtcagtgtaaacaagggcgtagcctgaaagcactgaggccactgacaacccatagccttcctatcaaaaatccttaacccagcaggtttcctaacaggggatctaaatcttaactaattaccatacaaaggtccgatcagaccaaggaggaactcccttcaggacaggaagatagatgtttcctcccaggcgattaagggaaaaagacacaatggatattcagtaagtgataaagaaactcttgtaaaatcagagttaggaaaattgcctaatgatatgtctgctcaaacctgcgagctgtttgcactcagacaaacagaatcaggaaggagccatcttatagaatcaggaaggaattatctataccaattctaagttaatatggactgaacaaggttttattaacagcaaagaaaaaatcccaaacttacaagattttcaactaaagtttgctaaaagttaacagtgtaacatgtattatcctactaccacacactctcaaaggatttctcagacagtttgcaagagataacaaaatctatccttactctacaatcccaaatagactcttcggcggcagtgactctccaaaaccgcagaggcgtagacctcctcactgctgagaaaggagatctctgcaccgtcttaggggaagagtgctgtttttatactaaccagttagggatagtacgagatgctgcccggcatttacaggaaaaggcttctgaaatcagacaacacctttcaagctcttataccaacttctggagttgggcaacatggcttctcccctttctaggtcccatggcagccatcttgctgttactcacctttgggccctatatttttaacctttttgtcaaatttgtttcctctggaatcaaggccatcaagccacagatggtcttacaagtggaacaccaaatgagttcaaccaacaacttctaccgaggacccctggactgacctgctggcccttccactggcctaaagagttcccctctggaggacattacaactgcagggctccttctttgcccttatccagcaggaagtagctaaagcggtcatcggccaaattcccaacagcagttggggcatcctgtttagaggggggattgagaggtgaagccggctgggcttctgggctgggtggggacttggagaattttctgtctagctaaaggattgtaaatgcaccaatcagagctctgtgtctagctaaaaggtttgtaaacacaccaatcagcactctgtaaaatggaccaatcagctctctgtaaaatggaccaatcagcaggatgtgggtggggccaaataagggaataaaagctggccacccaagtcagcagtggcaacccgctcaggtccccttccatgctgtggaagctttgttctttcactcttcgcaataaatcttgctgctgctcactctttgggtccgcactaacttcatgagttgtcacacttaccgtgaaggtctgcagcttcactcctgaagccactgagaccatggacccaccaggaggaaaaagcaactccagacgtgccacctttaagagctgtaacactcaccgcgaaggtctgcagcttcactcctgaagccagcgagaccacaaacccactggaaggaacaaacaactcctgacgcaccacctttaagagctgtaaccctcacagtgaaggtctgaagcttcactcctgaagtcagcgagaccacgaacccaccagaaggaagaaactccggatacatctgaacatctgaaggaacaaactccggaccatctttaagaactgtaacactcaccgcaagggtctgtggctttgttcttgaagtcagcaagaccaagaatccactggaaggaatcaattccggacacataaggccgggcacggtggctcacgcctgcaatcccagcactttgggaggtcgaggcaggtggatcacgaggttaggagatcaagaccatcctggctaacacagtgaaaccccgtctctactgaaaatacaaaaacattagccgagcatggtggcagtcacctgtagtcccagctactcgggaggctgaggcaggagaatgcgtaaacctgggaggcggagcttgcagtgagctgagattgtgccactgtactccagcctgggtgacagagtgagactccatctcaaaaaaaaaaaaaaaaatgctgggcgtgatggctcacacctgtaatcccagcactttgggaggccgaggcgggcagaccaccaggtcaggagatcaagaccatcctggccaacatggtgaaaccccctctccactaaaaaaaatacaaaaaaaattagccaggcatgggggtgagcgtctgtagtcctggctactccggaggctaaggcaggagaatggcgtgaacccgggaggtggagcttgcaatgagccgagatcacaccactgcactccagcctgggcaacagagcgagactccgtctcaaagaaaataaataaataaaaaataaaaataaataaataaataaaaaagataaagtggtaggcttaagcccaaacatatcaatagttacattaaatgtaaatggtttaactataaaaattaaaatacagtaactagcataatggattaaaaacatgccctaattatatgttctctacaagaaactcacatcaaatacaataacgtatgttgaaagtaaaaggacaaaaaattacacaagcattaatttaaaatgttatgttaacattagataagtggacttcagagcaaacaaaattacctaaccctagcactttcggaggccaaggcaggcagatcatgaggttaggatcaagaccagtcaggccaacatggtgaaacctcgtctctactaaaaatacaaaaattagctgggcgtggaggtacacacttgtaatcccagctacctgggaggctgaggcaggagaatcgcttgaacccaggaggtggaggttgcagtgagccgagattgtgccactgcactccagcctgggagacagagtgagactccatctcaaaaaaaaaaaaaaaaaaattaccagagatggtgaagtacattactaataataaaagtataaatctaccacaaaggcatagcaatcctaattatatatgtaccaaataacagaactacaaaatatgtaaagcaaaaactgatagtattgaaaagagaaacagacaaatccacaattacaattgaagactgcaacatccttctctcaacaattgatagaaaagctagacagaaaatcagcaaggacatagaagaaataacatgaccatcaattaacaggattgaactgacttttgtgaaacactcaacaacaggccacacattattttcatgtgcccacagtacatataccaagacagaccatgtcctaggccaaaaaaaaaaaaaaaaaccttgaaaaattaatacccattgaaatcctaagagtgtgttttctgactacagtggaaacaaactagaaaccaataacagaaagataacatgaaaatttttaaacacttgcaaactaaacacacttgtaaataatacttgggtcaaaaagagggtcttaaggaaaattaaaaacacattcaactaaataaaaatgtaaagacgatatatcaaaatttgtaagatactgctaaagaagtcttgagaggcaaagttatagcatgaaatccctgcattagaaaagaggatatttcaaggctgggagcagtggctcacatctttaatcccaatactttgtgaggccaaggcaggtggatcatgtgaggttaggagttcgagaccagcctggccaacatagttaaaccccatctctactaaaaatacaaaaaggagctggatatggtggcaggtgactgcagtcccagctacttgggaggctgaggcaggagaatggcttgaacccaggaggcggaggttgcagtgagctgagattgcaccactgccctccagcctaggtgacagagtgagactgtctcaaaaaaaaaaaaaaaaaaaaaggatatttcaaaaagttgtatgaaaagaagaaaaaaggaaggtctcaagtctgtatttctcataactacatgtgaatctataattgtttcaaaataagtttataattatgtattaacatacatatttcaatcatttaatagagcttcaaaacataaaatgtgagatttccagtttgacttttttgtagcatgcttccatatactattcatagatagtcacaataattctgaatgacaggccttgttggtattactgacattgctaggctgcctaggtgtgaggtggtacttacacagtttcatgatcacacacaagtttaagaatgtcagaaaagagactgaagtagccattcagctatatggttttccagagggaaagcttgggtcaaaaatcagaaattggcctggcacagtggttcacacctctaatcccagcacttttgggaagtggttggatcacttgaggccaggggttcgagaccagcctggccaacatggcgaaaccccatctctattgaaaacacaaaaattagctggatgtagtggcacatgcctgtaatcccagctacaagggaggctgaggcacaagaatcacttgaacccagaaagtggaggttgcagtaaaccgagataacaccactgtactccagcctgggtgaccgagcaagactgtctcaaaaaaaaaaaaaaaaatcagaaattgaataccaaggtcaaaattggtattgaacctcaatgcccaatatttttatgtcaaagtgccagtttcctgtaggtggacgtctagttggtttcttgctttttgctcttacaaatagttctacaatgacaatctttaaatatatatctgtgtagtctttagggtatctatctgtaggttaattcctacaattggacttgtggtcaaaggtatacgtatttaaaattttgattgataacgtcaattttctatctaaaaaccttataccaatttgtacctccatacctctatgcacgtgttgtttttccacacatttactaacattagatattatccaactttattttttgtcgttagaatagggtttttactttgtttttgagacagaatctggctctgtcacccaggcttgagtgcagtggtacaatctcagctcgctgcaacttctgcctcccgggctcaagtgatcctcccacctcagccttctgagtagctgagactacaggtgcgtgccactatgcctggctaacatttgcattatttgtagagacagggttttgccatgttgttcatgctggtctcaaactcctgagctcaagcagtcctcccgtcttggcctcccaaagtgctgggattacaggagtgagctactgtgcccagtagaataagggttttaatttgcttttgaaaaaatagactttagagtagttttaggttcatgtaaagtttagtggatacacagagtgctcccatgttatacctgcctccagatgtgcaccgacttccccattatcaacatctcccaccacagtggtatatttgttacaatagaacctacgttgacacatcattattacccagtgtctgtagtttacactaggtttcattcttagtgttgtacattctatgggttttgacaaatgcatagtgacacgtatccactgttacagtatgatacacaataccttcactgccctaaaaatcctctgtactctatctattcaacattccctcccacttgtccctggcaatcaccaatccctttactctttccattgttttgtctttttcataatgtcatataattggagttatatggtacctagccttttcagattgccttctctcacttaatacacatttaagttttcttcgtggcttttcatggcttgatagcttatttttttgaaagctgatgaatattccattgtctggatattccacagttcatttatctaattacccactgaagaacatattgcttgcttccaaggtttgccaattatgaataaagttgctataaacagtcatgtgcaggttttatgtggatataagtttttaactcatttaggtaaatatcaagggacacaactactggattggatagtaagagcatgttcagttttgtgagaaaccaccaaattgtcttccaaagtggcagtgccattttgcattgccaccagcaatgaatgagagcccctgttgctccacatccatggcagcatttggtgttatcagtgttttggattttggccattctaataagtatgcagctgtatctcactattgttttaatttgcaatttcctaatgacatattttgtggaggatctttttatatacttgccatctttgtatcttctttggtgaggtatctgttcaggtcttctcttcttctcccttcctccctccctccctccctccctcccttccttccttcctttctctctctctctctttctctctccctctctttctttttctcttcctttttttttttttaaagagatgcaggtctcattttgtcacccaggctgtagggtagtgatcatatttcactgctgcctcaaattcctgggttcaagcaatcctcccacctcagcctcccgagtagctgggactacaagtgcatgccaccatactggctaaaattctttttttgtagagatgagatctcatcatccttcccaggctggtcttaaactcctgggctcaagtgatccttctgcctcagcttcccacagtgctgggattacaggtgtgaaccaccatgcccagctttcatttttttttttttttttttgagacagagcctcactctgtagcccaggctggagtgcagtggtccaatcttggctcactgcaacctccgcctcccgagttcaagcagttccccctgcctcagcttcccaagtagctgggattacaggtgcccaccaccatgcctggctaatttttgtatttttagtagagatggggtttcaccatgttggccagactggtctcgaactcctgacctcagtttatctgctcccttggcctcccaaaatgctgggattacaggcatgagccaccacgcccggctcagccttcattttttaaattgggtggtttgttttcttattgttgagtttaaaagttctttgcatattttggataagtcctttaccaggtgtgatttgccatttaaaattcatgaaatgtgttggagtaacttttttatatgtttactggccatttatggctcttttttgtgaagtgcacattttcttgcaattggcattagctgaatccactgctaagacttctccccacttgggctttcatgcatagcataatggtatacacaatgcttcgtcggaatttacctgacttagaaagaacatgcctgcccaccttccacaagaagctgtacatctgactgtaatggagcgctcctcactctcctcaatgcagagcagaaatagtcacagcagagtggtagataaacttatagtaaatgtgtccaatttaaatgttaccatcatcagcaggaaacatactacacagccattggctggatttcaagtgactgtgtgggtctttgatttcaggaagttcgtgaatgctaatcaagggctaaataaagtggaaagcagcatccttgaaaatcatcgctctcaggacggggtctgcctggaatagcactgaatgtgtttagtagtgcctttggcttgggggctttggagaaagctgcttgagcccttcccatgctcataaattaggtaaggagcagtgaggaagtgtctacagcaacctcagccaatgtgatgtgcctctacagctgtatgaagtagattctctgattttatcttgaaatccacaacttccacaaaaaagaaaaatcttttaccatttctcattaaaaaagtaatataagtttattgtagggggaaataatcaaatgtaatctcattacccagatataatcactgttaacttcttcattcgaattttccctaggtccatgtatctatatatctatggttcataaaaatgagattacaccaaaaaatatcttttgttatctatatagttccagcttaataaatatacaactgtattattatttttgtctgaatagtattttcattgatatatcacaatatatttactccaattccctattgcatatagattatttctaatttttctattaataatactaagggagcttttaagtcaatacatctgaatcttgaataaaattcttgttccttctctttggatgggtattcagactcttaattttacaaatgaagaaataaagtcccagaaggtaacagagatagaactaggcacgattttctattcttctttccttcctttctttgtgagagttaacgattatttaaaagtattcataattttctgataataaaagtaagacatggcattatgacactggatattcaaaaaccacgatgtccttttacttgaagattttaaaaggaaatgattacaataaatacccagagtcaacaatta

SEQ ID NO: 691 - DNA, 43749 bp, Homo sapiens
gcaggcgcgcgcccaacggctttgcgaggctcactcggtctgagaggtcggaggctgcgagtgtcgctgctgaaggctgtggtggaccgggctggatcgcggattgtggagtagattatagatttgaaatagcggagttggggttggatcggggctttggggttggataggggatttggggctgggtcggccggggtcggggaggggggtggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagaactggacgccctggacaagcagcacaggtagcgggggctcagcccggggtgggagggggcccccaggcccggcttccccgcagaccctgggacggggccgtgcagggcgccgggcaccctcggagcggcggagccaaacggactctcagctgttttccatccctcataattccctggctggagcagttggagaatttgagtgatttaactcacaaagttaagcatatacagcgttgttatttttaacgtacacgtttaaaatatggtttatatacattataggaggtgcctaatgagagtacttgttcccctatcaaaaataaccgtgagttgtttcagtgggcgaaaagttctcagataagagagcttacttgaaaaatatttactatattatatatatatatatattttcagatgaaaagtatgttttcattttatagggaattcattatattcttttttttttttttgagtcggagtctcgcttctttgcccaggctggtgtccaatggcacaatcttggctcactgcaacctctgcctgccgggttcaagcaattttcctacctcagcctcccaagtagctgggattgcaggcaggtgccagcatgcctggctaatttttgtatagtttcaccacgttggccaggctggtctcgaactcctgacctcaagtcatctgcccgcctccgcctcccaaagcgctgggattacaggtgtgagccaccgcgcctggcctatgttgtttattatatatcataagatatatatatattactgatatgtatacatatataacacatataatatgttatatatatcagttatatatacacattagatgaaaagtacctcttcattttacaggaaattctttcaaatcaaatcatcaaacactctaaaagtgggcaaagtacctttttccagatctacaagttacttatatacataggaaaaaatccttcgcatttctggtataagaatttaaactaaaagaggaatgaaacagttttctatccacaatatttgtgaggatgttttatactgctgcttaaagttgctgattacttttcaaagtactcatttgaaaatggtaagtactacatttaaaaaatgtgtatgccctttacccaccaattccattatactaaaatacccttaggaaataaagatacatgcactttatttttcacagtacttactttaaagagaacccatagaatggatcctataaataaatttcagttgcatccataggatggaataatatgtgaccactgaaggtggcagtagatacagaagtacgttgatgtgcaaagatgtattttgttatagctagcaaggagaaaaaattagttaaattatacatacacaaacatactatggtcttgttttagcaaaaatatgtacaaaatataaaatttgtaatttctgagcatttgtattttaagtaaagtttttttcctttttcttatctgtgattgctgcagtgagtacaaaacttctagtaaaagtttattattaatggactaatccttgggaagagaggaatatgaatcttgcgctgatgaaaataatttctcactttctattttttgtcattattgtgtgtgttgttatcttctttgagcttttagcctcttcagaagtaaaaaaggaatgtttttatctgtttccagattttattatctatatattttattatgtacatatgttttgcttatatactcattccatttatgcaaacataatcatttcattttaattgtgttctttaaaaataaaacaacacatataaataattactattgcaaaaatattgctttataggagtttatttaaaaataatgaactccccaactgtatttatccattctttcattccatttatggatcaagcataacctgagtacctgctatgtagcagacatattctatcatctctcaggacccgtccatccttaaacacttcatgtttacctgccctgcctgcacaagctgagagatttaaaataggaatattgggacttaatctccttgaaactttatctcccacctttcaaacaaaagcatttctgaagttagaaaatagtagaagataacctttaactgctctttcgaaagtttatcagtcttaaatactaatattaatcattggaaagtcttatttgcatatattttctaagtataaatattgaatacaatgagccatatgtattcatttgaatcatgagtttcctttggtttcaagttgtttgaaaatcaaagaattaatttgtttaaaaaatgcattattgttatttcagtgctctttccccatagtacctttaagaactaaaatgtatttaagtttcagttacatgcctagaactgccctagacctgctgagtataccatattctacttaatgtaaggtctcatggattgcgtgatgccccgatattttatatatcaataagataatttttaaaatgctaccaattatagttataacaaatcatgaattataagtggcattccaatgtcagaggtgttaaaatgtgacctactcgttaagtcatcttgcaaagtaggtataattgtatcattctacctaattaaaatggttttgttaagtagtagtaatagtaataattataatatctggctgggtgcagtggctcacacctgtaatcccagaactttgggaggctggggtgagaggattgcttgatgccaggagtttgagaccagcctgggcaacaaagtgagattcttactctacaaaaatttttaaataaatagctgggcatgctggtgctcatctgtagtcccagctactcaggaggctggggatggaggatcatttgacccaggagttccaggtatagttacaccattgcactccagcctgggcaaaagagtgagactttgtctcaaaaaacaaaaatcttacaattattgagttgtcgtaggaactgttctacatactttacatagcttctcatttaagcatcacgatggtgtcctatgagatagctactattgtcatctttattaatgaggaagttgaggtacagaaaggctaagcaatagttggtaagtgtcaaggcttaaagtaggactcaagccctagttgaaccgaatccaaagactgagctctttctactcaaataggctgctgttttcattaaggcagtgagcaataagagctagtaagtattgtactttcttcaaaaaatttatttgttttgaaggcagaggaaaaacatgctattcagtttttacattacatgaatgattgtatgttttgagatattgtactacagtttcttaaaaaatcctcttactctcatagaactgctctacacttggcctgtgccagtggccatgtgcaagtggtcactctcctggttaacagaaaatgccagattgatgtctgtgacaaagaaaacagaacgcctttgatacaggtatattagagccaactcttttagcatgacatggatttgatttacatatatagaattaaaataaattgatctcatttacatataactagttggtgaaacctgtggaatgtgtattttgaattcttggaatttacagtctgtttcttggtctaacacggacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggtataggtcaatcaactttctttccaaaatatttgttttaacattgacataggtaagggtcaattttttatatttggaagctcaaccattccctgaatgcaaatacaaattaagttattttgaaataacttaattgtctaagattttattttaaatattgatatttttaaagaagcattaaagggcacagctttataaaatgcactttggaaaatatttgtgaatttgttaaaggtaaaaccttttcaactttttttctacacaggcttattcttttttttttttttttttcttaattaatgtaaaacaacacaggaaagaaaatattccccggaattaggctttatcttaaaactcaaacaaaactaaagcaacttacaataaagggacatgttgctgttgctgctaattttctgaaaaactgatgtatcatctttcagtggcaaggcttaagagggaaaaatgggaggggagaaagagagcaatcagaaatatgcaggtcacttggatattagataatgagggaaaatgccaggaagactttttttttgttttaaagtttgttttatgtgttgagacaaggtgctgtttagctttgggtctaataatttttggtttgaaaaagaatgaattgcaacttgcctagagatgaattttaggaggactctgaggaaaccagattggcagtgaatatgtggtgacgaagtgagaaacacttcagcagaaggtggaacaaattattaactgacttattgctcatcctggcagaaacagccacttagataagaacctaaagcctcctctcaaatctagaatgtcttagtgggaaggtgggagataaggagcttgtaaatagcaaaatcaagtgggattttgagtttacttgtccctgttctacccatagccaggaaacttaactggagttttaataaatgacactatctcttactcttttctctttttggccacatctccaactgataaaggaattagccatgtgggtgagaggtgagactgaagtgattgtctgctgcactgattctcagaattgtgcattacagtgacctgaggacattttgttaaaaatctacaattgtaggctttcccctgaagattttgatgtaatagacctattaaggcctgaacgtgtttaaaaatgttttcttgaagctgggcacagtggtgtattcctgtagtcccagcttgagcctaagagtttgaatccagcttgagcaacatagtgagactcttgtctctaacaacaataatagccaaaaaaaaaaacccacaaaaaaacaaaaaaccttcaaggttgggatacactcttgattaaaaaccccagaatagataagtgcaatatataaatttctgtatctcaaaaatgtaagaaatctctagaagagttggcatttgatagttgccacttccttcagagttctccttttcaattatattagcctgacttatctgtctttctctacatctgtgactgggaagtgaaaggaaatatcattggcaatatctctcagcttacagaataacatgttttgcttcccaccatgaatcattcactaccattcagagagtcttcagaaatttgcttatgagtaatctttcaataggtagaggctgaccctttcatgatttcatgtccctttgtcaccacgcaggtgattatgtgtcaacaaatgttcattacaagtttggctttctcaattagaatagcaaatcctaaactattttttttagttgaagttttattatgaactatctcagtatgtttgttaagtttatagaactttagcatacccaaaatgtcagttttaaacactgaaatccatgaagttaataagaatatagataggaattcttttaataatttagttttagcagtcttgtgaaccaattatctatttggttaataatctgggaaaattatatacaaacatattttaaatgaatacatgttggaaaaattcttgaagcaggtattgtgagtctttttagcaatttttattatatatgagagcctgattttttggtagaacatatgataccagagaaagaaaatattttacatgcaaatacttggattatacacaaccatttagtaacacattaatagcgaatataaaaaaaacaagggctatattctaatgtggtacacagatttgtttgtttgcctctataagttgaatcaacatgtaaaatttagaagactcgtgaagaaatgtggacttcaggcatatcctaaaaagtcaaatctggtgtcccctgagtttctatcattctttggtctgctgtgcagaagttgcccctttatagaaggcaggtattctccagtttgctactgtgcccaccttagtacttcccttactcaggcaaccttcctttgtccttgtaagtatctgagtttacaactcctatgttatagtatattttgataaaaatttcaaggtttttaagtcagcatgtatttgtttataatatatagtctatagagtatataaatccctcagttatggagttgaattttagagtttagaagtttttaactcttttctttatatataccacaaataattctctgcccataagaatgcctagaagcctttttaggttattcctggttatagttggataatttatgaatattgcagacagtacatctttctcctcagtgctcttccttaaggatgcaagtgacttattggcttgtattatgccagaaataatccatatggatcagtatgagaacttctattgataagccattatgtttttatttccgatttatattttgtctaaaataaaaaataattttaagtagccatttaagtggaagccagtaaaaatggatttaaaaagtagagctgcactagggtcccgggattaccattataattgagaatagtatttcttactgagttttggtttttaaaatatttcctcttaagttttttaaacctatctctcttacacagaatatactgagctttctaacagtaaagataaaaatctcttctcttgtattaggggaaaaacccatggactatttaataataaggaaaataaatgcatttgaagccaatctgtcttaattcaaagctcatttccatggtgacccatttggagcaggagtgcctgacattggcatctgggatcctgacaccattgatagaagtgaatcaagcaagtttgtaccacccagagggaactgccacctgtattgggaagctctggcaactgtatctctgaaactcttaattcctcaaatgttaatgtttgccacaaatagtattgtgaaaggggattaggtgaaattaaagagatttcttgattattggacataaaatacagttttgtaatacttctcaaatacagatggtcatggagtctttctcttgcggtataatacttctgataaagcaaatattctttggaatatagtttaagagacactgctttagagatagtaatttagatcattaattaatgtaaaaaacttaaaatatttgctactgtgtcttagggttttaggcccttgcctcaagaagctcttggtttcagtgggaaacagtgaaatgactacaatgtaccatgataagtgctgtgatcaaagcaaggattcttgggactagtaaatgtttaaagtgagttttggcaatgaccacagttaatccggggagacagaggagggttgtttgcaaggcaaagcacagcatatcagaaagcacagaggagtgagaatgaagggactgcttttcatttacttcctttctgtattgtatgttgaagttcaaagcatcctagagaagattttcagttcagttgagaaatatgtaattttgtgaattattaatttttttctgctgttttataggacaataataccccacttttatttgctataatttgcaagaaagagaaaatggtggaatttttattgaaaaagaaagcaagttcacatgccgttgataggctgagacggtacagtagttctttttttaaaaataaaacctgagtattctagagtggtcactcaagtcagaaatattaataagaagattaacataattattggcatataatgaaaaatatcaccatgaataatcaggtagaccagccaatatttggactgagtaacataaagaatagtatatagtaggattcatcttctcttataatatacagagtttggtatttataatcagatgtttttggtactgtaatcttttattagctaaagggttttgtattagttttattaattttttttttttttgagatggagtcttgctctgttgccaggctggagtgcagtggtgtgatctcagctcactgcattctccacctcccaggttcaagcgattctcctgcctcggcctcccaagtagctgggactacaggtgcacgccaccatgcccagctaatttttgtatttttagtagagatgggatttcaccatgttggccaggatggtcttgatctcttgacctcgtgatctgctctccttggcttcccaaagtgctgggattacaggcatgagacactgcacctgacaagttttattcatttttaaagtgtggacttttagtttatgactactagcattgtcattattattgttgttgttgttgttgttttcagcctgcagataactcttatctgacccctagctgatttgactaggaaagcaacggggaaatcttcatctaaatctttgcctactttagataagtgacctcagcacagtttcttggccatcaaaggactataagttagcaacttgtattatgtcttaccccagtgggacaagaggcttccctgttgtccctttcttttagccttggtgacaatttacaaagatgaacacttgagcaccctagatgcttatagacccaagctagtacatgcaaatggttattacatctatactgacaggcggatattaaactggtaaagtgtatcaaactagctttttaaaaaagtctttattaaagttcttgagtggagttatttctttgttgttttaggtcagctctcatgcttgctgtatactatgactcaccaggtattgtcaatatccttcttaagcaaaatattgatgtcttcgctcaagacatgtgtggacgagatgcagaagattatgctatttctcatcatttgacaaagtaagtgtttatgttaaaaggccagttaatgctaaattgaagtttaaaataattgcaactactccatcttatacattaggtgagagttcatagtttggttcagatagtttgaaatagcgaagagttagtctaccttttagccagaaatcaagcagaagtctagattagttagaagtagagtgcgagattttttctggatttttgagacatttatccctagggatctcaatgttattcattttattctaagtataatccccatgcatgggataaaaagagccatgtctttgatttcttttcctttcctttcctttttttttttttttttttgtagagacaaggtctcactctgttgccctggctggtcttgaacttttgaggtcaagtaatccccctgcctcggcctctgaaagtgctagccaccatgcctggcctgacttttctaattagttattgagtcttgtaatgtccagtttaacagaaaatcttgtattgtcccctggggctctctcctgtgtcttccttctttgaattttccaagaagctaaggggtttcctaagtccaaggaaggcaatctttctttacaagtcagaagaaggggaaaaaaggccattctaatcattctgttgtttccatggactcacttgctgtattattgccattataaccggtcctgcaatctgataatgattgacctttgccaccaggatgccttcactgattcagacccctcagttttcatggtgattcatatatagaggtcaaagctacggtgtttattagtttatgtacttgtgctcagtcattgttcccagcaccctgctctggcagctaggcctcctagctttatccacacaaatattgagcaagttgatgctcaccctacactaaaaaccttatttggagcccacgtcttagctagactttgcctaggccttcatggtatgttatcctttgagagccatgtttgtctttcctttaaccaatattagttgggattgttctcaatagtcagggatgttcaaataatgttgcaggaagagatcagagttccctgtctcttttgctatcagatctgtaccttgaggcttttttatatcctgtgcagcagctttggttagatagcggaatgttccatgttatctttccactgagtagtgggaaccagcttgcagttggcccctcaagtaatgtgtctctataatcatgaaaatctcctgggctacttgcagctcttcctcaagttttcaatatattttaaaattctacctcacaggaagccattcaataaaattctctgaatctgaagtaagtgagttggatttaatagagctaagcctcatccatgactcatgaatatccatgtatcaaacagggctttgtacttatttcaacagcacatattttaaaattggatcaatacagagcagataagcatggctactgcctagggatggcacacaaattcagaaaacattccatattttgcctagtcccaggaaggccatttgactatttgttgagtagctccaaggaagcagtgtgagcaaaaccaaaacaggtgacacacaatattgaaattgtgattattgctatgaaactattgatgtatggtgatctctgaaatgggaacagagctgagtaataaggggatgttacatgttgttagtacatgtcttggaaatgagaaaatgtcaacttgtatttccttcatggaactgaaaaacaatcaaagcagggttttgtcttgtctgttagttggagaggaccatggagatccagcagccaagcacagatctgctggctcagagtttgaggaggtagagaaggagtggtagttgtccaagccaggttttgacacctattagttttctgcccttggtgtgattgatgagctcagtgatgagctcactaaatttatatatatagaaatttagtaataagttatgaattaggtaaaatgccctgaattacaagccacaatgaatacaagtaataaccaaaattagcacttaataacattttctgaaaactgcaacatttgagtattagaacttacagaaaaacacacaccgagcattatttgggattccaaaatggtttcagcaataaagttcaagaataaattattccattgctttactatttctctgaacatataaacatgtaatctcattacatcttccaaacaacctagtgaagtaaggtagcagaatccttgttttttagaagaaaccatggagcctaagagaagcaacttgtctgaagacaaaatacctacagagcgaggtattttggttacagagcaaggacttactctgagtgcaggacactttgcatgatatccagctaactagagttcatttactgagctgtgcttcctccatttatgagtacttcactttcttttcttctttaattataagcttaataagcttgtaaggtttacaaatttgaagtgtatgggacattaaaattctgagattaggtctgatattgcttgaaagtgttttggaatttaatatgtttggtgaatattttttatttcattataaaaatggcaattttatttattacttttgtatacatagaattcaacaacaaattttggaacataaaaagaagatacttaaaaaggagaaatcaggtaagacttctgattgtgaatttcttacttgtcttggtggtcctactcttgataagaaaatacaaagtaagatgtaagattaaggtagtttcagtcaaaaaagaccagtttaaaaatatgtgtaaattgaatgtgtatatatgtatatacatatgtaaattaatttttaaaatttaacttctttagtttgaaattcagatttatttaagaaggtagttgtagctaatttacaatctcaaacattattgtctgaaaacattcatttatttaattatgatccctaaaatcctatataatatttttgcataaataagaaaaaagatttttaagttagtatgttgtatgtttcctctatagtcacattataacaaattggacttgttatacaaatggatcttcaatttcatttttataataaattgtttatatttagtaaacaaataactacagttgacccatgaataatgtgggggtgagggactctgatccctgtgcagttgaaaatctgagtataacttttgattccttcaccttagctactaatagcccacaattgactggaagccttcctgataacataaacagttgatgaacacctattttgtttgtgctgcattattatatactgttcgtacaataaaataagctagagaaatgaagctgttagaaaggaaatcatcaggagaaacatattgacttttcataaagcataagtagtcctgacaaaggtcttcatgatcttcaggttgattaggctgaggaggaagaggagaggtggatcttgctgtctctctgttgcagaggcagaagaaaatctgcatataagtgaatccctgcagttgaaacccttgctgttcaagggtgaactgtattacatattgatttgtgtcactaagaaagtaactatctttagaaccaggaactcagcaatccctttctggtaccataaataaatggcaataagaactgtagaactgaaccagtgtgcacccatacaaataggagattattttttgaagacagctactgagcacaggagacggaaaagcaattcctttgtgagaagcacaagttatattacatattcgtacacaagcaaaatgattttatctgtcatagtttacatacatacacatacacacgtgcacatgtgcacacacctgtgcacacagacacaaagttaaaagtcctgctgattcttaatgaccaaatccaactgttcacagagagcggtggataacgcatcctactgtttggatgcaattcttttgactttttgacttgttttgtgatgaactgcctttaatgggtttaaatcatgttttcagttttatgagaaatgaagaaaaagattagaagcaagtaaacaggaactctatggtcagtagtagactataatagtatattcaatagtcatatgtttttctccagttacacaatttacttgaatgatgcacaattaatcaattattattatcataggagatggggtctctctatgttgcctaggctagaatacagtgtctattcattggtgcaatcatagctcactgtagccttgaactcctgggctcaagcagtcctcctacttcatcctcctgagtagctgggactacagttttgtgtggttacatctggcctgatacacaattatttatttgtttatttatttttaatacagggtctccctctgttgtcagtactggtgtgcagtggtgccatcttggctcactgcaacttctgcttgctggccttaaatgatcctttcaccttagcctcccaagtagcttggactacaggcatgcactaccacacttggctaattttctttttaagggatttttgtttgtttgtttgtttaatagatgaggtctcactatattgccgaggccggtctggaacttccgggctcaagtgatcctcctgcctcaacctcccaaaatgctcagatttacaagtgtgagccactgcacctggccttcaaaattattataaaaaggaatgaagcccagttgagttgcagaaaattgaccactttttcattttttttctagaaacattcatattgtagaacatattgtcaatcacccagattctctattttttattcagataaaagaggattgctgctcatttcacattattttctgacattattttttcatttattccttctatggctttattcaattggatagatatagaaatacaagaatctccaagtcaaatatcaagacaaaaaaagaaaagaaaaacagattaggtaaagttattctgtgaaataaccatctgattacagttacacgtatcatatcaacttaatacaaatcttacacaatgaatttgtgtcaaggtttcccaagaccaccccaggtttggtggttcattagaaggactcacaggactcaacaaatagtcatactcagatctttaattgataacaaggaaggggacaagcaaaattagtagaggaaaaaggtgcatgtggtcaattctggaggaaacaaggcacaagcctccaggagttctgtcctgtggagttcccgggatctgcttaattctcccaggctcacattttgacaacatatgtgcagtgatgtctaccagtaccagagtttcattagagactaagtgcccaagtttttctatggaggttactctccctcacatgtacccaaattccagactcttacaaggaaagcagctgtttagagtaaatacactgtttctataagcactttagacacagtgagccactcttctcagggaatggtggaaaccctcccatttccaatttcctaaacaccagccaagggccagccttgcatgcaggcctttctaaggatggcagcctcttgcctgctatatgaaatcttttctgcacaacacttgtaaccccaacttaatttttggtgttgttttaaaatttcattttaataacataatattataagataaggtaacttggtactaatttctgttgtatgatccatcttaagttgcagtgcttgttacttttttgacttttggtgatgaacagctatttgtatataagttaccatagcaatgttaggtaattataatctgtcctatttatctcattaacctttcagtaaaattgttaaattaaataagcaaaataatttctgagttaacattagaataaaaattgtcttttattttgattacatgaatagtctagttttcatattgtgttaaatccctgtttagaattatgaaataagataaaatattcaattatttttatcaatattttcttatctaagcatgcaattaaatttatttattttatatattttatatagttcaatttgagaagtaatgaccacatgttgttactttggtcttcaatgatctctaatttttagggtcaccgtgtcttgcttaaatatatcatagtaacaggttcagtgaatatctttattttttattttatttacttatttttttgagacggagttttgctcttgttgcccaggctgcagtacaatgacataatcttggctcattgcaacttccacctcccagtttcaaatgattctcctgcctcagcctcctaggtacctggaactacaggcatgcacaatcatgcctggctaattttttgtatttagtagagatggggtttcaccatgttagtcaggctggtctcgaactcctgacctcaggtgatccacctacctcggcctctcaaagtgctgggattacaggcatgagccactgcccccagccatttatttatttatttatttatttatttatttattgtaattgttctggagatcctgggatgcatagacagtgaatatctttttgttttttgagatggagtctcactctgtctcccaggctgcagtgcagtggtgcgatctcagttaactgcaacctccaccttctaggctcaagcgattctcctgcctcagcctcctgagtagctgaaattacaggtgccagccaccatgcccagctaatttttgtatttttattagagacgaggttttgccatgttggccaggccggtcttgaactcctgacctcaggtgatccacccatctttgcctcccaaagtgctgagatgacaggcatgagccactgagcccagctgaatatctttttttaaatcaataaccttatttcttagagcagttttaggttcacagcaaaattgagaggaaggtacagagatttctcatatatcccatgcctcccacacatgcatagcctcccccattattactattttccaccagagagtggtacatttgttacaactgatgaacttacattgacacattataatcattcaaagttcatagtttacatcaggcttcactcttgatgctgtacgttctgtgaatttggacaagtgtataatgacatgacatgtatctattactgtaatattatcgacagaacagtttcacagcccgaaaaattctctgtgctatgcctgttcatctttccctttctccctagtaactcgtggcaaccattgatgtttactctgtcttcatagttttacttttttcagaagagtcacatagttggaataatacagtggatatctttttgaatagttaaaaaattaaagctccatggcagttgaatgtagtcatttaagatgttctttgtccttttgtttttcttttgcttctttatcattgtaaagaatgatatattctgatgacatatgctttacatacttagaaaacatgatttgtatagatatgtggcacataatagaaagggttgaggaaaaggacaccatgctgtaccacacagcacaaactggagcatcttgctctgtgaggtgggtccagatagattctctagcaatggaaggggacaagtgcaaggggttgtactttataaaactggaatcacaaagtctttcatacttaccttcggttggaaataagaccagacagtgaatgctataggtaagtacataggttcctcactgatcctcttcctttgagggatgaggttgacaacagcctgtattatgatgatgtgactcacctacaactagattctgtcatgagggatagcaagagagttttgctttctgtgaggtgaaaaagaatttttttcccctactagggagaagggcaagcactggaacattccggtagtaaaagggcattgatggttttctttctatatatttttcacatcatatagtactgtccagcagcctgccacacctccctggtgtttcttcagcttctctgaatgtgaggtgtggttcctagcgtataagctcttaaaggagtgatctttccagtggtttttctgtgggaggtaaaatggcaggtgaatttgggccttgctatatgtagggcagagcaaatagctacaactaagtaaaccacccagcaccttccccaaagagtagtagccagagtaatacattgatctcttttgagctcttttccactagcggctggaaagtctttgcaaggattcctgtttctggtctgattcctatgttttgctgacatctggtgttagggtgttttattctaaactgagcagtttgaactgaagagctagagaggctgtgttgtgttataacaaaataagtgcagtagctcccccttaactgtgggagatacattccaagacccccaagtggatgcatgaaaccatgaatagtactgaatcacaaactgtttttccctatacatacatatgtatgctaaagtttaatttataaattaaattgaatctgatgttaccagcagataaggtgtgagaattgaattgtgtcatcagcaggaatgattgcttgcttgttggtggggaaaaaccctccacacatttggtcacagaagccttctttgttgatgattgttgctgtggtgtgacagcagagaaaaatgtgtcaagtatgtctttctgcacgtatagtggataaggggtactactgtgtactctgttttaatggcgcctcatattttggtccagaaatcatgctctttgacactgttgactcatcacacctgttctgctaacaataccatttttactcaacctcatagggtttggctaagatgacttgcatactgcagttcacttgtagataccaaattttaataaatttattcttctttgcatctaataaatacaaagggaagagttcttactgcattaattacctaccaatatgtataacgaatgttaattctaataaggtcccaggcatgctcccaaaggaatgctttgtaacaaagcatcagtcttatgctttaaaaaaccaaaccaaaccaaaacaaaaacaacaacaacaacaaacaggatctaaagcatacatacaagtgtgcacaatttttttatgaaggtagagtcttactatgtttcccaagctggtctcaaacttctgggctcctcaagtgatcctcctgcctcagcctcccaagtagtttggattagagggatgcatcactgtgcattcttatgcttttaatattctgtacatttgttattgatttaaaatgcattttacctttttctttaatagatgttggaagttctgatgaatctgcagtcaggtaggattttatagatttaaaaaattatgttaactaagaaaatatagatggaagaaatgagtatctgttgagtgttgtattctgggctagacatcctaatatgttctatgcatatatcatctcataaagccatcacaacatctgtgttcctataacctactgtttattaaataaacaactatggattagagctgattaattgcctcatgatcccatagttaacaaagtagctggcctacagtttgaccatcagcctgcctgccttccaaatcctgtctcttgctcctcagcatagattgacagatatctgtgcagcccttggatcaaggtataggtctgaatcagattagtcagattgattaatttgattaatgtctaaattaatgagagtttaaataccttgaactctcatttaagtttatcattagaatgtggttagtccaagagtttgtcctaataaatttgacaatttcagtggtaaccagtatcttatttttaccatcaaaggctctagggcagatcttacttagctttgccataggggtgtaagttttacaaaagcaagtttaggcaagtcttagagacaaattatttgacttcccagtttggttttccatttaggcaagtatttctgcttacttccataatacattttttagtcttgttgctttttccgtgacttttctataatcttgccttcattttttaaaactttcttctctgcttttcttggtatttcttttgttctattattttttcaaactctgctggctatgtattctaagtttttctatagacagaatcaagaggacatagaattacagaattttaaggaatcttggaatgaattaaaataccttctagtatttttacctgtgttgaacattctggtcaaatgattctctagatagagaatgtgaggctcaaagagtttaggatgcttttttttagacataggaattggcagaaatgagatttgaactcatgttaaagcccagtactcttgcttctttttatatcctattggcgtgtgttttaataatacaaacgggagtgagtctgtgggtagaatgagaatggaattagccggggaacccaatggaagtagataagaatggaatgagcaggggaagtccaagtttgaagataaacaacactggattggataggagtacagactcttctataagagatcaaaatattggggtttatgacaagtttgataaagataaattataaaaatgaaggacacaagatgttgggaattatctacgaaggcacattaaaatagaaggttcaagggagctctaaaaagtttgctgcttttttttaaatcaaggactgacaaacttgaagatttttactgaaagatgctaaaacattttgagacactgggaggagcgtctgcagcagatagaaatgtggtgtcatctgcttccatcctgacttagaaaggggtggcttagagcccctggagtactaaggggctggagattgctgaactacatagatctgtggcccagtacaggtgtctcctcacctctgcctcttttcccgattcactgatgtccttcccatgtccatgtgggctgggtcaggggcatgattggctggcaaatcagtcatggagttcagttgggtagttggtagtgtgtctagctgggggcaggtgatggagactccagttagcttgtttttcaggagcagggatatagagagctcctagtcctggtcatttgaggccatcctttcaggaatctgtgctttcatagactgaagatttaaagattggagacttctgtggagccctgcagaagtggaatctggaagtgggagcccataggaagacagatacttagagagtacttagggaaatagaggtacacctaccaggactctgtttttttctgacagtctctctccttgggtgtctgagtgcctatgaaaagttttaagggcttgctagtttatgtggacctgaataaggtaggacctataggttgaaaataatgggattttataattgttaatatttcaatctttctgggaaaagtattctcaataagaacatacacctttgttatttgacttctgtacatttagctttcatacatttcaaatattgtaggggctttcctgtactgatttagggcaaaggaaagcaataggaccttcctaagtgggttccatgctgaggaatcaagactgtcatattgaagtgatgcagattagtcttttatccagagacagatcatggaaaagagacagtggatctttctaccttgttttaggttattagttttcttccagtttaggtaacaaaatttatgtcatccattaattgaattttaagttcagcttcaggacagataatttgtgagggcaaatcattgtcaggctctgccaatttattgactgtcactatttgttataaagctcaaggttagttttcattgaatattttatagatttagacaagtggaggcagaaataggtaactaaaatctatttttagaagaggacatattttaattatatcaagaatcactaatatatagattgctgacctttccctagattatggtttctttttttgagggggaagctggatataaactggcagttaaaaaaattgtaaagaaatcaacttgctcattttcgttgtgtgtttttgctctcaagcattttccatgaactgcgtgtggattcattgcctgcatcggatgacaaagacttgaatgttgctactaaggtaaagtggtctcttgtaaaattaattttctcactctgaatgtacttttgcgtagtatttacttttcaaatttagcagtggtttacctatcattgttttatggtggtaatggaaagttggtcagagaaaaacatacatatggctagttgattcaaaaaatgtgtttaactttggtaactaacaaagattgataagtactgtgacagggtgggagctgaaaaaaaatgaactggaaaattagtagtgacaggaaaatcacattaggaaatgctttctccaatagaggaaatatgaaatttgcttaaggtttatttggataaatactaatactttgacttttaaatcatacgagtgtgactttcttaatatttatgcctgtataaatcttcagtggatcaaattatttgcagtaatcatgggatcctcctggtgatttttagtggcaagaatattcagcacatagcatatagcttttgttcttggaaacttattattttggtatcatattgtttttacgagagattgtttttctacttatattattggttctgtagtgagacaaaaaaaataaaaattgtagaaaaataactgagtgtggtggtgtacacctgtagtccctgctacttgggaatttgaggcaggaagattgcttgaacccaggagtttgagaacagcctgggcaacatcgtatctgatttaaaaatataaattgtggaaatatagaaatttaaatttatgttctcaaaatgtgtattgcaaaggaatttttgtgtggtttatgagttgtccatgaagagtttatataaggcacttcatctaattgaataacatgtattttgctgcaaataaccagttctagaagcagagactcttaataccaatggatggtaagactttatcatcataattttgtcattgtagtttatttaaaatatttacttcaccaggcgtggagactcacctgtaatcccagcagttttggaggccgaggtcggtagatcacctgaggtcaggagttcaagatcagcctggccaacgtggtgaaaccctgtctctaaaaaaaaccaaaaccaaaacaaaacaaaacaaaacaaaacaaaagcagaaaaattaaccaggcgtgatggtgcatgcctgtaatcccagctgctcaggaggccaaggtgggagaatcgcttgaacccgggaggcggaggttgcagtgagccaagatcgcaccattgcactccagcctgggtgacagagcaagactacatcttaaaaaataaaatagccactcaaagtcctcatatcatattctgaaattttgaatttcagaaggttttctatttagttgtttaaataatcattggaagctcctgcataccgtaagctactggaggtcagtaaacatatttgtgtgtatcctggagtacctagaatacagtcttccatgtaagaagcattctagttgttgttttttgagatggggtttcactctgtcccccaggctggagggcactggtgagatcttggctcactccaatctccatttcctgggctcaggtgatcctcacacctcagccatccaagtagtttaaacaatagagctatgtcaccatagacctgtgtcaccatgctcagctgagttttgtagagacagggttttgccttgttgcccaggctggtctttaactgttgggctcaagtgttctgcctgcctcagcctctcaaagtgctgggttacaggcataagacattcagccttaatagttgtttaatctgaataaatagacaaatgaatttttatataatggaatgttataagtaatataataaacctaatgtatctaataattaaatattgtatttaaaatattgcttacattgtattttttaatatttaagggtgtataagttttgatatgttatgttgagaaattatgccataattaaaaaggaaataaaatagaaataggtcatcagtagcaaatagggttacaatatattttctagtatcattcaactggaatcttaacattgagattttagattaacatttcttaagctttttattagctctaactcatgttctattaaatatatgttttcaagccatacattactctttattattcttatactgtaagttctagggtacatgtgcacaatgtgtgggtttgttacatgtgtatacacgtgccatgttggtgtgctgcacccattaactcatcatttacattaggtatatctcctaatgctatccctccccccttgtccgccccacgacaggccccagtgtgtgatgttccccatcctgtgtccaagtgttctcattgttcaatttccacctatgagtgagaacatgcagtgtttggttttttgtccttgcgatagtttgctcagaatgatggtttccagcttcatccatgtccctacaaaggacatgaactcatccttttttatggctgcatagtattccatggtgtatatgtgccacattgtcttaatccagtctatcattgatggacatttgggttggttccaagtctttgctattgtaaatagtgccgcaataaacatacgtgtgcatgtgtctttatagcagcatgacttataatcctttgggtatatacccagtaatgggatggctgggtcaaatggtatttctagttctagatccttgaggaatcaccatactgtcttcctcaaaggatgaactagtttacagtcccaccaacagtgtaaaagtactcctatttctccacatcctctccagcacctgtgggttcctgactttttaatgatcgtcattgtaactggtgtgagatggtatctcattgtggttttgatttgcatttctctgatggccagtgatgatgagcattttttcatgtgtctgccatacgttactctttagaattctggtgaccaatttttttctgggtggaaagttgattgaaagttctagttttctctctgtgttataataatgttctttcaggtagtggtcgatgaccatatttagctaattgaatgtcttatagtaataaactgtatcacagaagtacttacaaaaaactaattgtagcataaatattaattagtattatcagggatatgaaagagcaaaaggctctgttatagatctatttccccatgtactttattgtacttcatgttgtttcttttctttcttggcttaagctcatatttcattgaccaattaggcttgttttttgtttgtatctctcttcattctcatattttaaattgaaatttttggggagtcagggtcttgctctgttgcccatgctgcagtgtagtggcatgatcttggctcactgcagtatccacctctcaggctcaagtgatcctcccacatcagcttcccaagcagctgggactacaggcgcacaccatcatgcctgactccttttggtattttttgagtagagatgtgttctcattatgttgcccaggctggtctcaaactcctgaactcaagcaatccacccaccttggccttgcaaagggctgagattacaggtgtgagccaccatgcctgggcaacattgagattgatttaaagaaattgattagggctgggtgtggtggtgcacactgcttatctcaacactttggggggcagaagtggaagatttacttgagcccaggagtttgagaccagcctgggcagtataatgaggccttgtctctgcaaagataacaataaaaacattagcatggcatgaagggacgcacctgtagttccagctattcaggaagttgaggtgggaagattgcttgaggtcaggagtttgagacaacagtgagccataatcaggcccctgcattctagccctgggttgacagagtgagacccagtttcataaaaagagattgataagaaactcttgatgcaactcattataattttaaaatggaaactaattcttgatattaccttagcagtgtgtccccgagaaagtgtcagagcctttacctggatcttcgcatgaaaaaggaaacagaatagtcaatggacaaggagaaggtgagaaccgtattttatttaaaaagtcttttgatggaggccgggtgcggtggctcacgcctgtaatcccagcactttgggaggccgaggcgggcggatcacgaggtcaggagatccagaccatcctggataacatggtgaaaccccatctctactaaaaatacaaaaaactagccaggtgttgttgtgggcacctgtagtcccagctactcaggaggctgaggcaggagaatggcttgaacccgggaggcggagcttgcagtgagcggagataccaccactgcattccaccttgggtgacagagcgagactccgtctcagaaaaaacaaaacaaaaaaagtcatttgatggaatgtttctttgaaaatatgagctaaagaaagtgtcctatttctttagctaaaatagctaaagaaagtgtcctattaactgtataataagtaaaggagaagtgaaatggtgataagttgtgtctctaaccaagggtcagcagttgattctattgggagtaccactaaaggagctgagttgtgagttccattttaagatactctaagacctgaggcaagtcaggagagagggaagaggaaatgaataaagagaaagaaagaatgaggagagcggattgtacatggaataaataaaaaagcatatgcagaggtaagtaagagaggatagtaaaggcaaattgatctgtagaagaaggaagaacatggtgttagaaacaggaaagaagataaagtgagcttccagtaccaaaatgtgtcagagaattacagtaacattttccttctcttgctgtcatcctcactactggggaggcattaaggattgaggcacctcaccacacagacctgtgttttatctaccatagatgaacatcaccaaagatggtcagccatgtatggctataatttgtttttatagaaaatgttgtaacctcataggatagtatcatataggccaaattaacataattgaatagtgttgggtgatttatggagaagaaattaattcaagaagttattgcctgattaaaagttcattagaaacattatggcttataatgtagtattaaattgagggacataatagggaagaaattgaggctaggccaaaagggcaattaggggaaaccaatatggaagcacatcagtgtagaacagggcattcaaattgtcatgaatgagttgaagagcttctggaaggtgcacattctgattcagcaggtatgggagtctgcatttctcatgagtactcaggtgatttttggtgctggtccttggacacagctctgaatagcaagggaatagccttcctttagagaactctggaaaaagaaccattggagagcaatttaaaaaataacagaatccagggaaagcattaatttccttttatttctgagcatgattctagccacaggggaaggagaatgagatgaaaacagagagattacaggtgtatactactgctgaatacagatgaaaaaagtggtcacaattatccataaaaagcagttaggaagggaagcatcaggatgacagttctaaaaatcactttttcaaaggaagagggattgtgaaaggacacggagggaggaaagaaagacatttgctggggtcttgggagttgaagccaagtaaacttgagacaactcacttccagttgcttcagcatatgcccagtctcacaaaagaggttattgctgtggagagtactggaggcaggagggagtgctagagttggggtaaaccacagcagctcatttcacttgataactgtcaggcctcagagagagaagtttcactgacatgagtgaataagatgtgattaagttgcatatagatgctttggctaattttttttgatattacaaaattcattcggtgaataccaaaattctctttttcaataaatactgcactgattttgaaatataaatatgtattcatatccagcaagtctgtggtaattcagtgttttcttttttgataaatattttgatatcggaagcttattcgacatggtttattttatgtgttttatggaccgccttgcatgagtggatcaaggagctctaactcaaggccaaatgaggggataggagaaatgtaggtgctgcagtagcccatgtgatcatgggaaaaatgagtagtttgattagctgtcatttcataagtgtgtatactagctgatcaatgtagaacactttctttgatgagaggtgaatcacactttcacctgaactgtcatcccaactgtgtatttcctcagtgacaagacgaggggaatttgtttgtggcatgctggcagcaatgcctctgctgtgttgagttaaaatactctgtacattcaccatcagctttgacgtcgattccctcaggtttgatttgctcctctgtttaatggtcccttttctcctcatcagtccacgtgttcacggtgatatccatgcttttctattttaggtataggcatttgaaacataatctcactactgaaatgtaaactgtgcattttaggaatcctatattcctattttcctcattatgtttctgtcatgttgccgtcctaggcaatgaaaagatgccaagaagaaccctcaaaaccttaagtaattatttttatagccaggcatgagaattcagctcgatagtaccactgcatgaatgtttggttggccctgtcatacttacatataattgatgacatatcccctttgctttgtagggcctcctgcaaaacatccttccttgaaggtaattaattatgtatatttttgaatcactaactccatgttgtataaaatatatatgatttatgaatcattttcttttaaaacccattcagcctagcactgaagtggaagatcctgctgtgaaaggagcagtacaaagaaagaatgtacagacattgagagcaggtacatttaatggaatactggaaataagtacattcaatgattggaagtactcacattattcttattcctaattctatttgttcaaaattgaatggaaggcattgacataaatgttattgttggtatccatatttgaataaaaataaatttagaagcataaaaaagattttaaaaatgtaagctttaactcagatgtttctcttttaatgtttttgaatagcatgaagttttcagtataaaatttttatacctgtcagggattcaaagaagtgaattttgagactctgagatatttccaatgagttaagtgctacttggagttctgaactttacctagaggaaagctttacttattaacatgtcagattctgttttaactttagaggcttgctgctagtgttattacactgatgatctgaagccaatcagatgttctaatgagcaagactgtgtgtgtaggtgtatatatagctgtgtgtatgtgtgtgtttgtggtatctttgactattaaaaatgaggaaagtaatgattcatttataactggtagacacagtcttttaaaatggtgattttgagactttttggtgttaaggtttttaaaacatgattgcatagaggctaccgacatcataagttggttgtttttcatttcaatgcccttttgaaatctttaactatattgtgatgctcagaaataatatgcagaattttttatttgtgtcccaaaatggtatgtgagtggttatacactttacatacctttctgccactttctttggtgtattttgtattatattttccagatgtatccacattgatatgattatctctggtttaattcattttacacttttcattgtattcccttataccactttaccacatttagttagactctcctgttgctgataaatgaagaaagaaagaaaaagaaaaataatgtcagattaagtgggcttttctttaatcagtttgtatctattaatatttactatatgagagtttaaagttgaaaagttcagaatacaagcatgcaccaccatattttataaatgcccttagaactgtgactcatgagcctttagcctatgaagttaggacaattcatttctctgaagaagtttgttgtgctgttctcagaaaagaaaactgaaaatagcaaatgatattgtcttatttgacctcttggacatctttgaatgaaactgcaactccagggatactcagatcaaaattcagaactaatgttttgaacaatatagtttgtgaatgtccagtggatcatgagcccttgatgggaaaatgacctttcaagtttcacttttgcatttttttgctcttttccttgacttgtcttaaaagcttaaattcaaccgttttatttttacagaaaccgggaatataacttttaaaatttatgtctgtcctgtctcacggtgttgtgtactcttcagatcttgtgtgaatatagacttatgtgggaacaattaggtgttttgtttgtttgtgtttttgagacagagtcttgctctgtcaccaaggctgcagtgcagtggctcggtcttgactcattaccacctctgcctctcgggttcaagcaattctcctgcctcagcccctcgagtagctgatactacctgcatgtgctaccataccctgctaaattctctatttttagtagagatggggtttcaccatgttggccaggctgctctcaaactcctgatctcaggtgatctgcctgcctcagcttgccagtatgctgggattacaggcaggagccactgtgccaggtacaaataagatttttaaggctattatattttatacaattctttggtctatgtgaattctgaaggtattcatgcattgagggaagatcatctcagtttaatgaaagcagtttttaatgtatattcattaaaaatttttttgaagtttttgtctctagtacacagaaacacacaatattgtcatgggtatttgaccttaatgtgtttatgcacaaacttagttattcaaatattttcttatccctgaagaatcctaattattaataaaaaaatttctcatggaaaacaacatatataatagagattattgagtgataaagtaaattgtagtaaataacagaagcttagaacaagttaagtaaacttgtctgagttaatagcaattacaggacttttaagatacattagaccatgagggagtagtgtgtttgtggggtagaggacatcatggtcctgcttcagtgaagaaagaacttttacaccttattacaatttgtattactatttacattctaataaaaactttattttcagatattttagattatgtttctactagttgaaccatcaatagtaagacttttcaaagatttgggaagttgtgagttgatgataaatatctgtatcaccattcgtgatcaaaaatcagacagcaactacaagactttggacacacgaacttcatagttaaagaaaggattaatcttggagctgtgtttttatcagggaattatactcttcattacctctgtgaatcgcacttattagagtagaaagagagcaaagaagggaaacaaacatagaaaattttattctagattacctcagttggcttcatgctaccatagttctggcttttaaaaagtcatcttgtggtcaaatgtactttggtttactccctttatgcagcctacaaccaaacaaaatgcttcttagcaaggcatttgtattcttcccttaaggaaagcaacatataaataacaaagagaatgaggagaaagagtaatttcattgaagttggtatttaacataaatttgtgtgcgggtaccatgattatatttagaattttgggcctggaatagaaaaccagctagacgtctacagatttcctactcaaacacaatgtgcctttgttttatttttacatctgtaattttgcaattattaggtacaactgtatgcagtgtcactaaaaataccttccaaaaccaaatattaaataatgcctatggttttctgtattataatgttgatttccccaatattaatgggaaccattgagcatttgccttggggtgtctcctcagctgtattcacacattccatcaccttgtcttaatggataatcatgcactatgagtatgggttttcagaagagctgtatcatttaaagataacacaggagcatcaaatttaattctgctagaatacttggtctattgattaactgcagctaatatggggtctacttcacatacaagttaaattcagtgcccttaatcagtcatatggtcaggtcaacagtaataaattatgcaatattttttcacccctatagttttaatttctctttccccttatgtctagaattaacattttattttacaaaacatgatgataatcttctagagtagtgatgacaaagtataaatccaaagtttcttacctatgcaaatgacgtgtttgcttctattttctcatgagcttggtagatccaggaaacagaacttttaaaacaaaatccccatatgtggctgggcgcggtggctcgtgcctgtaatcccagcactttgggaggctgaggcgggcagataacctgaggttgggagtttgagaccagcctgaccaacatggagaaacacatctctactaaaaacacaaaattagctgggcatggtggcacatacctgtaattccagctactcgggaggctgaggcaggagaatcacttgaacctgggaggcagcagttgcggtgagctgagattgcaccactgcacttcagcctgggcagcaagagtgaaactccatctcaaacaacaacaacaacaacaacaacaacagcaacagcaacaaccaccacaaaacccaaatgcatttccttggcacagtaaaactgaaacagaaaaagtgtaaagtaaatacaagtaactgaaacagtttatgtatattattttacttctcatttgataaaatttgtaaagtaatgagcagagtgtatttctccagggacccagatatatacatttattcattcaataaaaattcatgcttacaatggccactgatacttatgtcctaaatatttctgaaaacatctcctcaggcctgcatcatctttgcaacactgccttatattttatctttgttcattgatttatatgcctcagaattttatgctcctcacaataattagagttaattatctctaatgcaaatagaactgtgaaccactcctgaatacctatgtccaagcatcttaaagttttatataaggatttcagaaactgatttctgggttgggcatggtggctcgtgtctataatcccagcactttgggacgctgaggcaggtggatcatttgaggtcaggagttcaagaccagcctggccaacaaggtgaaaccccatctctaatagaatacaaaaattagcaggtggtaatggcacatgcctgtaatctcagctacttgggaggctgaggcaggagaattacttgaacctgggaggccgggttgcagtgagccaagatcatgccactgcactccagtctgggagacagagtaagaccttgtcccaaaaaaagaaaagaaaaggaaactgatttctgcccaaatctccatctgtagccctttccccatctgcctttttctctggaattactgagctgctggtaatggccccctcaccattcctcttttgcagagaaatatatactctcttggaggcttctctccctctcttgttgctgcctggcatgtgctcaccctttcctgccctctgcctcacttaatctggctaaccttactctctaagtctcagctcatgcatgatctttaggaaagccatccctgacagcttttattttccttccttataccccagtgcctaacacttagcaggaactcaataagtaattatttagcaaaattaagactgtttatacaaagatgattcaaaagattgtcctctacagtctaacagcaaaggggatcaacatgtaaagacatgatgtgcagttcaggtggtaaagtgacgctggaaaatttgacaaagtactaagggactccaatgaagcagacacctgtgtgtgtggagaaagacagctagaatcaaggaagacttcacacagcattctgagccttttttttttctttttctgttgttggagacaagttcttactctgtcacccagggtggagtgcaatggtgtgatcgagactcactgcaacctcaaactcctgggctcgagggatcttctcacctaagcttcttgagtagctgggactacaggcacatatcaccatacctgtccaattttttgtagagtcaaggttatctatggttcccaggctggtcttaaactcctggccttgaacaattcccccattttggccttccaaagtgctgggattacagatgtgagctattatgcccagcctactttctgagtcttaaaagatgaaaataaatttttcagaatagtaggggaaaacatttgcgatgtaaaaaatggggtgcacactaattaaggtataaacaacaataattttgcaaattattagtaactgccaactcaattagtgtcttgttaaaaagatactgttatgaagtaaagtgttacattgtatattttgactgtatttcaaaattttgttttgtttctaacagttttgttgatttatgttgggtggaacaatttgtgagtgaccctgagatttcatatggcttgaacctggtgatttctaatgtctccccaagtggtttgttgaagttttggatgattagaagtatttcttaaagaactaaatatttcagtaaacattaagcttcattgaaactctcaaaatataaaatacaaagaaatgttattctctatttatttttatatagattatagtctttatctaactgttcttagttcatttgaactaaaccaatgaatttgtcaacagaacaagccttaccagtggcttcagaggaagagcaacaaaggcatgaaagaagtgaaaagaagcaaccacaggtatatgaaaatttaagtttcttgtttaatattgggttttgtttttttgcttcagtaacaaagcatagtccaaatgacatgaccttttagactatacctttagaatccaatagctcataattttatatttaatttttaaaacattttaaccagttatgaaacttaagatattcttactatctctagtaactattagttattctggtaattcttactatctctagtaactcatagctgtctttacccttggaattgaggcaagacattttcagaattatcttgctcttttattgttataaccttactcataatacagaaggtaacatgaaatattgggtcatattattaaggaatagaaattgtgaacaatttaacaatgatggccactgagttaaactagtgttaaaggagtcatcattgccagtggttcaaatgttgcagttttacattgctggtcatcagtgccgaggttaaagatttattctgttttgtggtcacgatttgacttctgtgtctgtgttcagggagtgaatggggtcataaaagtcaacccagttgcctattaagagaatcctaccttgtggaatgggacctttggtgtcagggtacaaacaataactttattttgacataaatacatagtaaatgttactaaaatttaaaaaatccatccactatcactagtggaacttaaaatatattagaagtggatataagcagataatccatctagatacataacactatcatagtatattatttgaattagaatttaaaattttgcttccctttcttattggtgttcagtttggctcttaataattcagtgtttgcctagtctgtagttaatcttcagaaatatacacgtactgtaggggctcactttttctggtatgatgaggtaaaatctttgtaagagaggaagattttataatactacctatcagctttgaattcatttctggtagattttacacataatgcattaagtttaatccaaacaaatgctaagagttcagcttgccagttcatatttctgtcctatgttaagccaaggcaaattatttttcactttttagttacaatcccataatttaagagtggcaacacatagattaagtttcacagttaaattttaattattttctagtatttttgtttatacttgattaaagctaattttaaaacatgcactctgacagaaaaggcatctgagaaacaaaacaagcaaatttgttttccattttgcacctgcccaaaaaaaaaaaaaagtctcaagaaccagaactgggtaagaattgtgataaagggaataatctgtctgtatattcacgactttctttaaaattcattacaaacaagttcaagctgaatattggtgaaagttttgaaaactccagaattactgcttgccctgaggaagagctcctacatagtaactctaaagagggatgaacaaaaaaggagtgccctctaatctgatgaatcaggtccctgattgtgaggaggaagatgcatctggagggtctaactctgtggcattccaggcagcgcctgaacagaggaagcccatgtcaaatgtctttttattccattcatactccaggtccctgaaatacagttaccagtcatcttctaagcttcatttaaatgaaaataaatcagactataaaaatgatagcaaaccagacacatagcttgtttctaacacagatgatgaaaatttttgtaatgatactgaaaccaaaaaattaaggaacccagtaattatgattgaaatgaaagatgattaagagtttgacatgcaaatggcaaaaaatgtaaacccagataccactaattggaaattggacattaggcattggcctcagtctagagatccagaaagtctttttgatttgttgtttacccaccccaaagaaatgaagcatatgattcagatagaaagccacagtatttctgctgctacagatacttataaaaacagaaaaccaatacagcgtttattccagcagccactatatggcaatcccagtgctaacaactacagaagcatgaatcttgaattataaaatgtgagttattctttgccacatagtgagagaacatcaaaaatatagctagaagacttatgggaagatattccaaggtcaccaacatggcacatgaatagatatgtaacaaacctgcatgttgtgcacatgtaccagaacttaaagtataataataattaaaaaaaagaatgaggtaggcatgttacaagttgagttcctggctttggagaaaagcaagtccaacttcaaaaagacagaggttcacttgctgcttctttttcctctttatcaattatttgatttagtcaaattttctattcaagaaaatctcatgtgtacagttacagtggggttatctaaatgtgtaattatgtgtcaaagtagattagttctgctatctaaataatggttctggagaatgttctcataatgtttgttcattaatcaacctatgtctcactatcagtcttccaagtggcgtatgagctgggaaactaattaagccacataccatgtgaccttctgaaccagatcaacataaagaaattgctaaagaaacaagctctagattctagattcttttttcttgtattcatttagagatgatttacatttatttaatgatagaatgggaatacaatgggagggaagcaatgactgagacaagccacaaaaacacgtctagccttgagagttgcaacgaatattcccagccaaatgagtctgtttaatgtgttttcatgcatgcaagtttatctgcttagctcgaactgtttgaacttacagtcccatcatggttatttccaatatttttgaaaacaaacatatacttacacatattttaaaaaatcaccactctgcaatatttctgttgtatcagaccttacgttatgttgtttaataaagtatggtaagttttggcatgtatgatttttatcatataagaagcataatttcttagccaaaaatttagcctttgactctagtagaaagttgagttctgtacattgtgttctaaagatagacaaaaatctagagattttcttctttcaaagtaaaagcagatgaggcctttttccaccctctgaggcattaaattgctttgctcaagttagacttttaatatatctaatttgataaatttatctggtaatttatgtaattcagcaatatggaattgtatcatgttatatggtgccatgaaatgctagtgaatgccacctcaagagctctggatgaaacatttaatatgtcttggttggtttgactcccattatcagtagataatggggttaaagtaggtaactgtaccatatgttttccacctataaacttttgtggtaattgaatgtgaaatctgggaagcatctcattttccagaattctgcactagaaactcagcagtttcactctgcttcttttgttgtggcaaacgttggttcccataattcaaagagaacctttacttttttgatatcacaggattcaaaaaaaaaaaaagagagataaaaggcagtggggaaaagagtagctcagtacagaaaagggaaaacttctttactgttcctgaaggcctacaaggtcacatcctcttaatctggctatttcatgtaaaatccaggtagtaaagacagaagacatatgttatgcctgtgtccttttatttctctgtttctgccagccagatagcataaaaatttataccagatagcaaagagtggatgggaataaaagcacaaaatggagaagagccctttttgaaattttagaaaatgcttctattccctcaaacagaaatgagcagatttgacaaaaatttcgatgataaaataaaagtatcttataatgataataattatgtataatgataaaattaaagtaagcacaaaatacttttatcattaaagtggtgatagttaacctgaatcaagtaaaaaaaatcagggaaaaagttctttttattgaataaaataataacaattattattcatcttttattaaaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgataggtaagcctatagcagtgttttttttttgtttgtttggttttgggttttttttgtttgtttttgtttttttgagatggagtttctctcttgttgcccaagctggagttcaatggtgtgatctcagctcactgcaacctctgcctcctgggttcaagcgattctcctgactcagtctccctagtagctgggattacaggcatgtgccaccatgcccggctaattttttgtatttttagtaaaaataggatttcaccatgttagccaagctcgtctcgaactcctgacttcaggtgttctgcccacctcggcctcccaaagtgctgggtttacaggagtgagccaccgtgcctggccgcctatagcagtatttcacaggagataattgtcattgtgctataaactaattgaaaattggactaatattccttatgattaacaagttttatatttttaccaggggtatttagccctgcctggtaatcagaaaaatgcaaattaacataaaataagatatattttgtaaagtcatgctgatatttaaaaagtaattattagtgttggcaaatgtgaggaaaaaggcattctcatacactgttggtataggaaattagtaaattatttctgaagggtaacttagtgctgtgtatcaaaatttcaaatagcctgacatccctttaactcaacaactccacttctggggctagatttcacaggaaaacataactggtgtgaacatacacacacttattaatatataattaacatgcattaattatatattacacataatgaacaataggttaatgaatatataaaatatatgtaataagaaggtgaattgaaagtattaagaaagaaatataaaaagtgtggggaaacagatgttagactctttagcctagttttggatgacagtcatctgcagatatagtttgtgtgagagacatctgaaggtgtcatctcactctgtaaatcatttggagaaacacctgcaatatttcataaagatgaaaatttatttctagtgaacttatatgcttgtcaataaatagtaactttaaaaatttagttgattgtaaatgatcttttctaattagggagtaattatgactgtgtgatttaaaaaggtaattttgaacctgtaactttactgaattatctctggtatccttttttataatgtatattagagtgactagtaacaaaagctttagcagaatattctttccttactacttttcaagtatatgcattcatttgaagatgttgaagtgagaaattaaatatctgagaactgcaaaggaaaaataatccagaacatagaaattttgttaagataataaacaacatctgcagaggtagataacaggatgaactccttattttttaacaaaatgaattttaagataaatgtctttatctgcagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaattgggtaaatcaatctttggtaaaaattctatattttaaactttatcttatcactgttacttataatatccacttgatttaatatatattgtttaggtctaaaaccataaatgttatctcatttttaaaaatgaatgatgacacttacaggtacaattattaatatttattataaatcttggcatccacataggatattattttattacaaagagcttttgaaaacaataatatgccataatttatacttagtgataacctattgataaaaattttgttccaggtaaaatttttccttgtactttcccctatttcatattgattactgcacctaatattataaagaggaaacagaaattattgcaatcgcaaataatctcatgatattctaagaagagctctataaattttatcttatttactattggcgttttgaaataaaagttttctttcgtattgatgtatttacaccacagaagtaactgtgatctgttggagaactagaagtagagtcagaagtcctggggaaaatcctgtagcttgcttatatttttaacatttctttttcaaaattgtggtaactagatgagttcatcaatgaatgtatataggagtgactagtataatgtctagtttatgatttagtgaatgtaattcttataactgactataaaagtgttaaaagagtcaaactgaaatagaatgttatcagtgaaacagaactgtaataactctgggaaattttatctgtccaaatacgtgtgaacaaaagttcttactgtagggtggtgtatgggttagatatcaaagtgtaaatgcaattttttgatatatcttaatttagccaaatttgttaatgctttaatttatgcttttgagtttgttgtaattcagggaaaggcttttccaattctgatattcttaaaaattctctggggtgtgtgtgtgtgtttacttttataaattcattgactctaaatacatttctgaactttctggaatttatgctctataaggttcaaagttttgcttcaactttttctccaggtggatatccacttatggtaaactttttagtggtacggatgtgcaggttattctttaacttcagaggtaatcatgatatgttattttattgagtactagctaaaactttcttttgttttatttaggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaatgatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacaagatgtttctgtacaagtagaaatgagttctgctatttccaaagtaaaagatgagaatgagtttcttactgaacaactttctgaaacacaaattaaattcaatgccttaaaagataagttccgtaagacaagagatagtctcagaaaaaagtcattggctttagaaactgtacaaaacaacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacttcgtgctagaagagaaaagtaagaagctaatgaatgaatgtgatcatttaaaagaaagtctctttcagtatgagagagagaaaacagaagtagtagtaagtatcaaggaagataaatattttcaaacttctagaaagaaaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaactttaagttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtactgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacgtatttttatgaccacgtaatgttttaaaggcacctactggttataaaatcataatttaggataaatgtggtaaaacttagcaaaactatatttggtttagttttcccactggtatttatagtttactttgaatatttatattaataattagctcataatttttattgcaaggctcaatgactgtcattggaatataattttgttcagtacaaagatacttgtagctgtctgtgatttacgagttaggcactacatctccattttcagactgaggggtggcaggcttcacatacagtgggaatggagtaattacaggagggagttgtaggagctttgaagtcagagagggaggtagaggcctttttacctagggcatcaaaggccattggaattttacttttattctgagataggaatctgttggaaggatttgaacaggtgattgaatatgttaggaactttgaggctgagttgagcttctgagatgattgaatgttggaatgaatctgttgtgtaaaagagaataccaatttggcaggaagagaacatattctgcatccctcactgaattcagtaataaataaaaatgtgtacatgtgattaaaagaaggtgaa

SEQ ID NO: 692 - DNA, 15131 bp, Homo sapiens
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgccgggaaggcgtgagtgaggagctgggcgggaaggggtcgcggagacggcttcgtggagcccgggtccccagaagcccccaagcgcctcctctccccgttgttttctgctccccaatcccctggacccgattgagagggattccaatggggattgttttcttctttaaaaaaaagattgggcctgttatgctcacaatgacttcaggtggtaagtatctgttcctttcactcagtgacttgcccaaggtcacctggctgttgaatgctgtttaggactggatgtttctgtgacagtggtaaaagtaaataaattgcatttaaggggtaagcaggtgtttaaaaacaaaacaaaatgaaagaatgtggtcgcagctaaggaggtttttacatgttgtttaaatccagtaaagtctgatccagcatctgatgcatactaaggttttcttctgtgttcattacagcatgaacccctctctttgtcgttgccagagggtagcatgggagtagttttgcttgacccttctgacttttcattacagcatgaacccctctctttgtcgttgccagagggtaacatgggagtagttttgcttgacccttctgacttttcattacagcatgaacccctctctttgtcgttgccagagggtagcatgggagtagttttgcttgacccttctgacttttcattacagcatgaacccctctctttgtcgttgccagagggtagcatgggagtagttttgcttgacccttctgacttttcattaagtagccctgggttgctcaaggaaacagaatgcctggtggcttttaagataattttaaaaaccacccacggctcttggagtcagccagttaagatctttttcttcatcacattctgctgtggggacagctttgcccaagactagtcccagcttttccacgtatgggttgcacagccttggagagtcgtatctcttgaggcctcttacccctcttctgtagaacaggggattaagccaggtgaccagagcccttctagctctaaaattctgtggttctgtgccttttgacagaatggagtttcagtttcctggaggccatctgtggagtttccagggaacctgtaagtgcatgcctcgttcaaagattaccagaggtgccgcacccttcctggtatctttatgggcctgcctcctaaaatattcaaatcaaccctataacctgtgatcacttgtcctccagaaaagccttactgtttttaatgaaatcatttccagcaaactgtattcttgtgaaagcttactgtccatttctgcaggcctgaagggaggcggggctagtgactttcagccccttctctgcaagtctgtcctaaagagtagtgacagacatggcatggtccaccttctagtccttagatacaatctcaagataacaagtttgattgatgcgttggggtcaaattccttttcgtgctccaggtaccgaggagaaggcattgtatatgggacactagaggaggtgtgggactgtgtgaagccagctgttggaggcctacgagtgaagtgggatgagaatgtgaccggttttgaaattatccaaagcatcactgacgtaagtctttccaagcatgttatctctagatagtgtctgggccaggctatagtaaccccctcccatttcttctggaaggggtccgtgataccttttgttaagggggtgtgtcctgcaagcacaggctgcccactgcttgcagcattggaggcctgcctcagcccagtttcccggtgggaaacctcatgactcagagagggagagaagccccaaacagagtctctgcggggagcatacctgttccttgtgtggggctgctgcactaggcaacacaggatcctcagcccctggcacccacttccctgaagcctgggccagtagcagctccacgtacctgcatgaccccagttaccctctggtatgagggtcttcacgctttttgcttacatgcatccaacagatttttgagaaattatgcatcatcctcacacatccagttgatgtctattaataacatttagtttacaactaaattttcataagttgcaaagcatgtcatttttgacatgtaaatctcagttttgaacaaagcaatgacatcattcttttagatgtgtctaaataatatataaatttttacttaaaatacatgaacaaggttttttaaatcatcagaaatggtatatagctgttttcctggaactcaaatttccattccacatagccctctgaattttatcctaatacaatacatgtttattcttggaagtcatcatcttgcatcataaatatgcatagaaatagaagtttttttaatcatatatttcatgtaatcatgagactaattttttttttttttgagacggaatctcactctgtcgctaggctggagtacagtggcgtgatcttggctcactgcagcctctgcctcctgggttcaagtgattctcctgcctcagcctcctaagtagctgggactacaggggcacgccaccatgcccagctaatttttgtatttttggtagagacggagtttcaccatattggctgggatggtctcgatctcttgacctcatgatccccccacctcgaccccccaaagtgctgggattacaggtgtaagccactgcgcctggccaagactaattgttttttaaaaaattggattgaggtacgagtgtaattcattaaaataacatgattatattataaattctgataaatattaaacgtgacaagtaaaacattttgcgtctttagatgagatgaatgggagctctcttttttctaattaactcataagcccatgaaaagatacaaacttttcaatagacaactgcaaagtagaggggaagcacaggctactggtgagctcaggtttacaaaaaagtggagaattgccaagtggtagctctttatcatttagtgaaacaatgaaaatgtggagaaagggctcttccttgcagactgacatttctcagcatgcttttggcaactctcaaatatcctaattctaaaatagatagatgatcgatgataggtggatggatggataggatacagggccatgccatgagtttgtcgcatttatgacatgtgctgctgctgtcttcaaaatttctttccaaagtcctcctcatcttagtttccagacactgtacctcaggaatgatgcacttggaggcagtcatcaggggtggaagcagtatgatttttttttcaaaattttcatcacttctgccattactgttacaaaataccagaatttagaaatggcaaaattgcctagtttttaacaccaagttttggaatatgcttaagaaagggaaaaacatgaaattctaataccagtgtgtactgccttgattacatattgccgcccgcactcctaattgtccctttgccaccctggaggattttacacactgggacaattcatgataggatgattctagatgaatgggcatatgctgtgcttttcttcaagtgggaaaggagaccctgtgtgcaggtgcagcctgttcccaggcaggtcattaggggatgaaggaaacacggagtagtttcctggaaatttattctcattgcacccattgcaaagtgctcaagtgcccccatgcatctcatgccattcgaagattaatttcctgaggccgaaagtgtccctgatgaaaagttctgcagcaacacacgatgccccaagtcttaatacctgaggggaaagacacagagatggagacctttaccagcccctctcacctaccccgagacttctctccaggactgttccatcacaggcctggcctgtacttctccactgtgacctcgagagagcctgggccccactctcttgcaggatgggatgaatgggagaaagcccagcatccttggtttataaaatgagagtgtggactactgggatatgctgagattgagtgaggttcaaggtattccctcctggggctgggactagggtaaaccaaagagttgccccaggcacaacataggaggctgagcaagtgcagggtcagccctaaaaaagagtggcctctcttccctctccctagctctggccctgttcaaatcctatctccaccatgagcttcgtgctgagttccttagtctctctaagtgtcagtttcctcacctgtaggagggattaatgattcctatttctaaaggtaagggacagctgagagctttgtccagccaggctcttactaggtgctcaataaatggtacctcttatggtcacatgagacgtgacctcagcatggcactggtctgcagctagacagctgtgggcagcctgtgtcacagccctcgtcttacaaactgggtgtatttccatgacacccagttcctgggaagactcgctctggatcttaactgtttatagtgccaccctactgtcagccctagtacctttcccagaccttgagggatggggtgggagttgggagaagatgtctggccagcagtcacagctacatgcttctttggtttggcagaccctgtgtgtaagcagaacctccactccctccgctgccatgaagctcatttctcccagagattttgtggacttggtgctagtcaagagatatgaggatgggaccatcagttccaacggtgagtgatgcccggaggagctgccatgccttcctgcgatatcgagctttctcttctgcaccccacagttccttaaggaaagccaagcaaccagaaatcaccagaaactcacactctgagtcccctacctcatctggttgggtttggggggactcagggccatgggggtctgacgcaagacagtccatatgccagtaattctatgttcaagtcacggttttgccagtgccccttttttttttttcctgcggaagctcatggtgtgtgctgtacacatgtgggttagttgggtggcaaaaaacttgtgtgcaaaatctatggccgtgtcttcttgagggtttggatgctgtccactcccttaatgcccagtgaggagcagggctcctgcctctgcacagcccctgccattcctccaattcttctacgcgggagagttggatgcatccatgcctctcctggctgagatttgagagaggcacctgcctcctcccatgaccaaaccttgtgttctagaatgttcttttctctgatattcttgacaagcttgggaaagctatgtgcatgtttatgtgtgaatgtggatgagtgagtgtgtgtgagtgcaagtgtgtgtgtgtctgtgtgtgagtttgtgtacacgcatgtgagagtgtatttgtatgtgtgagtgtaaggggcagtagggtgggagtagggggaactcacgccaagaggcaggagtccctcacagactccagggctgcaggtagtctggtctgtgtgctctatggcaccccaatggcagtgacctgaccgtctgaagttgtaactcaccgagattctgcactgtcttccagccacccatgtggagcatccgttatgtcccccgaagccaggttttgtgagaggatttaaccatccttgtggttgcttctgtgaacctcttccagggtaaggataatttcctgcattgaggtacatggctcagacctaactgtgacttccctgtggaccttctgtgaaaaggggcactttgactacgattcaaaagaagaaaaatgccttatagctctttagattgtgacgatacaaaatactttcacacacatctgcataagcagaacctcctgagagtacctggcatgtgggaaagaattgaggggaggcgttactcttatttttgatgcaggaaattttccctgcagcctccaggttaagcaaatgtcatggtccatttagcaaatgaggaaactgaggtttggggaggttcagtgatgtgtcctgactcaaaggctaggaggttggcagggcagggtctgtgctccgagtcctccctgaataccctccgccaggcaggagcagctttgaggatagcagtccccaccccacatttcactcagtgatcatctctcctcggcaaggaatgtggcggaactcaggcctaaagggcagttctgagaccacactgtaagtcagcctcagaattgaccccggggactctctgttcccattttgccacaggtcatggccaggctcttgccaggaaatttctgtgtaatgaattacctgaaggtcccttgtttaccctgggaatcatgcatgttgacagcaaaagaaactgtgccttgcaggtgtgtcccggtgttccctgcagtctccatacagacacccggagggaaggggtctgtccttctaccacattgtcccaggaggtgggcctcggtgtcgtgggattataccaagcccagacctagcacctttatgttaccctctttgctaagctggcttttcagacatcatgtgaagacttttcttagatgtaacaaaattttgagtttgaaaatagcacagctgtgctctaccacacacagacatacacacctgcactcagtttcagttctcccaatatataggtgccctggatcccctggcctgggctcatttccttgtcctctcccacctggtagtcagatgctaagactcacctttcagtggtgccgggtctgacagagaggaattttcagaataagaggcagagtccttccttctgaggggctgaatcccattgctgtcttctttttggtggaatgcacaatataatgggtagcatcacgccctcatgccaggtagcaaaggtatcacatggattttttttttttttttttgagacggagtttggctgtcacccaggccggagtgcagtggtgcaatcttggctcactgcaacctctgcctcccaggctcaagcgattctcctgcctcagcctcccgagtagctgggattacaggtgcctgccaccatgcctggctaatttttgtatttttagtagagccggggtttcaccatgttgtccaggctggtcttgaactcctgacctcaaatgatccccgtcttggcctcccaaagtgctgtgattacaggcgtgagtcaccgcgcctggcccgattgcatggattttgctgagagggtggttggggtcccacaaaaccctgcccatatgaaggttttaactcaagtgttgactcttccaactcctctccacttgattaaaaacatcacgtgttctctgtaaagctttcttccagagcctgctgtgtgcagttattctcatgaggctgtggatctgaaatctgtgacaatgattattctcttattattctgtgaagataggcctattctggaccctagattcagcagacaataataacagcagcagcagcagcaaacatttatacagcattactgtgtgtcagccactattgtaagcacttcatataaattaactgtttttataacaaccgtaaggcactgttgtgatcctcatttttaaaataagaatggtgggtgcacagagaggtttagtaactaacccaaggtcacacagccagcaagtaagagagccacagtctcattctggccatctggctccagaatctgggctcttaacccagatattgatgtctcaaaacagctagagtgtctgccctcttagaacttagattccaatgaaggcaggaggagacagacaaaacacaaatgtaagtagttctatctcgtggatgtgctagtaagtatcagacgttaagtgccttggggaaaactaaacccagataaaggtgccagggaaaggtgtgagtgggttatctagggggtttccctaataagacgtttgagcaaggcacaaatgcagggagtcttgggcgtgttggtggagcgagcattctggcagggggatgagcagatgcaaagtcccagaagtgggagcaggagccggagcaagagcggggcctttgaggaacagcacagagggaggtgttgtgttagcaagaggagaggctaggacattcggcccatgaggtagcaggggccgcagcctgttggggactttcctctgaataaaatgggaagccactggggaggcctgagcaggacatggtctgactttggtcttaactgctatgatgccctgcttccccaaagagggtgaactccaggggacagggacttccttccatctcaaagccttagcatcgtctgcactccaccctctccctcacccaccaacccctgcccatcccgcctttgctagggccttctctctcctcttgctctcttgagtaagaggctgtgagcaagagggcaagaggactcattgggggtgaggtggtgttgaggccagaggtggtggtggttgagctccaagtggcgcggggggcgggggaaaggtgttcttaaggtggaggagcctgtatctgtggtcgaggcagcattacagtgtcatttctggagcacttgcactgtgcacaggaaggatgctaagtgcgtcacacctactctcattaaatccttctagcaaccgtagtggatgccttcatcccagccttttctgaggggagactgggtgacctacaattcctctgtgcccccttttgccctttctgttgttgtcacataatggtgtacatgcaagagctaccactcaccaaggccactgtgacgaagagagtttgtcccatcccacatggcctctcacacgttccgcccaccacaaagcccattcctcacccagagggaaacatgatcacggagtctcatttctcactcacctgttcatgtttccaaagaggatgctgctgagaggtgatgcgggccagaggaagcccattgggaggaggagcagggaggagagagaaggctctagcagaggcgggatgggcaggggttggtgggtgagggaaaggtggagtgcggatgatgctaggactttgagatggaaggaagtctctgtcccctggagttcaccctctttggggaagcagggcacaagcagaggagaaaagccacagcccagaggagcacatgctctcccaccttgtggatctgctggccccatcctgttccatgccccagttgtccttctgtatgacttgaagagtgagattcttttttttttttttttttttttcttttttgaggtggggttttgctcttgtcacccaggctggagtgcaatggtgtaatctcggctcactgcaacctccgcctcccaggttcaagcgattctcctgcctcagcctcctgagtagctgggattataggcacctgccactatgcctggctaacttttgtatgtttagtagagatggggtttccccttgttgtccagattggtctcgaactcctgacctcaggtgatccacctgcctcgacctcccaaaggtgctgggattacaggcatgagccaccgtgcttggccctggggagtgggattctaaaaggtctccagttccaaacctgtagcctgcatgatgtcaggaaacatctgatgggcaggcatagtgctacctggggttcctggtgaggctgagtggacagttgcattcaagtaaaatgccaaatgcacaccacaaagcctataccacctttgttgtcctggccgttgagaagtttgtcacagtgaagatcgcttcctgtccctaccaagttgtgttccatctccacatcgtgtgcccctttgattctggacttccagtcagcatctgtgccacctgccgtcctctgagcttctgccaccccttggccaaaatcccttcataggtgctcaaattattcgccagttctctaaatagcagttctcaaaattttggcataaggcattattatacccttacatatatttgagggcttcatagggcctttgttcttgggggttatagctatcattatttgatgtatttgaaattgtaactggtaaatttgagaaatgttaaaaatattttaacataaaaatgcactgcatgttaacatagataacatttttattttaaaaaactatttttttaaaacaaaaaatactgtgaaaagagtggcattgtttttatatttttgcccatctctttcatgccaggcttaacagaaactcatacctgcttgtgcgtgtagtctgttgcaatatcacatatcatgtaacctccggaaaaccccactgtatgcatgtgagagaaggcgaatcacatgttcgtgttgttataaaaatagtgttaactttgtagaccccttgaaagggtcccaggagcccccaggaggttgcagaccctaaatagtgaagggcagcatctcttcgttcctctcagggcctggcacaaagtgagttctctgaaagcatttgctgagtgaatcgggcagcagggtactgggtttttgggctgggagtagggacttcttcctccctggaggccgggagaggctgtggaatgcatccccgacaggatgggtttccatcctgaaaatcagcaggtccagagaggactcctgggtggagggcacagcaagggatgagacgcgatcactgtatcatggccatttccactgggctgggctctgctcacctgcctggcgctcgtccccagcacctctgctgcagatcataacacagctctgctgttgccttcacagggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatatagaccttgtatatggctttaatgccgcaaaatatttatttttccttaaaaaaggtgtcaacttggaaataatggtttaaaaacaggataagcattaaggaaaaacactttcaatgtgtcttccatttgatgaatttgtttttctctctttatccccgcaaggtggagtttcatgtcctcggtgaaaccagacagtgtgaatctgttccagcccaaatctgcagcattagggatgagttctcagaagtgattctgaactgagcacgcactcatgtctgcatggggaactctggggagaagagccttccttttctttcccttgggcatttgcctttccttgtcgtcttactgaggcggaggcaggaggtctctgtcttccaggccctggccaggccatcctgccatcaggaaagatggaagagtaggcctccgtctagcagccctggctggaaatcccccctctagatcctgctgcaagactgtacaaactcacaggggccatgtccacccaggcacatcatcagaaccagggagcacagccttgccacctagaaggggcctcagcagccgtgcaactttctttccctatctccaatccagagagggatcctctaacattctctagcaacctcatctgcacccccaccaccttccttgtaagaaagaccacgtgtgactaaaatcccttcacgctgcatttacccaggttactattgtgcgcgcaaaatgttttcacagtgttctcagcctttgctcctccaaacagaaaacgtttcccctgcgttactgttacttccctatttttgagtcctggggtgactgtctcttaaatgtgccaagatgtgagcaagctttaaaacatgacagctcagtgttaaggagacagaaagcttcctctttctctgttctattgcaactacaaattctacagtcatgcctaagatcctttagctaacacccttttcaagaaatcatcagactcttggattgacttagaattcattcattcattaagtgcttaccgagtccccgctctgtggcaagcactgttctatatcaacttctcatgagttcagccaattctaggtgcaccagccaaggaaacttcatgcctgccctctctgagctccatactctgaggtggtggtcttatcaagatgggatcgccttgtacatccctgtgtagccaagtggaaggccagccaaccaagaatgcatctcactgggcctatgggacatactgtgcctgcactgctcctccacgtgactgcatcaggttaaactggtcagagccctggatgaggagctggaaaacatgcatccagtccaagctctgccacttgggccaagtgtgctcttgaacagtcacttaatatatctgctttgatttgtcttttaaagaaaatatggaggcaggaataccagtgtcagtgtagcctgcttcttgagtgttggcacaagtgagataatgtatgaatcagtaaaatgctgggcaaagcaaagaagtagggctgcctgggagtggattcctttttatggtgagttaagacgacttcacaattgttagctgtgatgcctgcagtgtttgaggatggcattgccttcatcctgtgtcagctctgaagaagttggcagagcaaagctaagcctcaagtgtaaatcccagcatcatggaacgcaaatggatgagcttttgttttaggatcttcttgctgattcctacccagaggacttccccagcctagagaccagaaacctgggcaatagttatatcttcagtggccctaggagttgttgtgtctccttggggaggagagaaccttctaaaacaggccagagacaggaggtactgggagggccatgggctcacctgcatctatgcccagataacctgggacagataacctctgtcccaatcacttgctttgcctggtctctcaaggagtctcttggtaccccaggcccacggccagctccatgctcatccctgtccccaccttccagtcttgatgaaaacccaccttctctttcatcccttggctgcttgataagacttaaaacaattccctgattttagggaaggccactgcgtgcacagatggtgagtttgtgcaggcaaggaatgtgccctccacatcacgtggcctccttgcccagcctgggtcatgggaagggagtgttgaattgaatcacgtctttcgttggtagattatgttcatcttcaatgtttctattaagtctaaaaagtggatacaaatggtgcctccaagttcttgtctaattgcttgtctactgcttgacaaaatccagaatggaataggccaaacaagttaaccagcaggacagaaactgctctaagcccattattccttgagatgaatagaacagtgagctgaacgcctgctctaatgaagccactaaaggggtttacaggaaggttaggagcccagatgggttttgagtccactgctgggaaacagattcttcacttcctgtggaccctggagaagccatcagattacattaacatggctccactgatgatggcctgagaattactattgtttgtgtttcatctgtgtccttgccaggtcttcccccacatccttacttcacaggatcaggggctgagaggagaccaatactctggcccaggcctggtcaagggatgctggttgttgctgatgcaaagtcacattgcctggtcctgagcttggcaatcaggcatccagagatggccaaaccaaatatccctttggccaggcactcaggcattccctgtaatgttgtgcacttaaagcatcttgggctgatagtctccaccgaatcacagaagaaaactcaatctgccgcatcactcaccagctggataagccatttactgtacacagtgtgtgccctcttatcaatacattggcacagaaccatacaccgtagaagctgctgtgatcactaaaggcaatgcccgtttagccctgagcacagtgcttggcatgtggtaggtaagtagtagcaattttatttgataccctcatatacacgctggttccttctgtcggcacacctgtccacgctttgagcttggtgcttcacctgtactcctctgtttactggctccaccacccttccctaggattacttctccaatccaaccaaaaacaattttgcaaatgtttcatgtgacaaactgtatttttcataaatgaccccagcaatatttcctctccccttaaacccaggcaggtttgtgtcagctctaactgatggagtatggtggaggtgatgccatgcaacttccaaggcaaaggtataaacaagatgcagcttctacatggctcttgcgatcctgggatgctcatcctgggaatccagacaccatgttgtgaggaggcccaggccacaaggagaggccacctataagcattcaggccagcagccccaggtgagttcccagccaacatcaacggccagatgtatgagtgaatgatctcacgtggtcccagcctttgcatgactttgcatgacgccagctgatgccaagtgggacagagatgagctgcccattccaatctctgcccacattgcagattcatgagaaaaataaatgtcactgtttgggggtgaatcatgacacagttacagtacttgaaacattttgcgaagccaggcatgaatgtcatatgaaattctaataaatccattttatttgtggcaccacaa

SEQ ID NO: 693 - DNA, 55057 bp, Homo sapiens
ctccatcctggggcggaagtggggagagcagcagtttaaaggttctgttgcagcagtttaaaggatccactcagccgccttaaccgccaaccagcaggctaagggaggaacagaatgaacaatgtttggatcccaatgactggagatgaaagttgcaaaagctctgcccaggcttctaccaaggattaactttccagggcatctgctgaactgctcttcggggctgtctgctgagattggcggcgggaccctcccgcctctcactcgtgcctttgttccccacgccggcctaaccccgcgcccctgcgctcgcggccagggcacctgacccacgcgccgcccgccggggatgcgggagccgccactgctaccgctgccaccgctgccgggcctgctccgccaagcacatgcgcagtggcgacgccgagccggcgccctcagtctcctcctccaccgcctcccggttccgcagtcacttcctgcagctgtttccctgtgggtcgggttggactgacttttgacagtcagccttcggctgcggagggggctcggcggcggccggcggagaaagttgctccgagaagaggctgggtcgagctgggccgagccgggcgcgcagggcgggcgtcgcgggcgtcccgggcggacgcggcgcggagactgccggcgcgtcccgggggttccggtaagtgcgggcgattgggagccgcggagctttcaggacgagcccctggagcgccggggactagcggttcctttccgatgctctttccatctgccctccacgtgacagggcttgcgctgcttctatttatcagtttgcttgtttcaggcatttcacgtggaccaggtggatcatctgtgcgtgcagctgccttggccctctcagttgcccccgccccgtgggagtcgggggattccatccttcgtgatggcatccataccgggttgaggtgcgtgtgtgggttcgtgtgtatgcatgcacatcttaggaatgtaaggtggatgtgggcgacgctgaactgtctgtagctttgattcaaatctgtaaacagttctctaggattaggaaccgtcacagcggagactgaaaaacattcgccaattcaccaaggcctcttccccagttttctgcgttcttttgagccttctttataggatacaccttgcctcaagtgattattattattattttttttaacttttctccctctcattccttcttgctgcgttctgatgacctctgagtaatgctcgctgcctttccctcatttccagaattcccaattacagacttacctagtttgctgaggtgctcctaacctgttcctttattctattctctttcctctgtagatttctccaaatgagacaagagattgtctttaacacagtatgtgaagagtaggccccagtccaatcattaaaactaagtatgctatgacaattaattttctttaaacagggtaccttgtgaagctttgattttctttaatgtcgtcttagctcctttccaaaccaggacattaaccagcataaatccttcatttatgccatcgcaagcatcaaagtgactggtttttaagatttgaagaatatttatgccagtcttcaaattagtcccttttaaaccaatgcaacagttgaacagatctgagttgcatgttttgggtctctgtattccatcattcatgcattcactgaagacttggttttattcattttaagatttatattttatactaatttttgtttgcaaatgtactaatatttgatgcaattgtcatacatagatttttttgaggagtcgacattgtgttgattgttaaatataacaagaaataaatttgggatatcaagctactctttaaaaattgtaaagatcaaatgtgataatgggtaaatctgtgtttggcaagaattttttctttaaatcaggtaactgtcacctctggtaggaggccttttgtgcctctgttctttgagaaggatctttattttgagggaaacctgtagataacactgggggagacacatgctagaatttcctcaagtgaaagtgagctttcataaaacaagtccagacatgcctaggcaattggtagcatttgattttctgtttatattgctgatttcctttatccagaggttttgacacccccccccaccttttcactaatgaactagcagaatgtttgtggcaatttgacatcagtagcttttcaacattatgaattattattattaggtagttaaactttttaaaagctgttctttgtctacttagttccgttttctaaaatgaccatatctgtctttgctttctggactatctttgcttgattcaattaagagaaataataccattacagagaacctgactttttaaatgttaaaactctatattgcttttcttttatgttcccagagatatgggcagtacacttctgcttaaaaattaaataatattatcatttttctaaattttgtgattaatgagaagtattgttaaattctatgactaatacttatgcactttgtccttaactacattattttcccatcacgctgatttcctttgttgcctccccaccccaaatttcgtctgaaagttgttacttgattttcaggtgctgtgtagttatcaaatatggtaaaatagactttaacttttcaaaatttacttgattcattttagtaattctattattgccataatgtacacatttccattgcagatggaaaatttcagcagcttaaaatagccatattctattgaccaagagaagaggttttaataatactgtattgagagagtggagggaattgtggattttgaaataaggattctaatttgggttaattagaatcttgggaactcaaagggtgtactgtggttcattttgagacactcagggttagacggcgccatctgggggggaggcaggagacattatggataaagattgaagagggagaggaacattttgggtcttttctgagggaattataatagagactatcagttatttgttaagaaggaggagggaaatagcctcaagattgaggaactggaattatactgtggcttatggtggtgtgatccattactccattggacatttccttgataccttattttgtgtaggtaatttacctagagaaggaggaaaaatttgggttttacaggggctgatgaatataatctaaggctgtatgaggcagggctgtaaactcaagagctcacagagaacaggcaagtaacaagtacaggcagcagctgagtggggactgaggtgtcccagagaaggcaggcctcgctagagggcacagtgcctctgagcactaactagctaattgcgtcccatataggaatgtgggccaagtgatgccagatcatcctttttcaagagaagccatgaatctcttgatttttaaatgctaacaactaattcgacttaaaaaaatgaaaacaaaactgtatattccaaacagcacatctgtggctgtatgtggcccacaggctgtttgccacctctgctatacatttgctcaactacttaaatattgctagttgatcagaaggaacatattttatttatttctgtcatactttaggctactcctagagttccctgaaattttagctagttctataagtgctttaagaattctgcaagatgatattcttttatacactctttttgatattggttggttggaagatatgtttgctaagatttttagctggtggtcttttttttttttgagtcacagtcttgctctgtcacccaggctggagtgcaatggcacgatctcggctcacgaccacctctgcctccccggttcaagcgattctcctgcctcagcctcctgagtagctgggattacaggcactcgccaccacacctggctaatttttgtatttttagtagagacggggtttcaccatgttgtcttgaacaggctggtctcgaactcctgacctcaggtgatctgcccaccttggcctcccaaaatgctgggattacaggcgtgagccaccacacctggacagctcgtggtgtttttgtctgtgcatgattatcattaagagtgtttaagtgtaagtgtgcctgagggaaggggtctggactaggtgacatttgatgtccatttcagccatgtgacttttagatttagccgtggatgcaatgctgttaatgttcacgggccaaagggatagcagttggaactgtgccaagcaaaataaagccaaatctataaagccattctcagtggaagagcaccgtgttaacatgaattaacaggcaggggaagtctgctaaatgaggccaaaggaaagaagtcccaaagatgggtttggagaagtagaagaaagggtcagattatgttgtcatttacatgttatcttgctgaagtctgattttcaagtgagtttttttttctgtttttttgctgttgattcagatttgaagaccttgcttctcatcacccactggattatgccccaggcttccctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcaggtaaagggagaaaagaaaaccaggcattgagtagggtgaacatttcagggctctggctatttagcagttgtctctccagatatgactgtgcctggaataccaagatggcttagagaacaactaactatgaatttgtttgattaaaagccttatgtttttactttaaaaataagtatcactttttgtagactggatctcaacctgttacactaagctgtgtggcatgcgatagcttaccagtctttgtaggcaaatgtaaatgatctatgctggcatctgaacctgtagtcttaagaagaacaagtatttaaaccactatttaccagcctgggtgacagagcgagactttgtctcagacaaacaaaaaaacccatgatgtaccgaactcaattcagtgtaaaattgtttagaagctaatataatttgcatcatttcgaggtgacctctgtgcatgactcttatgctttccatttttgacttctaactcttatatatcctatcactggtaaggaaaacacaggtatctttttgtggtgagaataaaatgacattgcaatattgagccctatccttcattcataataaacatactctgatttattttagcccattagcgtaaactaatactggtttttaagatttaaagctttcacctccatgttgaatagctagtggaaaggaccattttaaagggtaatattacctaagaacaaatggaaaattaaactttggttagcaagagacggtacaatatttctttttattctagacatttgtctgtataaagttaaataatttccttttttggagaaaagagacctgggagataatcaaggacaaaacccagtgaatgatgtcttcccgggtcatcactgatttgattatttattatctgcttgaaaatctctagtaataagagagtatggtagaagactgttacacaggtgtttcttctgttgtgcactataactttctccactttgtttactgtgggtgttaagtcttttctgttttgttttgatcccaaagactgattattgtgttgctttttgattgtatgtcggaagtattttgatggtcaattgttttctctggtatttaggggaagacataatatgttgcctcctttaagttcccattatgtggttttgttttgccctcaggtgcagagagttgagttaattatatctcgcagctcttgacatgtgtcatcattggttcctaaaggcctcttctggttttatttttacgttttccccctttccccagtacgtactctcatcaccttgctgtccagtacagttgtttgatacagggtcttcctttgcctgtctttaccattcaagcagagtctgttagcatgattaatctcaactccaagactgtattagctttcttcatttattcctacggaatgttcagttttatagcctaagactcactttgaaaaaagaagccagggttctaaaggtttaattattagccatataaagcccctaacaaatcattaacttgggggcaaacccacttgtatgctatacacatatataattatctttatttatttatttttttttgagacagagtctcgctctgttgcccaggctggagtgcagtggcgcgatcttggctcactgcagcccctgtctccggggttcaagcgattctcatgcctcaccctctcgagtagctgggattacaggcacacaccagcacacccagctaatttttgtatttttggtagagatggaggtttgccatgttggctagattcagcctcccaaagcgctgggattacaggcgtgagtgacctaccgcacccagcctataattcccttttaaggaagagttgtttacttttatgagggaaaactctcgggcagtgtgtaattttaacatgtccatggattatacatataccttatttctttttttctcctaataaaactttttgacttcatggactttgaaaggtgctactgatgatacatagagaagattcagtttgatgcaaggtctttggattataaggctaaaactagataagcagaatcaacatttgtttttttcttttattttacatttttgcgtatgttctaaactatgtagttgacaagattagtaattatacttaatttcagtttcctcagtgatacagtgaataaataaattagaaaatataagaaaagggaaatacaatttaggtaaatttctcaaaaatcagaatttttaagtggaaaggttgaaggagaacaggatgtaatgggacaatttaagcagctaaaaaccagggtaaagatgggaaagaaaagaggcaagcaagtaatcagaaagtaggagcttacagaaaatgaaaagtttgggtataataaagtatattgctaagacttcagaagcaaagattcgaatgagactgatgttattggtaactcttaaagagagaaggttttaacagacaactaaggcaaagcagttcatgtgtaaaaatacagagcaattatgttagggtaacatagaagaaaggtaatcttagaagtgaaatctggatttcaataagatagaaatggtcaagatgagagtggatagtgcaaagtgtagatcagaataataaacagagtgtgaacataactctagaagtgggtgagctaccaaagaaggaaagcgtagaaatgttagccaaaaagatgcatcagagggtgtacatgaataagcagtaataaaagaaagattactgaagacaaggctaagaccaggccaggtgtggtgcctcacacctgtaattctagcactttgggaggctgaggcgggaagatagtttgcgttcaggagttcaagaccagcatggacagcataacaagaccctgtctctacaaaaatacaaggaaattagctgggcatagtggcagacacttgtagtcccagctactcgtgaggctgagacaggaggctcacttgagcctgggagattgaggcagcagtgagctataatcatgccactgcactccagcaaacaaagacaacaacaaaaaacacacaaaaaagagaaggataagaccaatgagtaaggcttaccaagcacaggaataagtagaatgccaatgattgtagactaataaagtggtttaggattaaatgagatgatggatgtaaaattttatttcaagactaaaaacttactaatttttaatacagagcattaccaagctgtaccttcattatttcagttatgtgtgagataaaatgggtcacgggtagcctgtttatgagctagaaacacatttgtgtgaagtgataaatcactgtgattacattactcaaaactttttagtcagttgatgccattgttgaaatcgtggagtttcaaattgcctcgggtattgtaaacaatggtggttacactagagccggactgtatcatgtgccagtaatccaggacacgcagtggaaactgcccaataaatacttccctttaagctcactagcattttttcctgacatcccagtgttcccaagctggggctaccttagcagtgacccatgtgtatctgtagtcatcacagatttagttttattccaaggacttttaaaaactggtcagttggcttcaaaacatcattagctattgttttatttttaatgaagccatcaaatattatattcttaaaattagggctttggatataacttaatttaaaatccaatctttggaggagaaacatattttcattttattaaagtctatctgcaggcttcaggttacttagggcaaggctggcatggggtaacataccactgtttcatcagcataaatgcccagaggaagaattgctttagcagggaaggttattaacagaaataaagaaaagcaaaaagcacggatgaattttgctaaggcatccacagtttaaagtcaccagtttatttgctaatttgcatgtatatatttaaaaagatctacttactcaaagtacatttataaaatttgtcataaacatggctttctatttgtaatagttagtggccagatagcaacctaccatgaattagattgattagagaaagagaacacaggtgaaagaatagttttagaattaggatgctgagtgtagtggtcttaattcataattcataatgaagagaatgctattagatttttcccaaaatttaaagcactgattttggcacttacattttaatattgatcacccaggtttggatcactgaattaaatctcagctaattttcatgtattcaaaattctcctatctgatttttttccaaatggacttgcagtggactgagaatggccaaaacacacttcagatttggttttaatgcatgtgctttacacgtggcatatatgctttggaatctaacaactttgggctaggatcttggctcagttactttaggcaagacactgaatctctctttattcaatatctgtaaagtaggggtcattgtacttcctctgcaggattgtgagacttgcatatgttatcttaataaatgctggttgattgaaataggttgctattgtttagaagtgtttgggtctcaaatgagcagaatgagatggcacacagctgtcttactgttgttactaccttgatagtaacttgctgtaggaccttgtgtaaataagcaaaactttgttttccttgattgttctcccgagatagtcttttagatccagataccaggttaccttaaaagattctcatgaagaataattcaaccaacaaatgaggcaaaataaaatgattttcaaatgtaaatatgctttcaaccatactactcgtctgtcagcttagtccatttacccaataatcaatccttgttggttttcttgttctgctctctgaaatcgccagctctgtaggcttttctagctcttgctttgatcactttagaggacagaagctctctgtgatcctgccagttttttgcctcctcctctagtctacccctacctcatttcttcttatttcgaaatgatagataccctttcttttgtccaagtttgattcctcatcctgttttctggatttcatcaccttttcacctcaatcaaaaactatgcccaagtcttttctatataaataaaaatagcagcagcaaccttctgtttacttttaatcccttctattagcaacctttctcctctcctctcctgtccttagcattctgcaggtagaattgttctcttcaggtctttatttcccattcattcctcagcccactgtactctgatttccattcctataggccgctgaaatggtcctttccattgtcaccatgatcttacaggccaaatctaactccttctcacttgacccctttgtagcattagccaatggtaacaactttctcctaaaaaaatttaaaaatatttttatttaaaataatgcctgaggaaccaaaggatttataatgaaaagtagtaatcacctgttctccacccattccctaccttttttttcctctccattctcttctcctttctgactcccaacttgagctggctatagttttactttgacactgtcaagattgatcacatttttatccattctgtcatcaaattaagttttccatgctctatttgcaggttgatgccaattgttgaaaattaacattgagtttttgcattattgtgaatagggaattttgcactattatgagtggggaaatattgttcactgcagagctgtttccttccctgtatttccagtgtcatgatcccatgctactcacaagagatgttcaaataggtaaccctttcctgaatgccaccagttgctcaaaattgtgtctattttagtttgcttcatatgtggattataactttgaaataactttttgtttttccttgagtttctggtacttaaaaaaaaaactagagagaagaatcttaagcctttcaaaaaaggtattagcatctcaatctttctttatattgcttacaacccatttcatttatcttcatgaaacccactgttttctgattctgattttgactagttgttctaatttggattagttgttccatatttgaatcactacttcattgtgtaggttttgtatttcccggagattttagttgcttttcttctcccctctttttcttgcattatatttttcatattatcgttctcccctccatccctaaatctcaaccccactatttattgtatggaattttccttttatcctagatccctctatctccttgctccattttcagctggagtctgttgggtttgctgcacagctttgtcagctttggacttaccactctttaggtgggatcactattttctaaatatatgttttcttttttaaatcttgttttgttggagtatattgtcacattaaggaagaaagaatgaatataaatgtacaacactttttttttttcttgaaataaaatgggggagtaatgggaaataatttttttgagcccttgcgtttctaaaaaatgtttgcattgtgccttcatgtttgacagttcagttccaggttgaaaattatttttctttggaatgttaacagctgccctctattttctgtttttatctaatgttgctgaagagaaatcttctgattcttattctttttttggtgacctgttttaattttgtgtctttcttttttttcccctggaagcttttaggctctcccttttatccttgtagtctgagatctgacaatgatggttgtgtctagttttccccaggatactttttcatttgtcctggtcagcactagtagatcctttcagtttgtgtacttctgtttctcttgctctggagaatttaaaaaatatatatatttttgagacagagtctcactctgtcacccaggttagagggcagtggtgtagtctcaactcactgcaacttctgcctcctgtgtttaagcgattctcctgtctcagccacctgagtagctgggattacaggtgcctgccaccacgcccagctaatttttttgtatttttagtagaggcagggtttcaccacgttgcccaggctggtgtcgaactcctgacctcagatggtccacctgccttggtctcccaaaaaaaaaaaatattctttcttagtcactattctccagatttttttgtctttccttctaggaatcctgttagctattgtcatggttctgcttgattgattcttttttatttttctagctttattgaagtataattgatggatagatactttatattgtttgtctctgctatcttttatcattctttttttgttttaatttgagacatgttcttgacttctaatctcatattgaattttttttttgcagttgcaagatttaatagagtgaaatagagtgaaaacaagagctcccatacaaagggaggggacccaaagagggtagctgttgctggctcgaatgcctgggtttatatcccgatcattgtccctcccactgtgctctcaggcaatagatgattggctatttcttcacctcctgttttgcctaattagcattttagtgagctctcttactggtcgggtgtgagctaagttgcaagccctgtgtttaaaggtggacacggtcaccttcccagctaggcttagggattcttagtcgacctaggaaatccagctagtcctgtctctcagtcccccctctcaacaggaaaactcaagtgctgttggggaggttggccgacaaccactctaactacttcctgctgaatcagggcatagtaggggttgtgcagttgagatttcctctggaggggtgtcttcgatgtcattaacatcggagaatgggctagcaggctggtccaggggtccatggtagattttagtcatggactgcatctggggctccatttgaagaacgatttgtagttttacagccttgattctggaagagacaaacttaacaaggaggttaaagatacagggattgaaatgtatggcctgcagtgcaggggtttatttctttggcacacttcacaggccctgactatctgcttgatagttttgaaaaggcctggtccagtaaataatgctttggccatctgatgggtgctgtcaatgcctaagtgaaaggtttggtgaagcgttttaagtaatttccattggttagctgcaggcaaaagtatttttccttcttcggtggctagccatcctgaggggaggaaatgatgtccctgtgaggttccccattctatttcttcttctgagtactggggcttggtttcctggaggggattaccccatactaggggtccttctataagcatttctaatggagggtcctgcattgaagctcttttggcttcaatatccacttggcatttcccttctatttccctttcctttcctttctgacgaccccagcagtgtaagactgccatctctttaggtttctgtacagccaataacaatctcctaatggcttcctgatgtttgataggtgttcccttggaagttaggaattccctttctctgcatattgctacataggcatggaggactaggtaggtatacttaagagtctgtatatatatttaccctttttccttctcctaattctagtgcccaagtgagggctattagttctgccagctgagcactagttcctggagtgagggaattactttcaagtattccattatcactgaccactgcataccctactcttcgaagtcctttttcttttttcttttttttttttttttttgagacggagtctcgctctgtcgcccaggctggagtgcagtggcgggatctcggctcactgcaagctccgcctcccgggttcatgccattctcctgcctcagcctcccaagtagctgggactacaggcgcccgccactacccccggctaattttttgtatttttagtagagacggggtttcaccgttttagctaggatggtctcgatctcctgacctcgtgatccgcccgcctcggcctcccaaagtgctgggattacaggcgtgagccaccgcgcccgtcccgaagtcctttttctacaaaggaacttccatcagtatacaagttgatgttgggatcagtcaagggaacctctaaaaggtcccctcgagtggcataggtttgagcaattacttgttgacagttatgttctatcttttcttcattgtctggaagaaatgtggctgggttgagttgcacaagtgcacagtcgcagcactggcccttcaagtaatagagcctgatatttaagtaaacggttgtctgacagcaagtcttctttagcagtgagtatgccgttcacgtcatgtccacacagtaagatctcttccctgtgttattttaactgcttcagatactaagactgctactgccaccactacctgtaaacaatgaggctaaccctttaccactacatcaatttccttactcaggtataccacgggttgcaagctcatccctcggacctgtgtaaggactcctagagctattcctgttttttctgtgacatataaagaaaaatcttgtcctgttggcaagcttaacactgggacttgggttagggccttcgttaggtcctagaaagctacttccgcttcaggtgtccatcttactaaatgggtattggctttctgagtttccttaattagtgtatagaatgttctgggtatttcaccgtacctgggaatccatattcggcagaaacccgttaaggaaccctattagttgctttagggttttgggatgaggataagccagtataggctggatacgttcctcactgagggccctggtgcctttggataattttagccgtaagtatttaacctgctgtgagcagagctgagcctttggtttggaaaccttgtagccacaggtagtgaggaaatttaagagtgcttgggtggcttgatggcacaaggtttctgaatgggcagctaaaagtaaatcatccacgtaccgaaggacaggagtgtccaggtattatgagaattggctcaagtcttgggctaatgcctggccagatagatgggggctatccctcaacccttagggtaaaacagtccaggtgagttgagacactgggttccaaggatcttcaaaagcaaacaagaattgacagtcaggatgtacagggatgcaaaaaaggcatccttaaggtccaggactgtaaaccactctgcttcctctggtatttgggaaagcagagtataagggttaggtacagctgggtatagagggacagcagcctcattgataatcctgagatcttgcactaacttccactgtctgttgggtttctgtactcctaaaattggagtattgcaggggctattgcatggttttactaggccttgggcttttaggtccttaacaatcttttggagtccttgttgggcctcgggtctaagggggtactgcttttggtagggaaaggacgcggaatcctttagtttaacttgaactggacaggcattctttgctcatccatattgtccttttgttgcccagacttcaggattaattccttcctcaagctggggacaacaaatgggtgttccttctcctatgttcaggtgtataatggcccctgcttttgctagaatgtctctccctaacaaaggagtggggctttcaggcataattagaaaagcatgtgaaaagagtaaagttccccatcacaacttagtggctgggagaagtatctagtgactggctgtcctaggaccccttggatagtgacagatctggaggacagttgtctgggacaggagagtaagactgagaaggctgcgccagtgtccaggagacagttaacctcctggctctcaatggtcaagcatacccggggctctgtgagggtgatggcatgggctggcgctcgccccgggcaccctcagtcctgctgctggatcatctggttaatggcttctgactcagagtatcttcatcccctggggcagtgggccttccagtgattcccttgacgtaaggggcatggacaagggggcggcttatttctacttggataatcttttttaaagtgtccttgtagaccgcactggaagccagccctattaggcatttgatttgcccagcttttcccttttgcagagcctccaaagtctgcttgcctgagggccatgactaaagtagtggacccccccttttttttttatcccgtttgtcccgtttcgcctgctcctcctgatctctattataaaaaactgaggatgccaagttaaatagggtttctaagttctgctccgggcctaaggcagacttttgaagttttttctaatgtctgcagctgactgagtgataaacttatcctttaagattagttggccttcaatagagtcaggtgacagggaggtatgcttcctcaatgcctcccttagtctgtccagaaaagcagtaggattttcttcctttccctgtgttatagtggacatcattgagtaattcataggcttcttcctagttttcctcagtccttctagcacgcaagttagcaaatgtttgtggcaccaatctccatgttctgattctgtgtcccaatgagggtctacactgggaactgcctgctggcctgtgggagttgttctttcctctgttgtcatcctattgttgacctgactgagataccaaagatcgccaaactctcgggctgcagttacagcggcacttctctcatttggggttagtgtctgatttagtagtaacattatatctctccatgtcagatcaaaggattgtcctaacccttgtaaaacatcaatatagccgtcagggttatctgagaatttacctaggtctattttaatttgctttaagtctgagagagaaaaaggtacaggcactctggctgggccgaattctcctcctctcactgcttggagggggcataatcggggaatattggcactctttggttcattgtttacccctttgtctatctccttttggaccgtttgggttaaaggggggtccttattagttgaggaaggagtcggggaggggacgctggggtagggaggtggactctgagggcttcctgtagggcataaaccacactttttacataattgtgagttgtctcttaatgaaaagaaagtttgcacatatggcacttcactccatttgccctcctttctacagaagaggtctagctgtaagatgatgttataatttatacttccctcaggaagccaggtttctctcccttgaagaggatattgtggccaggcggtactgcagaagaatataaatcgtttctttcttagcgtctgagtgtcacattggtcccaattctccagaatacatcttaggggcgtttttgccttggggggaatgtttcccatcgctttggaggtccctttgtggttgccaaaatgttactggggggtccttgctcccagagctcccaagatggcggcgggccacttccaagatggtggcaagcctcgtgttctctgacctggggttcttggcctcacggattccaaggaatggaatcttgggccatgtggtgagtattatagctctattagaagccgtgggtcatggaagagaaccatggaacccagtgactagtgttcagctcaattaggatgaacccgggcacttagccgtgtgggaacaatggcaagcctttagcccaattgggagcagcaatgggcgcctcgctggatcaggagcacagtggacaccctgctggatccggaggcatggaagtcgccggcgggtctgcgatggcggcaagcagcagtgttggatggtgagcgaaagctctgctccagccttagcaaacacggaccagaagaatgcagttgcaagatttaatagagtgaaatagagtgagaacagagctcccatacaaagggaggggacccaaagagggtagcctcatattgaattttttaatttttaaattttaatgttacatttcaaacattaacattttacataattacagtacaattgtcaaaatcaggaaattaacacagatttaaataaataagacttccagattttttattctcaattcatagcatctgttttataggatattaagaacctgaaatcgcggactttgaggtcagactagtatttgatgttgtggtcttactactcgctagatgtatgatatcgaaaacatttcctaacccttctctgcctcatgaagaaggagatgatgatgaggaggatgatactaataatatctgcatgttagtatgtgtggggcatttagaatagttcctggtacctgagatagtccttgacagtgttgagtggtcccaaggtgcagtggaaccagattgtcccagctctgcattggacaattgtggcattggccgagttttatttttattttatcaacattttagtttgaattattttagacttacaaaacagttccaaaagtagtacaaataattcctgtatgcaccttattcagactccccaaacattaacattttacataactacagtatagttgtcaaaatcaggaatttaacacagattcaaatgatattgtttaatctatatactgtttacatttcattaattgtgtactaatggcctttccctggttctagttatttaatccaggatgaaattttgcaggtagttttcatgtctcctttaatttggataggtccttggtttttctttgctttttatcatcttgccatttttgaagggttgttttgtagaatgtcccaaatttgggcttgtttgatgtttgattaaattcaggttatgtgttttttagcaagaataccacagaaatgatactgtgttcttcctagtgtgtcatgtcaagaaggatgtgatgtgaatgtcttgtattactggtgctgttaactctgatcacttgtttaagctactgcctgccatggttctcctttgcaaagttactctttttctttttgtgttcaacaaatgttatatggggaggtgctttaagactgcgaatattttatttctcatcatagttttggtcagtgatgattcttgtctgcaataattattactgtggcatttgccaaatggtgatttttctgttttaatcatttcttctaagcttgttacttggaattttactttaagaaagagctttcccatttttgcatttatttattcagttatttatattactggggatttatggattctaattttatagatattctatatctatatctatagatataaattatctctatatagaatatagatattttgtagatatattttatatctatagaattttatatctagatatattttatatctatagatattctatatctatacctatattctaattttatttattttgatttattttattttatttttttgagacagagtcttgctctgtcaccgaggctggaatgcagtggcacaatctccgctcactgcaacctccgcctcctgggctcaagcgattctcctgccttagcctcctgagtagctgggattacagatgcccgccactgtgcctggctaatttttgtatttttagtagagacggggtttcaccatgttggccaggctgatcttgaactcctgacctcatgtgatccgcctgcctctgcctttcaaagtgctgggatgacaggtgtgagccaccgcgcctggcctaagttgctgcaaatgccattatttcgttcctttttatggctgagtagtattccatagtatatattaatatgtgccacattttctttatccacacgttgattgatgggcatattttttcagttgcaaattgtgctggtataaatgtgtgcacaagtatctttttcgtgtaatgacttcttttcctgtgggtagataccctggagagggattgctggatcaaatggtagatctacttttagttctttaaggaaggaatctccacactgttttccatggtggttgtactattttacattcctaacaatagtgtaaaagtgttcccttttgaccacatccatgccaacatctattattttttgagtttttgattatggccattcttgcaggagtaaggtggtatcatgttgtagtttcgatttacatttctctgataattagtgatgttgagcatttttttcatatgtttattgcccatttgtatatcttcttttgagaattgtctattcatggccttaggccactttttgatggtattgtttgttttttgttgctgatttgtttgaattccttgtagactggatattagttctttgttggatgtgtagattgcaaaaattttctcctactctatgggttgtctgtttactctgctgattatttcttttgctgtgcagaagctttttagtttaattaaatctcatctatttatctttatcttgttgaagtctttgcttaagtcaatgtctagaagagtttttccaatgttctagaatttttatggtttcaggttttagatttaagtctttgatccatctctagttgatttttgtataaggtgagagatgaggatccagtttcgttattctacgtgcgacttgccaattatctcagcaccatttgttcaatagagtgtcctttccccactttatgtttttgtttgttttgttgaagatcagttgaccgtaagtatttggctttatttctgggttctctattctgttttattggtctaaatgcctgtttttataccagtaccatgctgttttggtgactgtagccgtatgctatagtttgaagtcaggtaatgtaagacctctagatttgttctttttgcttagtcttgctttggctatgcaggctcttttttggttccatataaatttttttctagttctgtgaagaatgatgatggtattttgatgagaattgcattgaatttgatgatggtattttgatgggaattgcattgaatttgtggattgctttttgcagtgtggtcattttcacaacactgattctacccatcatgagcatggtttgtgtttccatttgtttgtgtcatctgttatttctttcagcagtgttttgtacttttctttgtagaggtctttcagctctttggttaagtatattcctatgtattttattttattttttttgtaggtattgtaaaaggggctgagttcttgatttgattctctgcttggtagctgttggtgtatagtggtgtatagcagagctactgatttgtatatattaattttgtatcctaaaactttgctgaattcatttaccagtaccagaagctttttggataagtctttagggttttctagatacacaatcattttcattagcaaacagtgacagtttgacttcctctttattgatttggatgccctttatttctttctcttgtctgattgctctggctaggacttccagtactagggtgaatagaagtggtgaaagtgggcatccttgtcttgctccagttctcagggggaatgctttcaacttttccgcattcagtataatgttggctgtgggtttgtcatagatggcttttattaccttaaggtgtgtttcttctatgctgattttgctgagggttttaaccataaagggatgctagattttgtcaaatgctttttctgtgtctattgaggtgatcatatgatttttgtttttaattcttttatgtagtgtatcacatttattgacttgaggatgttaaaccatccctagatgtaaaaccatccctaaatccctggtgtgaaacccacttgatcatggtggattatctttttgatatgctgttggatttgcttagctagtattttgttgaggatttttgcatctgtgttcatcagggatattggtctgtagttttcttttatttggaatatcctttcctggttttggtgttagggtgatatggacttcatagaatgatttcgggaggattccctatttctttgtcttttggagtagtgtcagtaggattggtaccagttcttctttgaatgtctgatagaattcagctgtgcatctttctggtcttggacttttttttttgttggtaactttttaattaccattgcaatcttgctgcttgttattggtctgttcagtttctatgtattcttggtttaatctaggagggttgtatatttctacccatctcctttaggttttctagtttatgcacataaaggtgttcataatagccttgaatgattttttgtatttctgtggtatttgttgtaatatctcccatttcatttctaattgagcttatttggattttctctcttattttcttggctaacctcaataattgtttattagttttatttatcttgtcaaaaaaccaaccttttgtttcacttaatcttttgtattttttttgtttcaatttcatttagttctgttctgatcttgactatttcttttcttctgctgggtttgggtttggattgttttgtttctccagttctgtgaggtgtgaccttacattgtctatttgtgttcttttaggcttggcttttttttttttttttttttttttttgagacggagtcttgctctgtcacccagactagagtgcagtggcgcgatcttgtcttactgccagctctgcctcccaggttcatgccattctcctgcctcagcctcccgagtagctgagactacaggcgcccaccaccacgcccagctaattttttgtatttttagtagagacgtggtttcaccatgttagccaggatggtcttgatctcttgacctcgtgatccgcctgccttggcctcccaaagtgctgggattacaggcatgagcaaccatgcccagcccctttcaaactttttgatgtaggcagttaatgctattagcactgcctttgctgtatcacagaggttttcataggttgtatcactattatcgttcagttcaaataattttttaatttccatcttgattttattgttgacccaacaatcattcaggagcaggttatttaatttccatgtattcgcatggttttgagggtttcttttggagttgatttccaattttattccactgtggtctgagaaagtacttgctataagttcgattttcttaaatttgttgagacttgttttgtggctatcatatggtctaccttgaagaatgttccatgtgctgatgaatagaatgtatattctgcagttgttgggtaggatcctctgtaaatatctgtgaagtgcatttattgtaacgtatagtttattgtttctttgttgactttctgtcttaaagacctgtctagtgctgtcagtggagtattgaagtcccccacaattattgtattgctgtctatctcatttgttaggtctagtagtaattgttttataagtttggaagctccagtattaggtgcatatatatttaggattgtgatgttttccttttggactagtccttttattattgtattatgtccctctttgtcttttttaactgctgttgctttgaagtttattttgtctcaaataagaatagctactcctgctcacttttgttgtccatttgcatagaatatcttttttcaccctgttaccttaagtttatgtgagtccttatgtatcacgagtctcttgaagatagcagatacttggttggtgaattcttatccgttttgccatttggaatattttaagtggagaatttaggcaatttgcattcaatgttaatattgacatgtgaagtactattttgttcattgtgctgttttttttttttttttgcctgaataccttgggtttttttccattgtgttattttataggtcctgtgagatttatgctttaaggatttcctatttttgtgtatttggaggatttgtttcaagatttagaactccttttagtagttcttgtaatgctggcttggtagtggcaaattctctcagaagttttttgtctgacaaagacagtatctttccttcatttatgcagcttagtttcactggatacaaagttcttggctgataattgttttgtttaagaaggctaaagataggaccccagtcccttctagcttgtagggtttcggctgagacatctgctgttaatctgataggttttcctttataggttacctgatgcttttgcctcacagctcttaagattctttctttcatcttgactttaggtaacctgatgactgtatgcctaggcgatgatctttttgcaatgaatttcctaggtgttctttgagcttcttgtattcggatgtctagatctctagcaaggctgaggaagttttcctcaattattccctcaaatatgttttgcaaacttttagatttctcttcttcctcaggaacagcaattattcttaggtttggtcgtttatcgtaatctcaaacttcttcgaggctttgttcattttttaaaaattcttttttctttgtctttatcaatttgggttaattcaaaagccttatatttgagctctgaagttcttctacttgtccgactctattgctgagacttttcagtgcattttgcatttctctgagcgtgtccttcatttccagaagttgtgattgttttttatttatgctatctatttcactgaacattttccattcatacctgtattattttttgatttatttaagttggacttcacctttctctggtgcctccttttttttttgagactgagtcttactctgtcacccaggctggagtgcagtcacatgatctcagctcactgcaacctttgcctcccggactgaagtgattctcctgcttcagcctcctgagtagctgagactataggcgagcaccaccacatccggctattttttttttttgtatttttagtagagattgggtttcaccatgttggtcaggctggtcttgaactcctgacctcaggtgatctgcctgcctcagcctcccaaagtgctgggattacaggcgtgagccaccacgctcggcctggtgcctccttgattggattagtagttgaccttctgaattctttttctggcaattcagatatttcaccttggtttggatccactgctggtgagctaaggtgatcttttgggggtgttaaagaaccttgttttgtcatgtcacaagaattatttttgtggttcttcctcatttgggtagactatgtcagagggaagatctgggactcagaggctgctcttcagattcttttgtcccacagggtgctcccctgatgtggtgctctcacctttcctctaggatggggcttactgagagctgaactgcaataattgttatttttcttctggatctagccacctagtggagctactgggctctgggttggtactgggcagtgtctgcagggagtcctgtgatatgattcatcttcatgtctgtcagctgtggataccagcacctgctctggtggaggtagccggggagtgaagtggactcagtgagggtccttggttgtatttttgttaagtgtgctggttttgtgttggttggtctccagccaggaggtggtgctttcaagagtgcatcagctatggtagtatagagatgatcatgcggtgggtggggccccagagctcccaagagcttatgtcctttgtcttcggccaccagtgtgggtagagaagaccatcgggttggggcagggttaggcatgtctgaggtcagtctctccttgggtggggcttgctgcagctgctatggggaataggggtgtgaacgggccaatggagttatgttcccagggggattatggctgcctctgctgtgtcacacaggtcaccagggaattgggggaaagctggctgttacaggcctcacccagctcccatgcatcccccagccctaaaggctggtcttcctcccactgtgcctcatctgtagcactgagttcatttccaggcagctggtggtcagggctgagaacttgccccagaccacaagcctcccagctgagaaagcaggccgactcagttcctcagctgtcccacggagtctgcagtggcaatccgcctccttcaaagggcctgtgaataccctccgctttcctggtatgttcctgctgtagttcttggagcaaaatttcatgatatgggtctccacacactgctctgtccatctgagtgggagctgctagttagtcctgcctcctgtctgctattttccctgcaaatttgcatacttttcttagttgccattagtatcattatgttgtggatgcaatatctgcttgaatactactggggatgctgctttggaaataaaatacctgatactatctaaccttgacccctccactagtactgggtacctcttctgccttttcatggactgtgttcctgtagtcatgctcttcagctcctgtatcagctgttcttctgcttttagtgacttcttcctgttgtcatacagacaagcctctaaaatccatatttcaaagggaaatgatcccatttctctgtctagctgcatgccggatttctctgctccctgtcatagagctcttctgcatagttgcctgtactgggtgttttcctagttaaaccacttcacatgacctttatctctcactgttctgctgaagtgattcttacctaggccagttgtgacctctgtctttgcaaatccaagtatcacttctctctcctgactttattcacagcagcttttgacctgatgaactactcccttttttggttattgttgtgctgaatgattatgaagtccttcagatataaggtaccaaaaatataataaacatttgtatttgccatctagcttaaggagtaaaaattattaattcagctgaagtccccatgtatctcttcccaattgtatccctatcctatgcccctagatgtagccactatactggattgatatttattgttaccacacattgtttttgtatatttgctacatatatgttcccttatataagtatatagtgttgttttttatatttttagaccctatattaaaaattattcttacatatcttcttttgcaatttgctctttttattcagtattttgttatgagaccgattcatgtttccatgcatggccctagagtgtttactttcactactgtgtagtgttcctctgtatgaataatctacaatttatctgttgtcctgtaggtggtcacttacattgtttccaccttttttgctgttacaaacaatacttctaggagcatccttatggttatctcctatgtatgtttctgtttcgtaatacctagaactatagttcctgggtcataatgtatttaactagactcttcttttgagccactttgttccagacttctatgacactgcacttgtctggtttttatcttatttcatgggcattctcaatcttatttttggattctttgccacacttgatattgtagtgtcttagaggtttgtcctttgctctctatcaccgactcgtctaggtaacttacctagtttcatggttttatttaattttatttattattattattattttttattatactttaagttctggggtacatgtgcacaatgcgcaggtttgatacataggtatacatgtaccatgttggtttgctgcacccatcaactcgtcatttacattaggtatatctcctaatgctatccctcccctagtcccccgccccctgacaggccctagtgtgtgatgttccccgccctgtgtccaagtgatatccttgttcaattcccacgtatgagtgagaacataaggtatttggttttctgtccttgtgatagtttgctgagaatgatggtttccagctccatccatgtccctgcaaaggacatgaactcatccttttttatggctgcatagtattccatggtgtatatgtgtcacattttctttctttttttcttttgagacagagtcttgctctgtcgtccaggcgggagtgtggtggtgcaatcttggctcactgcaagctccgcctcctgggttcatgccattctcctgcctcagcctcccaagtagctgggactacaagcacctgcaaccatgcctggctaattttttgtagttttagtagagacagggtttcatcatgttagccaggatgttctcaatctcctgaccttgtgatcctcctgccttgacctcccaaagtgctgggattacaggcgtgagccaccgtgcccggccaccacattttcttcatccagtctatcattgatggacattcgggttggttccaagtctttgctattgtgaatagtgccgcaataaacatacgtgtgcatgtgtctttatagtagtatgatttataatcctttgggtatatacctagtaatgggattgctgggtcaaatggtatttctagttctagatccttaagggattgccacactgtcttccacagtggttgaactaatttacactcccaccaacagtgtaaagcgttcctatttctccacatcctctccagcatttgttgtttcctgactttttaatgattgccattctaactggtgtgaatcttcattgtggttttgattttcatttctctgacgacgaatgatgatgagcatttttccatgtatctgttggctgcatagatgtcatcttttgagaagtgtctgttcatatcctcatatcctttgcccactttttgatggggttctttgtttttttcttgtaaatttgagttctttgtagattctggatattagccctttgtcagatggggagatcgcaaaaattttctcccattctgtaggttgcctgttcactctgatggtagtttcttttgctgtgcagaagctctttagtttaattaggtcccatttgtctattttggcttttgttgccattgcttttggtgttttagttgtgaagtctgtgcccatgcctatgtgctgaatggtattgcctaggttttcttctaggatttttatggttttaggtctaacatttaagtctttaatccatcttgaattaatttttgtataaggagtaaggaagggatccagtttcagctttctacatatggctagccagttttcccagcaccatttattaaatagggaatcctttccccatttcttgtttttgtcaggtttgtcaaagatcagatggttgtagatgtgtggtgttatttctgaggcctgttcttttccattggtctatatgtctgttttggtaccagtaccatgctgttttggttactgtaggcttgtagtatagtttgaagtcaggtagcatgatgcctccagctttgttcttttggcttaggattgtcttggcaatgcgggctctttttttggttccatatgaactttaaagtagttttttccaattctgtgaagaaagtcattggtagcttgatggggatggcatttaatctataaattaccttgggcagtatggctattttcacgatattgattcttcctgttcatgagcatggaatgttcttccatttgtttgtgtcctcttttatttccttaagcagtggtttgtagctctctttgaagaggtccttcacatcccttgtaagttggattcctaggtattttattgttttcgtagcaattgtgaatgggagttcactgatgatttggctctctgtttgtctgttattggtgtataggagtgcttgtgatttttgcacattgattttgtatctgagactttgctgatgttgcttatcagcttaaggagattttgggctgagacaatggggttttctaaatatacaatcatgtcatctgcaagcagggacaatttgacttcctcttctcctaattgaataccctttatttctttctcttgcctgattgccctggccagaacttccaacactatgttgaataggagtggtgagagagggcatccttgtcttgtgccagttttcaaagagaatgcttccagtttttgcccattcagtgtgatattggctgtgggtttgtcataaatagctcttattattttgagatacgttccatcaatacctaatttattgagagtttttggcatgaaggctgttgagttttgtcaaaggccttttctgcctctattgagataatcatgtggtttttgtcattggttctgtttatgtgatggattatgttttttgatttgtgtatgttgaaccagccttgcatcccagggatgaagctgacctgatcatggtggataagctttttgatacgctgctggattcggtttgccagtattttattgaggattttcgcatccatgtttatcagggatattggtctaaagttctctggtttttgttgtatctcttccaggctttggtgtcgggatgatgttggcctcataaaatgagttccctctttttattgattggaatagtttcagaaggaatggtaccagctcctctttgtacctctggtagaattcggctgtgaatctgtctggccctggactttttttgattggtaggctattaattattgcctcaatttcagagcctgttactggtctattcagagattcaacttcttcctggattagtcttgggagggtgtatgtgcccaggagtttatccatttcttctagattttctagttcgtttgcgtagaggtgtttatagtattcactgatggtagtttgtatttctgtgggatcggtggtgacatcccctttatcatttttttattgcatctatttgattcttctctcttttcttctttattagtcttgctagtggtctctcaattttgttgatcttttaaaaaaaacagctcctggattcagtgattttttgaagggatttttgtgtgtctgtctctttcagttctgctctgatcttagttatttcttgccttctgctagcctttgaatttgtttgctcttacttctctagttcttttaattgtaatgttagggtgtcaattttagatctttcctgctttctcttgtgggcatttagtgctataaatttccctctaccacactgctttaaatgtgtcccagagactctggtacgttgagtttttgttctcatttgtttcaaagaacatctttatttctgccttcatttcgttatttacccagtagtcattcaggagcaagttgttcagtttccatgtagttgtgcagttttgagtgagtttcttaatcctgagttctaatttgattgcactgtggtctgagatgcagtttgttgtgatttctgttcttttacatttgctgaggaatactttacttccaattatgtggtcaattttagaataagtgtgatgtggtgctgagaagaatgtatattatgttgatttggggtggagagttctgtagatacctattaggtctgcttggtgcagagctgagttcaagtcctgtatatgcttgttaaccttgtgtctcattaatctgtctaatattgacagtgggatgttaaagtctcctattattattgtgtgggagtctaagtctctttgtgggtctctgaggacttgctttatgaatctgggtgctcctgtattgggtgcatatatatttaggatagttagctcttctcattgaattgatccctttaccattatgtaatgcccttctttgtctcttttgatctttgttgatttaaagtctgttttatcggagagtaggattgttacccctgctttttttttttttttgctttccatttgcttggtagatcttcctccatccctttattttgagcctctgtgtgtctttgcacatgagatgggtctcctgaatacagcacactgatgggttgtgactctttatccaatttgccagtctgtgtcttttaattggggcatttagctcatttacatttaaggttagtattgttatgtgtgaatttgatcctgtcatgatgtttgctggttgttttgcccattaattgatgcagttttttcatagcatcgatggtctttataatttggcagtttttgcagtggttgttaccggttgtttctatgtttagtgcttccttcaggaactcttgtaaggcaggcctggtggtgacaaaatctctcagcatttgcttgtctgtaaaggatttcatttctccttcacttatgaagcttagtttggctggatatgaaattctgggttgaaaattcttttctttaaggaagttgaatatcggcccccactcttttctggcttgtagggtttctgccgagagatccgctgttagtctgatgggtttccctttgtgggtaactcgacctttctctctggctgcccttaacattttttccttcatttcaaccgtggtgaatgtgacaattacatgtcttggggttgctcttcccaaggagtatctttgtggcattccctgtatttcctgaatttgaatgttggcctgccttgctaggttggggaagttctcctggataatatcctgaagagtgttttccaacttggttccattctccctatcactttcaggtacaccaatcaaacgtagatttggtcttttcacatagtcccatatttcttggaggctttgttcatttctttttactctttttttctaaccatgtcttcttgctttatttcattaattaatttgatcttcaatcactgataccctttcttccactagatcgaattggctattgaagcttgtgcatgtgtcacgaagttcccatgccatggttttcagctccatcagtcatttaaggtcttctctacagtgtttattctagttagccattcgtctaaccttttttcaaggtttttagcttccttgcgatgggttcgaacatgctcctttagcttggagaagtttgttattactgaccttctgaagtctacttctgtcacctcgtcagagtcattctttgtccagctttgttccattgctggtgaggaactatgatcctttggagaggaggcactctgatttttagaattttcagcttttctgctctggtttctccccatctttttggttttatctacctttggtctttgatgttggtgacctacagatggggttttggtgtagacgttctttttgttgatgttgatgctattcctttctgtttgttagttttccttctaataggtccctcagctgcaggtctgttggagtttgctggaggtccactccagacccggtttgcctgggtatcaccagcggaggctgcagaacagcaaatattgcagaacagcaaatattgctgcctgatccttcctccggaatctgcatcccagaggggcacccatctatatgaggtgactgttggcccttactgggacgtgtctcccagttaggctacatggaggtcaaggagccacttgaagaggcagtctgtccattctcagagctcaaacaccatgttgggagaaccactgctctcttcagagctgtcagaaagggacattgaactttgcagaagttgtctgctgccttttgttcagctaagccctgcccactgaggtggagtctggaggcagtaggccttgttgagctgtggtgggctctgcccagttcgagcttcccagccactttgtttacctactcaagcctcagcaatggctgaggcccctcccccagccaggctgctgccttgcagtttgatctcagactgctgcgctagcagtgagtgaggctctgtggacgtgggacctgccaagccaggcacgggagagtatctccttgttttccggttgctaagaccttgggaaaagcgcagtatttgggcagaagtgtcctgtttttccaggtgcagtccgtcacggcttctcttggctaggaaagggaaatcccctgacctcttggcttcccggttgaggtaacaccccaccctgcttcagttcgtcctctgtgggctgcacccactgtacaaccagtcccagtgaggtgaaccaggtacctcagttcaaaatgcggatatcacccgtctgctgcattgatcacgctgggagctgcagaccagagctgttcctatttggccatcttgtattttattttattttttgagacagggtctcgctctgtcacccagctggagtgtagcattgcagtcatggctcactgcaacctcaaccttctgggtttaactgatccttccatctcagtgctcccagcagctgggaccataggtttgcaccaccatgcctgcctcatttttctttttttagagatggggttttgtcattttgcccagtttggtctcaaagtcttagactcaagtgatccttctgcctcagcctcccaaagtgctgggattataggcatgagccactgtgcctggccctagttccatggttttaaattccacctacatactgataactcctcagattctatctctaacctgacctcgttcgtaaactccaggttggtctctctttggacatctgaaagggatctcagacttaacacagcaagtgggtctcttgatgcccagctcttccccctttctctacattgcatggctggagccatctcatgcttcagcttttagctgacatgtatctccccagaaaagccttgtcggcccaccccactctctccctgtccattatctattatatcatcctgttttattttttgcagagcagttgtcagtaactcttttttctttggttgtgtgtgtgtacatatatatatgtacatgtatatattctgtttatgtcccctagaaaagcttcttgagggcagagactttgcctttgttcactgttttatctccttttcttagaatggttgccagaacatagagggtagtcagtaactatttaaccctgttatcttccgccagagttgtagattcaaattctcacctgtttttagaagacttctaaaccttcttagccttgacttccttagtgctaatgttgcagcttttgtagttcagcaagcgggaggaaatggcacactggctttttttccccgttgctcagtgagcaggagggagggttgcagtgtaaggattcctttggtgctgcttcaccagccggaaatctctgtgggtgctgtgtcctctgcctggggcctcattccaccgagctcactccgcccactcagcctggcaggctgtgctcggcttgtgccttggcctggatcctgcgcccgctgagggatctgcactcagcccatggctccactgggtgtgttgccagcagcttctgcattgggtgtcgttgtctagatgaggggaatgtgggtggtgcccgaaaactcagagatgtcagtaatggcagagtcccaaggggtgttacagctctcatccggggagtcccaagatttgacctcccaagaaatgttgcagctttgtattgttcctgccacctgcagcttggcgaacaggggcatgttacagctcagtcggtcccaccacccgcagctcagtgaatgggtgtgtgttacaggttggcctattctgggttcttctcctgcgaccaagaggaataagaggaataaggtacatggacactggagagtgaatagggtggagaagaatttcattgagcaatagaaggaaagctctcagcagagagggggcccaagagtgattagccctgtgtgtgagaggggacccaaaagaggtttgccatctgtggggttgagtctgggatttttatgggctcagaatgggggagtgcgtgctgattggttcacgggtcggcttggaaaaagcaccatttgattgcctaaaaggcatcgaggaagttctcactctcgttgtggactccacctgcaactggcagctcagttttcagtctttaaactgtctttggcatgaggttgggtttcacagggacccatccctgtctgcctaggaatttgtctgtctccagttgctgtcactaagccacacattgcactgtctcttggattcattaagatgtctttcggttgtctcaatctcatattgagattgagattgttgactctatcttcttccccaaagccttttttcctccccacacctttaaaaatttttcataaatatttccatctaccctgcggttcacctcccttctaccctcttatccaatatgctattacttgttcttaccttcttcatagttcctgcgtctttctcctttatctagccattatcttgcttgaggcccattttgcaagctgttatctgtctccactctgtctaggtgatagtttttggctccatagctttaaataccatccacattcagatcattcctgagagtctgtcttcatcctgaccacactcttgaactccagtttggttgtgggcttctatgataacatactatctgatttttatcttactttttggctagaccttgtcaatctcattttctggatcttcattctctactagactctatgttgtagtgtctaggattttgtccttgactctcctctgtgtatcttcccagcttccagctttggtctgctaccctgatgctcatctttatcaaatacaatcaagtcatgcactgctttgcttaaagttcctcagaggctccctgctgcctctgaagtccaagttctttatcatgggcaaaggcattaagaatgagccccctgtgtatttcaatttttgcctctcctccaaaggatctagaagaccgttatctctccttgtagcccctcaacacagaaggctgggcttttgctcatgctattttcttggtgcacagttttctttttccgtattgcttacctcccctgtaaacatttgctcatttaaaaagatgagtcagttgcccccttttcagggaagtcttccgtgatacattcaggcaggagtaagaaattccttctctgtgttctcctagcagtttattatcttcattataatacttggttcatttatccaacagttatttattgcttgcttgctatattctggaaactattctaggcattgggattagaacagtaaacaagacagatgaggtcctcattttcaagaagtctacattacagagcggaggaaagagaaaaaaaaacaagtcaacaaactatattattttagatagtgattagtgatactaagataaaataaaaccggccagtgtggtaatatgatggagtgtgtgtggtgtggagagggggagtggttgtgacacttgagagtgagtgaggtccagtttgagttgagacttgaaagattagaaggagcaatccatacagagatctgcaagaggtacattctaggcaaaaggaacagttaagtacaaaggccttggagctagcctgagcttggcatgtttaaggagcacatgcagcctagtgagccaggagcataatgagcaggggaaaggaaggagtgctgtctgacataaggcccaagagatagacggggccagatcatgtagggccttataggtaagatttgtcaattagatggggccagaacatgtagggccttataggtgagatttgtcagttagacagggccagatcgtgtagggccttataggtaagatttgtcaattttaagtatagcagaaagccattggaagagttttatgtgagggagtgacatggaactgattcatgtcaagaattattacttgggtttataatgaggagaattctaggaggacaagattaacagcagagaccaattaggagttgttacctactgcaaatgaccactgttacctactgcaaatgaaaaatgttggtaccttggattactgtggtatttgtagtatccatggagagaagtggagtgatgtgggatgtattttgaatgacaagacttgctgatgggttgaatgtgttgggcttagggaaggatggaatcaggaaaaggaccccttggcttttcttgggtaattttgtggatggtggtgccatttacctactgtggatgactagtggtggtggtgatggtggtgatgagaaagttctatggaggaggaatcaaaagttgttttaagttggatatgcctcttaagacgtgaaagtatggatgaccaggaggaagctggatatgtggttctgaaggtcaaagatggagattgatgatttggggagtcaccaacttactcatggtatttgaaagctataggtctgggtagaataacctagagtcagagaataaaagagggctaagggtgcgtccttggacattgtagagtttagaggtctgatagaggaggagaggtggggagggaagaaggagtatagatgatagtaggaggaatgtttcaagaaggaaatgaactgtgtcatgctactttgagttccagtaagatgaaggcacatatgtgaccactggatttgactctggagttcactgtgaccatggtaaaagcacctttagggtattgaagtgaggagaagatggatcttagttcattactctatttagctgcttaggtatctgtctcctcctctatgtgctagtccttagtttatttctagggcttagcatataaatagatggtgaataaatgtttgcctgcaggtttgagttttacaatgcagtttaaagaataatatactgttttacccttatttagaatgcttttgtactattgacccttgccactagtttgtgtcagttcaaggaatataatcatgtgactaataaaacgtgatgagaaaggcaagttgatgttagtagaggttcctagtgcatcttgaagccatcatgctgtagtggaaaagggccattctttgatttggaaggcctgtctcaggctttggctgtgctatttagcccttgagaagggagctgggggcaagctccttacagtctctggattgcagttccttggctgtcataaatggacaatattaacaaattcctcttacaagatttttgtgagcagcaaatgaataaatgcaatgaacatcctttgtaagtaaaaagatactctgtaagggcaattttaaaagaataattggattatccatttcattactaacttataaagtacattagatcagagtgtcatgaaattcatatttatctgtggcatataaatggcaagaagttgggtgaggacataagtcactggaaaatgtgatacttcttttttttttttcctaaaatcccatattcttttcttttcttttctttctttccttttttttaaaatttttttagtatttattgatcattcttgggtgtttctcggagagggggatttggcagggtcataggacaatagtggagggaaggtcagcagataaacacgtgaacagaggtctctggttttcctaggcagagggccctgccgccttccgccttccgcagtgtttgtgtctctgggtacttgagattagggagtggtgatgactcttaacgagtatgctgccttcaagcatctgtttaacaaagcacatcttgcaccgcccttaatccatttaacccttagtggacacagcacatgtttcagagagcacggggttgggggtaaggttatagattaacagcagcccaaggcagaagaatttttcttagtacagaacaaaatggagtctcctatgtctacttctttctacacagacacagtaacaatctgatctctctttcctttccccacacttcccccttttctattcgacaaaaccgccatcgtcatcgtggcccgttctcaatgagctgttgggtacacctcccagatggggtggcggccgggcagagaggctcctcaattcccagacggggcggccgggcagagacgcccccccacctcccagacggtgtagcggccgggcgggggctgccccccacctcctggatggggtggctgccgggcggagacgctcctcacttcccagatggggtggctgctgggtggaggggctcctcacttcccagacggggcggctgcggggcagaggggctcctcacttctcagacagggtggctggtcagagacgctcctcacctcccagatggggtggtggtggggcagacacactcctcagttcccagacggggtcgcggccgggcagaggtgctcttcacatctcagacggggcggcggggcagaggtgctccccacatcccagacgatgggtggccgggcagagacgcacctcacttcccagacgggatgatggccgggaagaggcgctcctcacttcccagactgggcggccgggcagaggggctcctcacatcccagacgatgggcggccaggcagagacgctcctcacttcctagacggggtggcggccgggcagaggctgcactgttggcactttgggagaccaaggcaggcggctgggaggtggaggttgtagcaagccgagatcacgccactgcagtccagcctgggcaacattgagcactgagtgagcgagactctgtctgcaatcccggcacctcgggaggccgaggctggcagatcactcgcggtcaggagctggagaccagcccggccaacacggcgaaaccccgtctccaccagaaaatacgaaaaccagtcaggcgtggcggcgcacacctgcaatcgcaggcactcggcaggctgaggcaggagaatcaggcagggaggttgcagtgagccgagatggcggcaagcagtccagcctcggatcagcatcagagggaggctgtgtggagggggagggggaggaggagggggagggggaggaggagggggaggaggagggggagggggaggaggagggggagggggagggggagggggagggagagggagagttttttttttttttatttgagacagaatctaactttgtcacccaggctggagtgcagtggtgtgatttccgctcactgcaacctccgcctcccaggttaaagtggttctcctgcctcagcctcccgagtagctgggattacaggcatgtgccaccatgctcagctaatttttgtatttttagtagagatggggtttcaccatgttggtcaggctggtctcgaactcctgacctcaggtcatccaccctccttggcctcccaaagtgctgagatacaggcatgagccaccgcacccagccaatgtgatactttttaagaaacatacaggaaattaatttcctttggctgtgttctcttgtctttcccagaaaaatttaattgttctgttagagccaaagagtaggctcttttacttcaagatctagcaatcaaatctagcactatagtagtctgtttacccccagggttgtgtatgtgtgaaggaataaaatgtagttagtattgtgtttttttctttttttttttaagtgattaagtaaatacattgattaactcagtttgacacactttctcatggtgattacagttttcatttttttttatccataggagatatcaagacctctagtagaagcctaaaaccgtgatatttctgaactcttctatatgcgttttttttttttcctgtacatacataacccaggagaaagtttaatttataaattgggctagtaagagaataacaacaataattaattagaaaaaagaacaattataaaaatatactgtcatggaaattatgtgaatgtggtctctctctcaaaatatcttaatatttttggaccacagttgaccatagctaactgaaattgctgaaactgcagataagggtggactgctgtactcattttatttttatttctagggtaaaaatcatggtaagaaactccgaaattactatgcagcaaatagctgtcctcctcctgctagaatgagcaatgtggtcgagcctgcagctactccagttgttccagtccctccgcaggtgagacatgtgtgtcagggtgaagcagcattagggtggaagctgtaatatgcacaaatggttatagatgacatttgtcgtccatgtgtccattagggtacagttgggaaaataatcctgaaagatgctgcttggtacttttaactccttgaactacagtgctggatttaatgcaggctattgttacgtgagtctttatacatttcttaaaattctgggctaaataggccaggtgcggtcactcatgcctgtaatcccagcactttgggaggccgagacgggcgaatcacgaggtcaagagatcgagaccatcatggctaacacggtgaaaccctgtcccaattaaaaatacagaaaattagccaggcgtggtggcgggcacctgtagtcccagctgctcgggaggctgaggcaggagaaaggtgcgaacccgggaggcggagcttgcagtgagctgagattgcaccactgcactccagcctgggcaacagtgcgagactccatctcaaaaaaaaaaaaaaaaaagaaattctgggctaaatgatcctgaatgtctaggctaaccccaaaatgaaaagagagattttcaaacatgtgttcctttattgcagttcatcccatttatttcagattttgccttccagttgcaaaattaggtgtttgagattgcttattacttacctctattcagagagcctgtgtaaacatgttttgaaccttgctatcatgaaacagacttgaaaaccaagttcttctgctctttggaagatagaacaggtgctttaggcaagatattcctgtaccttagtagcctctgaaacatggagtctactcttaatctgtctttgaagtgttatatgtccataaaaacaatacagtggtcataaataataatagttataatagagtacatatcgtgccaggcactgtgctgagcatgtttcatacgttgtttcagtcagggctgggactatggtgaggtgatggatgcactaaacttgggcataaaatttaagaaggagccaaaaaactcagtaataaagatagatatttaatacaatattttagaaatgtaaaattgatttaaaatagtggtgaacaaaacattaaaaacttaaaataagtattactgattttccttttgccccaggctgcaatatgacttggtgtggcagtgttgttactgattctgaatgtaaaattttggtattttattcatccttaattttttgcattaaatttaattttttaagctgggtgtggtggtgtgtgcctgtagtctcaggtacttgggagggtgaggcacaagaatcacttgaacccgggaggtggaggttgcagtgagccaagattgtgccactgcattccagtctgggtgacagagcgagactatctcaaaaaaataaaaagaaaatgtaattaaaaaaattccatgaaagtattattaatcttgattgctgagttttttttgatgctccattaaattctgagcccaaggcaagtgtctcacttgcttcattttagtcccaggccctgacgtcatttaatgcttgcagcgacttagaggtattggccatattactcaaattggtgtccataggtcagcagtttcagcctcactgaagtttattagaagcttagatgagctaagtaactttccatggtgttacaggttttgtaaagtggtggagcaagaatttctttctttttttttttttttgagatggagttttgctcttgttgcccaggctggagtgcaatggtgtgctgggctcactgcaacctccgcctcctgggtttcaagcaattctcttgcctcagcctcctgagtagctgggattacaggtgcctgccaccatgcccagctaatttttgttattttagtagagacagggttttgtcatgttggccaggctggtcttgaactcctgacctcaggtgatccacctgcctcggcctcccaaagtgctgggactacaggcatgagccaccgtgtccagcccaagaatttcttttgatcttagacctttgcttttaaccagtttgtatcattttacttttctgagtgttagtttttagtatttaaaagtgtgggtagcaattctggctgttcttccttctcatggatttgtggggaaaatgagatatataaaaaaccaaatcagagaacaagaagatacccagagagatcttcaagctgcatagttttcctgtcactggtttctgaaggctgctctagaattgaatagctacccccagtgggggctgttttcagtgggctccaccctcccgggcaggcagcctaagcctttcttcagagcataccccagaaaaaacttcccttccaagtgaaatgatgctgttttctgcaactgttgctgatatatgtggtttccagaatctttatcatgtactatattattctcttctggccaaaacctagtgtgtcattttttttgttaacctaatacttactgaatgcctactatcttctgggcaatctgttaggctctctttaacatgttattccacaacctgactacagttgtctggatttgctacttatttttaatttttttccggattatatctgtagctagtttgtagactctttgtggacaggggctctttttaaaaaaatatatgactatgtatccctcctggactagacagcaaccctgataaagagttaacagtcactaaatgcttatcgatggattctgcagactttactgtttcccgtaatgtgattttaggccttacctattttacccatgacttactgtcctaaatctaaggtttttaaactcttaaaaaatgtcttcagtggcgacagcaactagccattcactaatttggtacctaagtgattataatgcaaaaccatgattaagtatctcccagcctttttgttttcctggattgaattattttcttgatgaagcttaatgcttgtggtcatgccatatcctttggttgtttttcagctcttagaaagacctttgaggagaaggaggaaactctgtattttttttaactttgtttcttcttgtgtctttgatgtcagatgggctcctttaagccaggaggccgagtgatcctggccacggagaatgattactgtaagctctgtgatgcctccttcagttccccagctgtggctcaggctcactatcaagggaagaatcatgccaagaggctgcggctggcggaagctcagagtaactcattctcgtaggtattgccattttctctgaggccaaagtgttatgtgagattgactgtctttaaagaaaaagagtagaaagggattcttgtttagaagactcactcttttttaaacttcttttctccagggaatcctcagagctgggtcaacggcgggccaggaaagaagggaatgagtttaagatgatgcctaacaggagaaatatgtatacagtacagaataattcaggtatcttgtctgtttccacataccttgggtacattctgtacctagtctcctttgtttttatttcttttaatgataatagatagccctgagaatttggagttagtcagtgttttattgaattagtctagtggcggcctttcaggctggtgtgtatttcaggtctcatttatttactttattgttgtaaataatatattatttattttggttttacactatagtctgtgttttaggatctcttatctttgtccccttatgtttgtttatatttccagctgagaaatgtaaaagacatgataaaaatgggctacttggtttaaagttgtaccatgttaaagaaaagattctaaagcagtgttttttaaccaggctagtgaaacagaattacccaaggagcttttacaaaatgcctgaaccatgacttagagattttcaatgaataaatttggagtaggacccagacatatgtgtgttttgaaaatgcttgcttgatgcttctgatatacacatttagttcacaaacactgatttataggaataaattctgcattttctgattgtcttcagtagggagagtgggctgagtagtccctcaccctcccctctacttcagcctctgattcatgcacatgccagcagaggtcatttacttgaacagtgaaacaaatagaaaacagagctaactgaaaagccagagaagcctactaaaaaaaggacatatagaaagcacaattcaggccaggctcctgtggctcgtgcgtgtaatcccagcactttgggaggctgaggtaggtggatcacctgaggtcaggagttcgagaccagcctggccaacacggtgaaaccccgtgtctactgaaaatacaaaattagctgggcatggtggcatacgcctgtaatcccagctacttgggaggctgaggcaggagaatcgcttgaacctgggaggtggaggctacagtgagctgagattacaccactgcattccagtctgggtgacagagcaagactctgtctcaaaaaaaaaaaaaaaaaaaaaaaaagcacaattcattatgattaagaaaagtctaaacatatattaataattgtaataaatgtaaaattaccaaagtccaaaaaatgttaaattggatgaaagaaatccatctgaaatgaaagaagctgggatagctgtattaatatcagaaaaataaattttaggatagattatgttctctgaccagagtacaatgaaatgagatgtcaacaacaaaaatagaaaagcaaacaaaatttccatttgttttccaatttaaaaacacttctaaataactcatggttcaaagaaacaattatactggaaattaaaaattcctacagtgaaacagtaatgaaaatatattaacacttgtaggatgcagtgaaagcagtattttgagaaaagtattacctatatattattatagtggaagtgaaaagcataaagttaacgaactaagcgtccagcttatgaggtcagtaatgtaaaaagaagaaaatgaaatgatcagtaatgtcaccaacacttttgcagatttcattctagtctcttcatatgtatgacttctttaaaatagaaatgggatcctagtttgggatattcatagtttacttaatagcgtaagagttttctatagcattattatatttagcaatggcatagttttccattgcattcattaccatactttctttaatcctatttttgaatctcttcttccccctaaatttttgcttttataatcactgctgagataaacatattgctattaaatctcagtgtgaaaattcttagtattttcttaggataattcttacaagtagaatttttggattaaagggttagcataagcataagacttctgatataatgcttggaaattaaagtatttttaaaagcgtattcacttttttagagacacagccatttggaatttgggtttggctctacagcaatttttctgacaatggttggaggaatcattttatctttttagatcgaacctgtgtaaaattgtaattttaaaaatccattaacttcacattcacttaaagctaagaatctgtgaattttataatttgaacttagaattacaaattacagtgataattggtcaggttgtcattcacttaatgaatattttgaatatattatttttatctcttgctttagcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtacattcctctgcttaatgttaatacatgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaaattttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcagtgagccgagatcgcgccactgcactccagcctgggtgacagagcgagactccgtctcaaaaaaaaaaaaaaaaaaaaaaaaaaaatatatatatatatagatatattttccagcagtttttaggaaacaaaggtgtgtttgattttccaatttagagttacttcattgatagtaacatgcgcttatatcatgatctaaaccataagttcagattgcttgatattttgttttgccagacttttttgataatctgattcttacggtttacttacattttcctctgtcttgccagtctggtggccatcctgaaaaatatcaccacctgctgttttatacacagaggaattttttaaaaagcaaataaagtttcactatcttcgtttccagtagaaatatacacgaactatggttttattctttgtaattcggctttcttgaagatactaacaagtatatgatagatcactttggcatctgataattatatcagtattattatttttgtttttttgcgtttaaaataagaagttgtatgaacccaggaggtggaggttgcagtcagccaagaatcgtgccactgcactccagtctgggcgacagagcaatactccgtctccaaaaaaaaaaaaaaagaagctataatatatatctagattaactaatggagtgctctgtgaatattcattaactacattttatctatttactatattttatatgggtaagaccagtggtcatccgtatttcttttgaaagcccacttgatcaggaagtttatattttaagcagtatgtttgcacaatggtcagttcacatttgattgcttgtattactaattagaggtaaaacttctattttttcttgataattctgtaggcaaaaaaaattggggaaggcaaattacaatcattcttcttctgtaatactttgggacaatttttaaacaactcagacccatgtttaaaaacgagttttgtgtgattaacccttgtatagtatccagttactgtcttctcttgaagtggtggttctttgagaagtagaattattttgtaacttttcttctcccagaaacagaagaatcaaatactattctgttaggattctatctagacctgtgactcttagtataataacccttttattattattattattattattttttcagtaatctataaagtagagttgcttagttttgagcaatttagggcttttcttattggccagtaggttattcattttgctgctaaatataattttttggttaattttaacattatagtgctggccgcttggttctatgattacctaaaaatctagtttttttcctccataggtagatgtgtgtgtatgcatacccccacacacacacgtacatatatgttgtcatagagaggtatttcaacccttatttcaaataacagtagaagatacgaacatgaatttatattttgtaaaaatgtcattcatccactttgttttccattggaaatagttttataagaagggttccccttgctctctccacttaacaatttcattatatacgtagaaaaagcagccgacttaagggcttgatgttttttcaggccttgtggattcaggtttccagtttcccagtgcccttaatggatgttatgaatgcataagcacattttcttttaaagaaagaagttagatttatagtgttatttcttacttgctatatttctttgcactaaaaaagagctatgtgtttgttttataggacactttagtaccgtattgcctacaataactcagtttgctccttaaattccaaactctgggaagttgataaataacttccatgatcacttgtaaaagttacatgcacatctgaaaaaaaatcacaaatctctatgacagtaggttatgttttgagcttgttaccttgcagtattcttctctgttccataggtgaaaacaaagggtgacagaggttatcaggcaggaaatgcctaaatagatacatctctgcatggtacaatttctcatattcatgtattccataaacagtgttttttctctgtttaagcagactgttgtttcttctgagtcagtgatatgtgatcttcgttggtttcattttgtgaagctcagtctgtctctgtaacatactttaggatttgcaccttgtgctccccaggaattatgttagtgtccttttctatgctgtcttcaaggatggacagaggcctaaaccacaacaacaacaaaaattagaaaaaaaaatacttagatttcggtaatcatccataggaactcatagcatcagtctcttttctctgtgaataatatctttgtgtaagttgtcataaaaaatcaacgttagaagatgacaattagaattcttcttaggtattgagggtaagaagttgtaaagaaagaaaattcgtgtttcaactaaaagattggattgcatatacctttgaagtggttttgtaaaaaaagttcagttactaaactgagtgtgccctgtaatccttttgagtgcactgaagatgctttgaaaatactttgttggtcttcacattgtgcatcatgtcctgcaacttgtaaatatgtgcatgttgtttatgtttgtctgcctgtctcttattgcactaaattctgcaaggtgaataatttttttataccatttatttggaaaaagttcctcctccaactcttcttcactgaccttttaattagttggtaaacttagaaaaccaggtaggatttttgaagccctgagtttaaaagaagaatcgtggctatttgacatcatccttacattcccctgacttaaaaagctaacaagaagcacgagatcttccacctcattttagaaagcttttctacagaactatatgcttgcttatagctacctatctacagtttgaacagggagaaagggagatatgtatgtctggttacatcttccttcactcttgaattggctgggacagcaagcaacaacagtttgaggtccagtgacctacgtaaaatgagtgtcgtttgtgtcaggggacacatgtaactgtgcaacatggtattttctacagggagggctaggaagggtggttttggaacctaacctactttgtgtcttcattgtcagaactaaggttggaaatgccctttaaagaacttggtgaggcatatgctaggacaatagagctgctttagaaagaaattgagacatgttttgtcaggacagataaaagtttaatgcaggcttttgaacagatgttttaaaacaaatttgaccttaccaactatttttttcttctagccaaatcattgtacaggagtttcatatatgataaaaagtgttttgttattgtttttgctttcttggcaggggagaacccctaccattgtgagcagttactgtcactctggctgaatggacaaatagctgtgtaaatagcttctcataaaacgcttctactgatagctgtttgactttttcttcccgttatgaatgggaggaacatttgtaaacttcctttctgggtagctaccaaaaaacgtactggcttatggtcccatgtgaccttgtctccgttaagcccagaatctgagtgcctttagcaagtgttagcatttcacagagagaagagagacagaattattgctattaatcaccattcataaataggagcttggaataacaaaggtctgtgtgaattctgttctacgtcttttttttcccttttttaaataaatgtcaatttgatatcaagtaaaactattgtcattattgatcagaaaccatacattctgaaaatgaatccagttttcccaagctggcagaagtcagagatcatttttcaccttgatctgtgttgcgtttgtacttagtgaatggcagtgtggttgattggaagagcttgacactgatgtttggaaaaattctttattctagtggtcattttcaaacttgtcttctgtagagaggggaaaaattatgtatttgcagctaaagcgaagagactggcacaataattattaattgtgttagttcatttctatattaaatgaagcatcttcacaaatcaggtttgaagccattaaaagcaaaattttccctagtttaattaatttaaaattctaaattgcctgactacttagaatcttagaaacgccctgctagactgattttattatagaaatgttaacatgttcctcaacattttctcaagaaaattttcagacatatatcaaagttgaaaaaactttgcagtataaccactgctagattctgccatcaacatttgactatacttgtattgccatgtatctgttcatattctctatccctcttttcatccatcgatccatcagattttttttttaaagaacattccaaagtaaattttaggcaatacactgccctaaattcttagcatgggtgtcattaattaaggtttagtattcgtttaaatatctattttgaaagtggtgtatgaagttgataatctgagccaattaacatacttttttttttttcctcctgtggacttttgtcttccagtttctctttttgtgtgtacttagggtgagggaggacaattcctttcaaacacaagtttattttagaattggtcatttttaagtgcttgtcataaattttaaagtttcaatataatttttcttttccccacttctgataatgtatttttgccaaactatgcagcttcttcaaaaaactgtaaattactgattggggtttatgaaatcagcgaatacctcatttcaatctgttgctgcttttctccctcttgtcacttctcctttcactactttcagctgctctaccagaaggtagaggggagtaaagggtcaaacccctatataattagctgttttaaacaactctaggagagcagattaagtagcttagtaagttgaaactattaatttttctaaagaatttgatttgaattccttgagaattgtaattatccacacttcctccagctataattagcagaattaaaaatgattgtactgtacaatgagttgttgaaattgtaagccttagtaaccatctttagctttattgtagtcatgtttagaaaaaattatttttacatatgcctttatttttatgcccactttttgtggataagattctttagataaaatctaaagaattttaagtgactttctccaggtcatgaagattcaatgggtagaattgaatcagaattgaaatgttccagattcatattcttgtgtgtgtttgataaaattcatggcttccaaagtaactgaacacttcctttgggcccttggagggaaaatccatatttttactaattacacttttttttttagacatctggcagttctttgaacttaaacatattctcatggccatagttccaaattaagcccgacgcagttgctaaaaatcttgctgcactgttgaatactaataatgcaacatttattggatgtttttgcattttgatgaccttcatgattcatttataagtctttgtaagtgcttaagtgaccccctcactagtgaaaataataaatgttctatatcatttattattatttgtgtattctctacatgatatatttttttaaggaagagtaactccacatgtcagaatgagtgatattatcctagggcaaagcgcaaatagggcagtttgtttctactctgcaaatatggcatgtataggaacaaaactcttttggagtggctggtcattgttctgccctcttttggtacctgagtacctttctggggttttgtaaatcgtgtgtcatttgtaagaatttcacgttaactctgcgttacttggtgttcacctgtggtatccttgactgaccataatgatttagtttgggtatgatgtgtctgctttgaaatgccttactggagtatgtcagatcctgctttaaagcattccatatatctgctgggacaataagttgcttctccttggaaatatgctctagattcagaagcaaaaccgattttgctttcaccattaaggttgcattttaatgcagttattgttttaaattagagaataaaatgtaaaaccaagggaggctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgtgttctggggctgcagaatgacaaacgtgtcatgggattaaaaccaatcaactgtgaattgtgaaattgaaactactctttcggttttattttctttagcatattgagtatagaaatctgaaacttatttaaaatttatactgcttttgttgatggctcattttggctgtgtatcctcacttatgtactgatttctgataaaggcttgacattattataacacgcattttgtgttccagtttaataaaacggtttctgagtcttgtctgaaaa

SEQ ID NO: 694 - DNA, 20373 bp, Homo sapiens
gtccaatcaggcacgcagcttgagcggagaggacggcttccgggatgtggcgggatttgtccgcttctttgtctttggctgccgctggaactccgggtctcgtcttcactgctctgtgtcctctgctcctagaggcccagcctctggtcctgtgacctgcaggtattgggaatccacagctaagacgccgggacaccctggaagcctagaaatggtgagagtgcggggtccaacatcccgagagaggggaagggctggttggaaccggtgggaagtggctgtggcgagactcaggcctccccgcagtcagctctacaatctgcgccccgagttctccttgcccagctcggcctcagtcgccttcagccataagatggcggttgcgccgacagcccggcccccgggcgtcctgtctcttccctgcatagtgactgtgcccttgcctggagccctctctggggaatctctgcacccgcagcgccgcttctctaccggattgtgcagggaccgtgggagggtcgtcaggggagaatcctgacttggggtgcgggttcatgaatgggaagaggtttgttccgtggggttcccagttcctattatctcctattaaaagttaatgggagtcactgcaaaaatattaaaagaatttaatcaaagagtggttctaggctgggcgcggtggctcacgcctgtaatcccagcactttggaaggccgaggtgggcggatcagaggtcaggagatcaagaccatcctggctaacacggtgaaaccccgtctctactaaaaatacaaaaaatgagccgggcgtggtggcgggcgcctgtagtcccagctactcaggaggctgaggcaggagaatggcgtgaacccaggaggcagagcttgcagtgagccgagatcgtgccactgcactccagcctgggcgacagagcgagactcttgtctcaaaaaaaaaattaacttattaaataatttaatcaaaaagtggttctagaattgtagagcaccaagctgtggtttttagtttgtggtctatgggagaggcttgaaagaaagtcttttgtaaaatgcatgatgaagaaaaccaaatttagtaattggttaggtacagttacgtggttttttaatttgtacattaaaggtgaaaatttcctggttatgtaatcggagctcaattggcagtttatagtaggtgaagcctcaattttgtttctctgaatttagtaattaaaaataatgcgcctgagttagattttttaaattgaagtaggaacccagggactagagaaacctcagtctaattgcctgccacttaattattttcacactccacagggaactgattttctgctgcatttttcacctgggtcccaatcagggtcttaagtctaacccccatccctcattactccaacctcattcttgcttgcagtaagatactaaatttccaatttcttctggggttcccaaatgccagcttttcctccctaattcacattatcacgtatttgtgtttttttgtttgttttgttttgtttttgagatggagtctcgctctgtctcccaggctggagtgcaatggcgcgatctcggctcacctcaacctccgcctcccggttttaaacaattctcccacttcagcctccttagtagctgggattacaggtgcgcgccatcatacctggctaatttttgtgtttttgtaaagacgggggtttcaccatgctggccaggctggtctcgaactcctgacctcaggtgatccgcccgcatcagcttgccaaagtgctggaattacaggcgtgagccaccgggcctggccacttattttgtagtgtacttttttataccgtattttaattaattattttttggcaaggcattaaatggtgcttttttcttttcttttttttttgagacggagtttcactcttgttgcaaaggcacattctcggctcaccacaacctccgcctccgggttcacgaggttctcatgcctcagcctcccaagtagctgggtttacaggcatgcaccaccacgcccagctgattttgtatttttagaagagatagggtttctccatgttggtcaggctggtcatgaactcccgacctcaggtgatccgcccgccttggcctcccgaagtgctgggattacaggcgtgagccactgcgccctgcataaatggtgttttgggggtttttttgtttgttttttgttttgagacggagttttgctcttgttgcccaggctggagtacagtggcatggtctcggctcaccgcaacttctgcctcccgggttcaggcgattctcctgcctcagcctccgagtagctgggattacaggcatgtgccagccaccacgcccggctaattttttatttttagtagagacagggtttctctatgttggtcaggctggtctcgaactcccgacctcaggtgatccgcccgcctcggcctcccaaagtgtggggattacaggcgtgagccaccacacccagaccaatggtacttttaagaaggtttgttatctgtttgtaaatattttccatgaaaagaaagcaaataataatcccctgacactgtgttgcaaaaaatctctgtgtgtcttttccttttatctttctaggcacagagatgttatcggaatttttttgggtcagagttctgctttggaaaatttatggggtgatgtgtcctcagccaccgtttagttttttcccggtcctgggtttcagtattatctggggataaaccgagatatctgccatggttatgtcagctagagtgtctagtggatatcagcttctggtttattttctcccataggacgacctgaggtatggagtgtatcctgtcaagggggcaagtggataccctggggctgagaggaatcttctggagtactcttattttgaaaaggtaaccccttgatatgttaaaattgtctttgggaccagcttgaaaaacatgctctactaaaaatacaaaaaacttagccaagcatggtggtgcatgcctgaatttccagctactcggggttgctgaggcaggacaatcacttgatcccgggaggcagaggttgtggtgagccgagatcctgccattgcactctagcctgggcaacaagagtgaaactccatctaataataataataatgataataataataataataataataataataataatgaataaattgtcttctaccaaccctgcttccatttcatggagacaaattgcttgtcagccaatcagatgctggtaatgaggaacaaacacagtaataacttctgccccctggattctgtaagggagcagaagaatagtgaaataaatatagtaaaagaaaaagagtaaaaaacagtgaaaaatatgtgaccaaaaaaatagtatcccgaaagacaaacaacaaaaacaacaacaaactgactccagtgagatggtgtaagaacttgcaaagtaaaatgcacctagggcagtcaccgaaaaatagtgcagtgtctcctgaatgggtggttcttgagcacataagtgagcaggagtgggtggaaggatctctcaagtgattgaatggcctgacttgaaacgtgagtcagacacatctgttatttaaccagcactgccattcctggatttgtcaccttgaagagatttgttcacttattttcacctgttttttagctgtaaggttacattatattagtagggcttgaaaggtagaaaaatatttacaaagggcataaaagacgtgggattcaaaaaaattaatcatatatttcatttgttaaaaattttcacttacctttttctttcccagagtgagtttacaagttttctcaggtgtagcttttaatggctgggtgatttcaaacagaatttcaagcttagctttcagaatgctaccaagaaaaagaagaggaaaaatgtctattccatttttgccgtagaaaatgaatacgtttccacaagaaaatgtggtagataattggtgagttacatagattcatgaaaacatcagttcctttttttggcagggtaaatttttgacagcgaatatctctgttcaaattctgttatcttgatttctgagttttatgctaaattttatgagatgaaacttggtattgcctggaagtgtttccatatgactaaatgtttgctgcatgatttttaatggaattaatagaataatacatttattttctgatagaaatacttttgcttttcttattaaggtataaaatgtaagcaccttaaaattttcttcccttataggaatactgtgtttgagtaatttttttggatttttcaaacaacttagtttcaaaaaccaagtgagcaactctaacatggaaattaaagcttgagcccagtgactcagagctagggcttatattgagactgtaaaagtaggttattaaaggtccagttagttttttctggagtgcctctcctgcagatgttctagcctgctcactccagtcatggaagaagcctttctgatgagagaagctagagtcctggaaagctacaggcagatgagttaaggttaagacaaaaggggactgggagggtcttactgaccgtgtagttgttttaaggcagtttctagactttgtaatatgttataaagttaatttctgttaaaaaatttgaattctagacccaggcacggtggttcatgcctgtaatccctgcactttgggaggccaaggtgggcggatcacctgaggtcaggagtttgagaccagcctgaccaatatagtgaaaccccatctctactaaaaatacaaaaattaactgggcgtggtgatgggtgcctataatccagctattctggaggctgagacaggagaaatggttgaacccaggagtcggaggttgcagtgagccgataacggtcccactgcactccagactgggtgacagtgagactccatttaaaaaaaaaaaaaaaaaattgaattctagagcccggcatggtggctcatgtctgtaatcccagcactttgtgaggctgaggcgggcataccacctgatgtcaggagttcgagaccagcctgaccaatatggtgaaaccccgtctctactaaaaatacaaaaataatccaggcgtagagatgtgcacctgtagccccagtgacttaggagcctgagacaggagaaatgtttgaacccgggagatggaggttgcagtgagccgagatcatgccactgcactctagtctgggcaatagagcgagaatccgtctcaaaaaaaaaaaaagaattcaaaaagagcattgcaacaggaggaataccaattataaaaattttaaggaatgcaattttaggtagacaagggctttttttcatagagtggagcctacaagattagaaagaatggaggagaatggcaaacggggggttaaaaaatcagatttcagatcagagaatgttttatcctgaagtcagcatgttcttaggagggatatagaatgaaattgtataatggctcagattgagggtagctcaaagttcagtagcctgtgaaaaattttatttagaccactgaagacaaatacagctgactcttttaataagaaaaagaagaaaaggtgccaagtttttaccaaaaaagggtcccaatccaaaccccaagagagggtccttggatttcattctagaaaagaattctgggtaagttcattgaataaaatgaaaggaagtttattaagaaagtaaagaaataagagaattgcttactccataggcagagcagtccggaggcctactggttgcccattttatggttctttcttttttttttttttttttttttgagagggagtcttgctctgttgtgaggctggagtgcagtggcatgatctcgactcatggcaacttctgccttctgggttcaagtgattctcctgcctcagcctcctgagtgactgggactacaggcatccaccaccatacccagctaatttttttttttttttttttttttttttagtagagacagggtttcaccgtgatggccaggatggtctccatctcttgacctcatgatccacccaccttggcctcccaaagtgctgggattacaggcatgagccactgcacccagccagttatttcttgattatatgctaaacaaggggtggattatttattcccattgtagaccatatagggtaacttcctgatgtttccatggcatttgtaaactgtcatggcactggtgggagtgtagcagtgaggatgagcagaggtcacactcattgccatcttggttttgttgggttttatcctgctccttactgcaagctgttttgccagccaggtctttatgacctgtatcctgtgctgacttcctatcttatcctgtgacttagaatgcctaaccatctgggaattcagcccagtaggtttcagccctattttacccaccccctattcaaaatggatttgccctggttcaatatgcctgacatttcctccctcttttgtacaaaaaaaccccttaatcataagggttacagaggaatgaaaattcatcttctgtaactacttcatgctgtataggggcgatgatattcttgcttaactattagagtcttttgtatttgaggtagagaggagctcaatcggaactcatcagtatgtgagggccattcataactgttgagtttcaaaaaaggggttatctcaaagattagtaagtgtttaatttaagaaaacatctaggctgggcgtggtagctcatgcctgtaatccaagcactctgagaagcctaggcgggtggatcgcttgaggtcaggagttcaagaccagcctgaccaaatgacgaaaccctgtctctaccaaaaatacaaaaaattagccaggcatggtagggcgcgcctataatcccaggtactcaggaggctgaggcaggagaatcgcttgaacctgggaggcagaagttgcagtgagccaagatcgcgccactgcactctagtctgggtgacagagggagactccatctcaaaaaaaaaaaagaataggaaacatccagaaagtttatcctgcatttctacacacagagtacaactgcaatatattttacaagttcaggcagccgcttcttggtagcaaaagggtcgtttccagaagtcctgtcagctctcaagtttccccttttggaggggaaagagctccccatgtcctaattctgtcactcatagacaccagcaaacagtgcaagacagattaatccaaaaagaatagcaattaacatccagtggtgtgaaaccagttcttagttgagactttactgagagcggtctctaacctacatcttaggaaggactataaccttcctaagttgggtcttgaatccaagtacagtcaagcatccttgccttgttttagaggctcctttaacccacgctgtcttaggagagactctgactttcctaagttgtgcctccaacctaatctcatcctttacccaggtatatggactcaaagtcagccaattggtatccacagataatttttctgggggagggacagaagtctcttcagtatagtccttttgtggttgccaggaaaatgttactagaaagaagtcttgatccataccccaagagagggttcttgtatcttgctcaagaaagaattcagggcaagtcataaagtgaaagcaaatttattgagaaagtaaagaaataaaagaaatggctttctccataggctggttgcacatttttatgtttactttttaattatatgctaaataaaaggtggattatttatatatctcctttttagacctttacgatgtaacatcctgatgttgccatggcatttgtaacctctcatggcactggtgggagggtaacggagaatgaccagaggtcactctcatcaccatcttggttttggtggcttttatcccacttctttactgcaagctattttatcagccagatctttgtgacctgtatcttgtgctgacctcctatctcatcttgtgacttagaatacctaaccatctggaaatgcagcctggtaggtctcatccttattttactcagcccctattcaaaatggatgctgtgtacctctgacagattctgtgtctggatgtgtaataaataaggaaagagagcaccatctaagtcataatgggaagggtatttctttctataaactgttcctgaagaacacaaaggatgaagaattttattaatcacagctatttactagggttatgtatgtgtttcatctttctacatctttttttgtcctatacatttcttctatttgactttcctcagttgtatattttataataaactggtaaacataactacagtgtttttctgagttctgtgagtagctcgatcagataattgaacttgagaaagggctcaggagtccccagtttttaaacagtagctcagacacatagatgggcctatggggtttgtgactggcatctgcagtgaggacaatgttgtgagactgagccctgaatcagggtctgtgctgactctgggtggtgtcagaattcaaatgttagacattgagttggtgttagagaattgcttgatgttcagcaaatgctacagatttggtgccagaagaaagatatcacagacgcctggcctgcagtggaactccaggtgtctgaaaatggaaggctctgctctcctgtacacagactgtcatactgcccattgtcctgtgattccaggtctcctcttagggtgagagaatgaaaactcagaggaaaggagatctaatgacagaccctctgtctcacagctgccaccacaggattcccacccactcacaaacacacccactagacattgatgtgtccacactcctcccaggactaggcaccaccatcaggaacttcaccacagcatatttgatcctagggtttcttgccaaaaagacgcaaaagtgtctacaactctcctggcatatccccactgtatctgcagcagtaacctgttttctccatctacctagcattatggagcacctgttcataatctcatctgcctgcatggacacagaaataaatcagagtacagccccactgggaccactatctgcagaacaaacagttctttccagttatattgcactcttctgcacgcatgggtttttcttaacttttctttttggttcaggcatacacgtgcaggtttgttatataggtaaaattgtgtcatgggggtttgttgtagattattttgtcagtgagttcctaaacatagcaccaaagaggtatttttttctgatcctctttgtccttttatccttcatcctcaactaggcctccatgactgttccttctttatgtccatgtgttcttattatttagctcttccttataaatggtgacatgcatttggttttctgttttgcgttaattttctaagaataatggtctccagctccatccatattgctgcaaaggacttaatcttggtgttttttgtttgtttgcttgttttttgagacaaactctttttttttcttttttttgagacgtagttctgctcttgttgtccaggctggagtgcaatggtgctatctcggctcactgcaacctcagcctcccaggttcaaacaattctgcctcagccacccgagtagctgggactacaggtgcatgccaccaagccctgctaatttttgtatttttagtagagatggggtttcaccatgttgctcaggatggtcttgatttcctgaccttgtgatctgcccacatcagcctcccaaagtgctgggattacagacagaagccaaagcgcccagccagacaaattcttactctgttgctcaggctggagtacaatggtgtgatctctgcttactgcaacctccacctcccaagttcaagtgattctcctgcctcagcctcccgagtagctgggattacagatacttgccacgacgcccagctgattttttgtatttttagtagacacggggttttagtatattggccaggctggtcttgaactcctgatctcaagtaatccatctgcgtcagcctcccaaagtgttgggattataggcatgagccacagtgcctggctttgtgtttttatatggccacatggtcttccttgatttttatgtaccatattttattttgattaaatctttattttatttttggagacagtgtctcactctgtcacataggatggaatgcagtggtgtgatcttggctcacttcagcctcaacctccaaggctcaaggtttaaggaatcctcctacctcagccccttaagtaactggaactataggctcacaccatcacgcctaatttttctttttttattttttgtagagatacggctttgccatgttgcccaggctggtctttaactcttgagctaaggcattccacctgccttaatctcctaaagtgctggcattacaagcgtgagccacctcatgctaccatattatattttttcaatctagtctaccatcaataggcaattaggtttattccgtgtctttgttattgtggacagtggtgaaatgaacatgcatgttttaagttttgcatttaagtcttcaattcaggttgagttgatttttatatatagtgtaaggaaggggaccagtttcaatcttctacatagtgctagctagttattccagcaccatttattaaatacagaattcttttcatattcctgtcaggtttgtcaaagatcagatggttggaggtgtgtggcattatttctgggctctctattctgttgcattgttctatgagtctgtttttatgccagtataatgctgctttggttactgtaatgtagtttgaagaggggcaatgtaatgcttccagcttcattctttttttttttttttgagacatagtctcgcactctctcacaggctggagtgctatggcatgatctcagcttactgcaacctccacctcctggattcaagtgattctcctgcctcgccctcctgagtagctgggattacaagcacacaccaccatgcctggctaattttcgtatttttagtagagattgggttttaccatgttggtcacactggtcttgaactcctgacctcatgatccgccaacctcggcctcccaaagtgctgggattacaggtgtgagccaccatgcccataatggttgaaagctttttaaacatctattgaaatgactttgtggtttttatctttaattgtgtttacatgatgagtaacatttattaattgtatgttgaaccaaccttttatttcagagatacagccaagttgatcatagtgcattagctttttgatgttctcctggatttggtttgccagtattttgttgatattttcatcaatgttcattaaaaatattggcctcaagttttctattttttgttttatatttgccagattttggtatcagaataatgctatttttatagaataagttggaaagaagtccccttttctcaatcttttgaaataatattagtagaagtggtaccaactctaatttttacatctggtggaattcagctgtaaatttttctgattctttgttgtttttggtgggtaggctatttatttctaattcaattttggagctcgttattggtatattcagggattcaatttcttatttgttcagtctttggaggatgtatctttgctccaagtttacaatcctcaagcttggcccagatgaagtctctacttatattcatgttgcctcagtttttttcttttaggtagacatattacttagaatgtgctagagcagcctctatgaagggatctcttctttgactgtactcggcttgctgtaatgcccaaggatgcagagtcaggctaacctcacctagaacctgcacataagttctggcctctgcctgggatttacaagacagggccagactttgggttgagaatgtactgaaaaccaacaaaaggcattttctgtattgtgagatgtcagtgtagaaatcttaaagcccccatttgagaatgtggctctttaagcttttcaatcttgttcagtgacctgctacagtatgtgagaggctcctggtgtaaatagaatctgatgatagaatctgtaagtgtaaacaagaatgagagatcaaggccacaaagtatccagagccataaccacaactatacctaccggtaattgtgatattggagtaaagtattctcgtccttcttcttacccaaaagctagcaaaaatcaggataggtgacccaggttctggggctccaccaaggcagttccattttctatttagaatcagcctgagtttctccagcctggcttatcactgggccatcagccctgggtcactgggaatcctctcctaatcacctgggtgtccttaagacatttgaggatgtcaagggtagaattatgtcaggctaacaagaatgattaattatgtttctgtctcgttgtaagagaaaggagacatcctgtgtttttttctccctcatacaagagataactttggttgttacccagatgagagtttctcaagttttctggtactagggtgaaagacaaagaggaggtctggtgactcaaacaaactaattgcttccacttcatatggtcattcaaaaaatagatgaagcagtcaaggtccctaccatccaggaaattttagtctagactagcaactggatacatggttgaattaagcattatatggttggtacagtgaatagaagtgtgcaaaaaaaccttggtccacttctttttaatattgttgtgacttctgaagttatcacctgaacgtatatttatggactgaagagttattattatttgtgtttcttttacttttctaagaatacatatttatcttctaataaaattatcctagaaaactttaaaagatccatttaaattgcttattagtatatgttataaaattgacagcagtggcaaaaatagattagtgttacataaactctgggatttaactttttttttcttttttcttttttagacggagtttcgctcttgttgcccaggctggagtgcaatggcgcgatctcagctcacctcaacctccgcctcccgggttcaagcgattctcctgcctcagccttccgagtagctgggattacaggcatgcaccaccaccctggctaattttgtatttttagtagagatggggtttctccatgttggtcaggctggtcttgaactcccgacctcaggtgacctacctacctcgacctcccaaaatgctgggattacaggcatgagccaccgtgccaggctgggatttaagtttttcttaggtaaacttaggaaaaacagaactggaaatactccagtgacatagaaaacaaattctacctaggttcttttccctgccccagttctgatcagattcaccatttttggaggccttatttaggtctggcctcactctggagtgttcccttacaaaactgatttataaagattcaagtttttgggggtaaatcctgctgactttctagagctgctgctcacagtatcctgaaacccaaaagcagatacataagaaaaataaactatacattttaagatcttaatttttaaattttgtagtaaaaccagtgcttacagaaacgttccatttagcagattttctgttcctgcagatccagtagctgctctacaagtcataaacaagtaaacataaacacaaaaaaatttctctaaactacattctaaatcctgagaattattgaacacttagtatgaactttcaaggtgttagtaggacataataacaaataataacacataatgtgttattcccagcacagtgctctgcaacatactattgagcacatagtacctgcttaataaacattgcattagttcatgtgtacatgttgttttttaaatgcagacttatttagacattgctgccttctgtgtcctctgtaaactttagagagccagcaaagaatatgaaactttacattttttgtctttatttgggtatcagaagtattgtattgtgacaagagtgcggcatgtaaaggactctgtgctgtgcctgctttctctaactaatgctaataatgagcccaaggggagcaacatcagcattgacacgggacttgtttgaaacacccatccatggaccctttccaaacctacagaatcacattacataaagtgggaccaacgttaccaagtgatttttgagctcattaaaggttgagaggcaatgcttagctaagtggttatcagcctagacttctcattagcattacatggccaatttgcagaaatctctttacttgtaccctttccacaggttctgtttattgttctaggtgaaagtattcatgttgttttaattgtgtctcatgtgactctaaggtgaggccagaatcaagtgtgtggggttcaagatacattcatgagagttaagttccacctttgcactaaaaggtagtcacagggaccgttctgtttggttttgatagggagaggtcagtgtcacccatatttccattactgtagcagaaattgctggtgtttgtggcaaaagcaggcacctgaagacagaaatagagaaacatatttttatattcattgagcagttcattgttcctgaatctctgctgttataaaggacagaaatgggtgtgctttttctgcagttcttagttcttttttctgtgggtgtgagactagcaggtaaacaggtggtgctgacgccttttaaggaattttttcaagacacaggtgtaacttctccagagaatgtcatctgaaaagcatttccaaagaagacaaaagaggaaaaatggctttttttttttttttcagctaaacatgtgtcagatgaagagctgtgtccactctgcctcctggagtgcgatgcatttagtccttgcaaacatttacttctctacttgtgtttctttcccctaatgagtttaactactataaaaaattcttgtggtagtcaagggtctctgcaaagtatctctctcctatatcccagagccttctctacactctctaaatcatggcttcttatacgccatgcagaattcttaccaggaatttttgatctgcactattaaaagtgtttcccttgttgctgttgaacgtggaaagatgtggatactcaagattcctattgggggaacgtccttagtaaggatggagaacatgtaatgttgaggtttcatatgtgttcttcattagctctgttcagaacaggattaagaaaatgcttatttaaactggatggcatttattactctgaaagttctgaaaaaaaaattattgcgagatacccgctttctagggtgctaaagaaagactactttaaattgttattaaaaattacagaacatagaagatatctgcatcttgaactctgcataaaactgatttttctgtgtggttaaattcagactatactttttggggggcaatatctcagtaatgatgctgtgttcttcggtgtgcgtcagcacatcacaaaaatttgtccttgtgcagttgattttaaaatttacttcaagagctcttggaaatattcatttcactgtagagttaattatttttctcctcattattaagtatctttatgtagccaaagaagagctgtgcataaatcatcacatttaatctggcagctgcctttctttcttaggttttctttgcatatgtctatctttagaaaatgaagactcttatctttgtttacaggccagaaaaatggggtaaaacacaggctcttccacttactggatgtttgacaaaatgttctttttgggcgaaatacattggcattactagtgagcttgttagaaattcagaatctcagactttatttcacatcttctgaaaaaaaaaaatctgcataagatctccagtgtattgtacacattaaaacttgagaggtgctgtctaactcaacatgtcatttttgcctaaaaaatatgcactactcattctttgtgatgcaaatataacactaaaaaatatacatgtttgtgttcatgcctttcgtttttatactttattgttcataaaattatcatatatacagcggtattgtggatcttataccattctcttctctcagagttagagaatacattagagaatatttctgtgttgaaaattgttggatgatttcagttattcctgtaagtcagaaccaattttctttactctctcatttaaccttaattcaaatgataaattctgcccgtggacacttgtaaatatgtgtgtgtgtgtgtgtttttcaggggccgttgacatttagggatgtggtcatagaattctctcaggaggagtggcaatgcctggacactgctcagcaagatttgtataggaaagtgatgttagagaacttcagaaacctggtgttcttgggtgagaataactttaatacacaattccttatatacactaaaggtttcatttctccatttttgtagaataatttttggtagtttatgctttgcataaatgcgtttctgatccctgttttcaaaaaattgcgaggaattatccatgcagaaaaaaatttcctcaagatgttttatcttagcctgaactttttgcattcctgagctggtctgtacccttcactctagagtagtggtaatctcagaaatttagtagtataaaatattgttgcccataggttaaaatctatttgccaccactaatttttgattcatgagcactgagtagcaaaattaaggacctacaaatttaaaatattttctaaatgtaagaactttctgtcattaaatagtattttgggatgaattttctagaatattctattacctcctctttactaagcacagtaataggtaggtaattagagaatatgagcaagattcatgttatttatttttaataaatcaggtattgatgtctctaagccagatctgatcacctgtctggagcaaggaaaagatccctggaatatgaagagacacagtatggtagccacacccccaggtaggtgagagtgaataaaacagttgacatagatgaaaggttggaagattacaaaaaaaaaaaagcagtccctataatgtgatttgggaagctgtgttccaaagcaaatagattctgggaagcctgaggtgtgtggtttttttgtttgttttctttttgttgttgttactgtcacatagggccatcttctgtcttaggcttttaaattctctaaggattctactttcccttcattgattttccttcaagttcacagtgagagccagagtcctcttcatggcatataaaagactgcacaatctgactgcatttccattgttttgggggacacacaaatatctgcatgattttgagaaactttatgttaaactatttttttagttctcttttgcatcatgtctaaaatgtgtgagagtagtggtcactgttctattggtttttatgttaattttctgcacattccatctttttttattagtatattcttgaaatatagtctgaaattataaaatataatgtctctctgctttgttctttttcctcaagattgctttggctattcaaagtttattgtagtttttttgttttgttttgttttttgttttgagatggagtttcactcttgttgcccaggttggagtgcaaaggcgccatcttggctcatcgtaacctctgcctccagcgattctcctatgtcagcctcccgagtagctgagactacaggcatgcaccaccatgagagtttttagtaaaaactcatgtttttataaaaagttttattaaaaaattggatttttagtatacttgccttggcctcccaaagtgttgggattacaggcgtgagccactacacccagcctttttttctattttatactttcattccattttggtcataggatgtaattcataaaatgtcaaatttaacaaatttttatgactccgtttttggcctaacaggtggtctatcaaagagaatgttgcataagctattttgaaggatgtgtttcctcatattcttgaggactcttctctatttctctgttaaaaataattgtacaggctgggcgcagtggctcatgcctgtaatcccaacactttgggaggccgaggcgagcggatcatctgagtttgggagtttgagaccagcctgaccaacatggagaaaccccatctctactaaaaatacaaaattagccaggtatggcagcacgtgcctgtagtcctagctactcaggaggcggaggcagaagaatcgcttgaacccaggaggcggaggttgtggtgagctgagatcgtgccattgcactccagcctgggtaacaagagcaaactccatctaaaaaaaaaaaaaattgtattatactgccttcagttcctctcttcacttactaatattctgtcttgttttatttttattacagaaagtggggtattgaaatttcctactataattatattgctgtctaggtgtttcttccagtctgtcaatatttgctttatatatttggaaccttagtgtgacatacacacagacacacagacgtgcacacacacacacacacacacaaaatttgtcataggttcccagttaataaatctattattgtttaatgtctttctttgtctctttgcagttttgacttaaagtactttatgtaagatatgacagtttttgacttaagatgtggcttttgtaatactattttgacctcttctgctctcatttggttaatatttgcatgcaatgtctaaatctatcttgccaccttcagtatgtttttaatcattagatgtcagctgacccttgtagaaaggcaaattggatcttggtttttaataattttaaataaatttctttattgaaagtatgtctcttgattggaaagttttctgaaacaaagagacttactaattttttttgttgttctatttgattcttgcatctttgtcccacattttctctctttgtttctctctgtggctgttttatttttactttgatatgcttttacttctttcttatgttgttttctgtgtctatacaggcatattctttgtggtacgtgggggattacataaaacctttaagagatacaatgtatttcagtctagttaaaaatgaacttttgttgcatgcaaaaattttttctcattacatatgttctcagatttgttcttgatgttgctaattatatttttatatgtatatttattaacatgtttataatgatttctatgcctttatctttcaaattttggggaataattaaaaatttcttctgtgccattatgataatgctaagaaatgtatttttgtgtatgtgcgtatctttcccagaaaataatgtgttttaatatgattttgtgttgctttgttaaatcatcttattttcattggaagcaactgttttcagcaccttttatatgtaaggaagtaccaatatactttttaaaatttggttatttttgaagtttgttttctttttatttagcaggacagatttggtgatggtattatactcacttgataactattttcttcagatttcactatatcacacagttttcttctgtcctgaaaaatttttgttgagaatccactggctatctcataagagtattcttgcaaataatatcactttttttttttttttttttgagatggagtttcactgttgttccccaggccggagtgaaatggcgcgatttcacctcgctgtgtcccaggttcaagcagttctcctacctcagcctcccgagtagctgggattacgggcatatgccaccacacccagctaagtttgtatttttagtagagacagggtttctccatgttggtcaggctagtctcgatctcctgacctcaggtgattcacccacctcagcttcccaaagtgccgggattacaagcttgagctaccgcgcccagccaacacatcacttttatcttgcagctcccgagattctcttttctgtgacttttaaaattgtgcttacatatgtgtttgatataaatatctttgtattctagtttgtttgttcagcttcttcatttttacatcactttttaaaagatttctgttattttttatatttttttacctccataatttctgtttttccaatattttaaatatttctgttcttatttccagttttctgattttctgtagttctctgtgttcatattttactcattgagtattcaatttattttgtttttaaaattaatgtatacattttttatttctttctgaaaaatttataataattttgttggtactacattgccctgttttgtatatattctaatcttttattaaaatttgcacatt

SEQ ID NO: 695 - DNA, 730736 bp, Homo sapiens
aggcagggggcggcaacatggcggagtgagcggcggcgtcggggcttcacaacaacagtggtggccgtagcagcggcggcagcagcgtcaatagcatcggccacagcctgagcttcagcaccggccagcgtcgtggccagctgctcgcgtcctcgggcttctcggagcggctgcagcatctccgcggggggcgggccgggccggacagaccgggagagggagagagcagaggcagcggcggcggcagcggcagcggcagcggcacacctgctgggcgggcacagccgcttgcccggcagcggttagcggtaccgccaccgccgagaataagcctgcggatcccccgccgcctccgcgggggagagcgccggagcgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctggtaaggaaaaggcgtgctctcaatctgcttccccagtccccacatacaccgtccccagcgcctttccctcccacccttcacccccagggtcacacgcgccgcgcgtccctgggagcgcagagcgttcagccggtattgcccagcgggtgacctgcctgcgcgctgctagagccacgccacctccctcctctcctctttctggtcctctcctgccacctgagcgcagtgcccaacttaacaccgcttcttctcactttttaggaccgcgagtaacccagtacccgcggtgaaggttttgggtcgactttagagtttagttaggaggtgaggaggcctcctgttctctggggttctttttctcacacttaattgtccttggtgtcgctctccgaggatgacagccttgcccctggagcctaaattcccccgtgctgctgaaatgtgagaagcgcattagcttccaacttgagcagctggggtgtgatgttttcgaaggagacagaaaatgatgcagttttgcatctgtctttaaatattccaaggccatgatggagagtgttgtgtctgtatccatccccctccatctcagaagcagccgtcccttctttgtaatattgccctgaatatactgatctcttagtcattttttgtgcacacaaggtgtgtgaggacaccaaatcacacaggttgatttctgtggttactttcagtagtgtggcatgtgggtaaagactaaaggaaaggttttaaacgcagccctaggttttggttcctttcatggtaagaaagagttactgcagaagtgtgtatgacttaatgttttgcgctatctacagagaggctcagaagcgtttaagatgtcagggaaagaaatggaaagaaggagaggagaatcatacattgaggataattaacagtagttcatatttagtgctttgtaaatggaggttttgttttgttttgttttgtttttaaatgcagccaagctttttaaacagttttctctgcaatagatctagtctttgacatactgtaaggttgggctttgggaggcaagacataaatcgagagcaatcagttgagtattgtatttggtgtggggtcacaggaatataacaatatgcttacaggggtactttgtaacacccatgcagtcatttttcagctaagcaattatttttacttactctattggaaaactgagagaaagctgcagctacatcagtggtgtcctgagacatgcattagataatgtctacggtttatgaacctcgtaaatgcacagaaaagttgaagctgtttttttccttttgctagtgtgtcaggtcaaaggagattatctgtctttgttatattcattgctgtttaaaacaaaacacctctttttacttttttgtacctttcaaataaatcatcatgaaaagtcagtgtaagtttgagggaatgtcactaagttgatataaccaagttcttttcagaacactactagaaatacagttttcttgagttttaattttaactagctgcaaataagaggtcagtacttgccatttctttttaaaagaagataaatctcaaactgttagtatgttagcaggtaactgtatttctgtaatttaaaggaacacatttttagttgcagttttgatctaaccaatatcatttttaagttagattatattaggctattttagtaagtattcctatgcttacttaatacattttaacctggtaagaggcagtagagctttcacaacctggaaactgatttgaatgtataaccagtttggactctgcagcagtagcaatgtgtgctgaatcagttcttaacagatggggttttttagatatacggtagactaagaaaggaagtgaaatgtttctcttgagataaaaaagaaatttaactcttcagagcaatgaaaatctgacatgaagtttcagtatgcagacgttattttagagaactttaccattaagcttagagtcactagaaataaagtaatactgagatagtatatccccaaatctacctaagattttgtaactgcaatgatatttggaatttaaagagttaggtttaaaatttctttgtatgtatttaaagaatgcaatagatttttaaatagaaacttttggagaaaagaataaatgacaaaaggagctgtttattactaagttgttaattatattaattgtggagtataaattagtcatttgaagtgtaattttcttgaactgtagatttagggctttattgtccaatacactcatgaaaatgtcatatgaaaatttaagtggattctcaaaaatatgtggaagtcatgggcatttaaaaaactgattatcaaacttaattctatttatttagtaagtaaaccaataaaattcatataggacactcagtgactcgttagagtttggaaacctttaatattaaatctaaaatgattttttaaaattttcagttttagtttaacacattaaataaaaatgtaaggtgaaatagtgaaatacctattactgtgccctgaatgacagaaaagaaaggagaactaatgaaacttcaaaaaaaagaggagtttctaccttaaacaatacctttgtctcagtcgcctttgtcagtatatttttctttctttttcctgtttattttttcttcctatgtaaggatactcataaatacttggtttttaggtgctgtttctcacatgccttggccaaagaattaaaagctgggcagagtgaagttttaagcatgcactaaagtgtaggacttcttcaacagagcggtggctgtaatttttctgctttgtttcccaaaggtctagagacctatttttactactaggtggattgtgggagtttggtgaggaatcaccaatgtgatatgatataaaattagtcatttttattagagatgtatgtattttgtataatgatgttatagttgacttaaaacagtgaaatatggaatggataatgttaggaaggtaggtaaattagtttgtgaataaagttacagtcagagtgcattgtcaaggattttgcattgtagctctactaatgaaagaaactgatcgttaacaaagtttggcttctggaggaattatttaaagtggcaatataagagaatttaactacagagaagagattttgttgattgttttcagttgtaaaactggcgtactacctaatctattacttcttttgtaaacacacttaacatatgtttatataagctttatccatatttgaagtaaaagctatgtaagtatcgtgttattgttgcttataacatggaagtttcttttataaacataaatttctagaaaaatatgtttataatagaggattaatatttacttagtgaaagaattcataatttttttggaatggctttcttatgtgtatagtataattctatgattataattatggaatttaattatagacaaattttttatgaataactgaattcatgaaattttttcatgaaattttttcatggatttgtagttttttttcatgagttacagtgagttatatcagtgtgtccagttgtagaaaatgatatttcctctgatttttttttttttttacattctaagtggcatgctgttggctgaactggaagcctaataagatgctttgaagggatttgtggtttaccaaatttctctcatcttggcttatggatcatggtatttttgttaaaagggtaactttaaggttttttttttttttgtacttgaatatggcagtaactcttcttccttagagtttttttaaatttgcagcttgatagtcataattttcattttaaagatatttagaattttacaaacaaggtgtcttctgcatttgaattatatttatttaaaaaatatacagttgcatcttagaatcatggaggtccttaatactaataaaaccacatttatattaaaataatttcctgcattttaatttatgttgatatataagccttttcatattaatttgagttgtattttattctcatgattgggtatggaaaataaaattcaggattcatatgtaaatgctcgaggtttcaatatcttaaggagttttgagattttccttagaaatattaatttagtcacataatgacactaaggcagcaaatattctgtggtcagtcaacgatcaagttatattaattttaaataaatgttttgtgtattgctagctgctttttggtaaatactatgctgctaattaaaaatatctcaaggttctttattcttttgctatacttttcccaaacagtgtgaaataatttattgggtctaacagacccagtgcccgttttgtgtcactggtatagctgtattataaaattcagtcacctgcattttttttttaactatatactgaacatattgttatgcattagttccaggttttccatttcttgtctttatacaatgtcagcatatctctttggcatcacatatcaccctgtagcattgcagttatttatgtgtgtttcccttcctaggctgtgaactccatgagggcaggaattgattttatgtatatttattttttgtatttctaggccttggataagttaagtgcgtttgtagtgtgcaggacactgtattaggcagtaatgattatggtcagtttctgaagttatgttcaacattacggtccagacttaggatcctgaaataaactcatatataaagtcaactcatataaactttatgtatttcttattcctcaaactagaaatatgtgttcaatgtgtatgatattacctgactgtgtaggcattactgcatatgtagatgttattttgaactggcatctgttagtaagttcgaatctggtaaaaacttttcagtaaacttttatgtataatcaaatataatcacataacaaggtcatgttgttaacaaagaaaatacgtaatgcattgaagagaaattgtagaaaatattgttagcatttgtcatattgccaagaatagtggacatctcttgtttttgtgtgtctggcgtacatgtcacctctttgtagtggtacctcagttttcctttgatgactcacttattccccatttgtagttcagctggtttaggtgggtctaccccactgcctgccttgagggtcagacatctaacctaggtgtggcaagaattgtggtgattggttcagggacaaacatttaacccaagggtagcgagccagagtaggttccaggaattgtgctggaaggctttctgatggggatgctgaatgtgtaaattcttaagagttgtaggtccctgtcttagaatttgatcaggtgtaaagcaaacaacctcatgattctgttggagaacctagagttctttatgtctgtggtgattatcttctaaccattaaattatctcctttaaaatttactattgttatttatttcaaatcagtgtaagttgggttttttgtcacttgtaaatagaaggaatccccagtaacatagacattagtatctggaaatgacacattgtaggaaacagaccttagattttgaaatggagtggaaggcagtgagaactttgtggtcctctagcagttccgttttacagagcagctgtttaaattgtcacctgtgttatctttgtcaatggaactactgaggttggaattttagggatgttggaatgttttggtcactttttggggtctttgatacaatgtcttttaagagagcagttaacttcggtccaagttagcatgcttgaaagcaaagcagaaagaaaatgtagcctttccaaggcagagaggctctttctgcctgtagctgccatccaagatagcagagaattagaatattaaagctttgtaggtcataaaggcctaagtttttaccccgtgctaaagttggcaagaggaaagccaagagtttaaatgagaaccaaataaagttctgtctgataagcttctcccaagcctcgcatgcagtatacgccagccttctgaccaaagtaacagtaatccagttgtgaagagctttaaaataggatgcaaccagggagcaagtgatagaatagctgtgcctcctcacccagtttattgtttcacattgcttcaaggaagatcattaagctgacggttaaggggataagagtactgggaaggcctattgctatgagactgaaacttaaaagctgacaagatcctgacaggatctcctgttttggttgcgaattcaactccttttacttaagtaaattgacgaaaaacttaccaaagtttaaggaagccatacttctagagaaacctcaagcctggtaaacaaaggcctgcattcttttacttctaaggcaattctaagctccagcagtgtagctgctagaaggaaaatctgcgttatggaggctaataagtgagatcttctgagatatagtggtagtgaatgtgttcattttggccgacccaaggaattccattagcaaggacagggaattcttgttactctgaccaatgatatatggtttatgctttgaaattagttatcatggtgtttctttaaccttctccagtcttctaagtgcagttattgtttcttaatgttcttttaccattgtatattaattagaagttatagttaaattcattatatagctatataattggtcaggtttgaggtaccaccaagaagaatattgtcataacacaaaaatttcagacttgaggttagatgcagtaatttgtctttgtcttttttcaccctctggtaaggtggtaagtacactttctattgtgtctaagatagccatgttaaacatggatatttaagtagttatatgtatgaaaagaagtgagtgtctgagatgggtgggtagccaaggactctaatgttatagatttctgacggttttggctgcctagcatccattctttctgctgttaacattctcgattttttgatactcttttagggagtcattcttgatttttatggtctggggcttcactggactttatcctgctttcctggaccagacagagaaactgacgtctggcccaacagtaactggtattggttataaaatttagctgcatttctgagacagcttgataacttctttctgaagaaagaaaaaggtgctttcgctggggttgctgaaaatgttagaatgtaagtctagaattgattgcagtctgcaccatgaagtcagattctacttgagaacagagctgttaaagaggcacctaaaaccaagccatacattgctgatggcagctttggatcccctcaagtcagttttatctccagatgtttcagtgcatcattttgccttaagccagtttgagttgggtttctatccatttgtgccccaatattctaaattaaaaaatatttaaatactaatgtttaaattaaatattctaatattctaaattaaaaaatttagaatattctaattttctaaattaaatatttagaaatatttaatttctaatattctaaattaaaaaaattttaaatactttaggtattaaatattacaggacgaagcataagaaaaatgtttacttgtcaaagaacttgatatatttcaagaaagaagaaatatacatgtttaattaatataaaaatactcactttggctaaataagaacataaggcaacagataacatgaaaaggaagtgattaaaaagaaatgaccagctggtcatggtggctcatgcctgtaattccagcactttgggagtctgaggtgggaggattgcttgagccagggagttcaagaccaacctaagcaacaaccctggaggttgagtctgcagtgagctgtgatcacgtcactgcattccagcctgggtgatggagtaagatcctgtctcacaaaaaaagaaatgatgattgtttgctagggcaagttaaaataatcttaaatgctctttctgggctcgtaaactgttacagctattccgagtgacattttaccaatatgtatcaaggattttaaagaggttcctataatttattcttagttctttaggctaaggaaaaaaatacctgtggacaggtatgaaaattaagtgtatttttatgatataacatgtggcaacaacttaaatgttcaacaataggaaaacattaaatatattatttttacatccatgttatgaaataacatacagctattaaaacattctgtgcctcagtttctttgtgtgtaaaatgggatttcaaccttataagatagatatacaggttgtacagattaaatgggttaatatatgtaaagtgcttggtatatagtaaactttagttagtacttactattgttgttttagttattaccttggtcctgagaatcacctgaccatagaaagaagtaatgacctaactgaaagtgatctgtcctattttagcttggagtacctgagcctagtgacctgtcagggaggggactcttaggtacacacagatcatgatctcctgctgaagcacaggacatctgttgtcttgaatcctgcatagtctttatcagtgcctgaggtagtttttctgatttcttactttgcatgaggagggtgagaaactggggatggaagaggcaagaggtaacaccagttcctttgtgtggagtctcttccatctcttctctcacagggctgactttcacatgttgatgtagtaagacatgaatggtgatccaaggcaaatagtaactccctctgggagtatttgcttaaatatttagaagactacttgggtaacaagtctaaggggcaagttaaaggattaaaaactaatttatgactattttagaaactaacattagcctatagtttaatagctcttaactatttacagtacacttgcggaattgaacacagcagtgtcctctaaccctcagaataatttccttttatagataccattcctgctttacatatgtagaaactaaggctgtagaaaatgtgaagtaattagacaaggttatctaggtactaagtagcacagctgggactcagaccttcaggttccaaagctagagttctttcccattactaagcaaatgtagctagtacttagaaattatcccaaaaacagcatgtatgaagagatgatgttggaaggggagggaccagccagcctcagtgagttgattctctggtagggaatgtgtcccatagacaacttaggacaggctattcagaggaaattaaaaatgaatgcaggtcaattgaatggatttgtacactaaagtgacttagcaagaactgtaccatgagttattaatatttgagttttaggaaataattggttatgtggtaaatggctttgaattttatacattttcactgggtataatgtggatacttgagggattactctgaaccagaatagtagtatgcattaatatattatacagaaaaagtaaattcgtgattttcttgttatatattggaggtaattatttgaaccactgtatataccatatttgcttgaataaaacaaatgagttatagaaggaattatactagcatctgggtaatataatttctaataattgtgatttctctttcagtttatgaagatagagcaaacattggttaatagcaaattttatgggagtaaaaatatctagatatatttctctttagcaaatactttcattttctgagaaaaataacgcagcagattaaaagatggtatataaatatttttatgttatttaatttttttacatttgggaagggaattggcatttatagattgggtttgggttcatatcttatgtttttaatgtcctcttccaactcctttgaaataataactaatctataactgaggttaaggagcttgtccaagatggcaaaattgcttagtagcagaatgagatccaaagttggatcttccatttccaagttttgctatttaaatacaccattacctttgataatgatgatgatgacagtgatagaatctttacatgtcaggcactgtgttaagcatatgacctatgttatcttatttaatcatcttgacctatattgtgaaatattcagtgaaataaagtaattgtctttttaagctaagcaagtctgctgtcttaaaagacaagtgttttcaactctgaatatataaacgatacttgattataaaatgtcatagaattatttcacttaatttatactaattctttataacttgatccccctttcaaagtccttgactttaaatgaagtatttaaatttttttaaccttaggagatatgagttatcagtacaagaatgttccttttattataatatattgactgttacttgatagttgttacatttctcaagtcatcatattcttccatcttttgtctaaagaacagctcatctttcaagatttagctcttacccctatttaagtgacgtcttccctgatattcccctaaaagctattcctcccaacatgtactttcccatagaattttatacatatttcagatttagtacccacacattctattttaaattacagttggccctctgtatccatgggttccatatccgtgaattcagtttggatagaaaatatatgagaaaaaaatggatggttgcatccatactaaacatgtatagactttttaatcttgtcattattctctaaaccaggggttcccaacccctgggccacggacctgttaggaactgggccgcacagcagaaagtgggccatgggtgagcgagcattaccacctgagctctgcctcctgtcagatcagcagtgccgttagattctcaaaggagagcaaaccctatcatgaactgcgcaagcaagggatctaggttgtgcgctccttatgaaaatctaatgcctgatgatctgaggtggaacagtttcatcccaaaaccattccccctgaacccccctattcatggaaaaattgtcttccatgaaactggctcctggtgccaaaaaggttggggatcgctgccctaaagaatatagtatagaactatttacatagcatttacattgtattaggtattatctggagaggagttaaagtatacaggagggtgtgcataggttatgtgcaaatactataccattgtataccaggaacttgggaatctatggattttggtaaccacagggggccctggaaccaatcccccagagatatcaagggacaactgtgtttgtttacttatcagactgcactagaggctctgaatcttttgaggatcagcacattatcttaccttgctattatgagtatttaacatagtatctggcattttgtggtgtttagtgaactttactgtggatattttctctcatctttggtatagttagtttgcttgtttcagtcatattcagcttcggcacaaatcttatctttgcaggctattctgattcttttaatttctacattttcctcttgctttaacatttcagtttttatttttgagtgggggatgattggtgtacctacatgtatgcagttgtcccttggtatccatggaagattggtttcaggacccctcaggataccaaaatccatggatgctcaagtcgtttgtataaaatggcatagtatttgcatataaccaatgaatatcttctcatatacttcaaatcatctccagattacttataatacctaatgcagtgtaaatgctaggtaaatagttgttctgttgcagtgttgagggaagtgacaagaaaaaatgtacatgttcaatacagatgcaaccatctattttttaaaagaaatattttcgatcccctattggttgaatctatggatgtagaactcatggatacagagggtccactgtaaatacatggtttatattttaaaaaaagttttctggatatttgagactggtaaggagtcagagtgtttttggatctggtcaatggcctgactctttcacttgcatagatgaggaaactgagaaccaggtaggttaagattctatggtccttcacagactaggaattaacacccagattccctgacccttcgtccagttcttttttcattttatcttgatgactgtagttctactttgcttaagctcagtttctgctttataactttcatatggaaacttccgtttttactccagcaggctcagaatacttaaaatgatagttaaataaattactgattaatcctaatctagtgtgctattgctagagtcaagatacttcttgggtacataaaagagtaacataattcataccttcaaataacttgaaattcagaacagggaatggaagaataaacagataaattataatggatgaaagtgatattgtagagatagaaacaaagtgctgtgggaacattaatggagctcctaactttccttggaggagttgggaaggcttcatgggtagacgtcttgtgaaagggatctcgaaggacaagtaactgttccaggattaaaagagcaggaaaagaacagctttccacaaagggatagcttgcacagtgacaagagccacgaaagagtgttttcatggttttttgccttaatgctaactatagactacagtaaattaaatcaactttatttctttttgtagaaatcatttttttttaaaattctagtagtacagttgaccattcatatctttcagttaggaggagttaattaccccttcttgtaggagggtcagccttttgttctgtttaggccttcaactgattggttgaatgaggcccatccacattagggagggcaatctgtttatacagtatactaatgcaaatgctaatctcattcaaaaacaccctcacagacattcagaataatatttaatgaaatacatgggcattctctggcccagttaagttgacacctaaaattaaccatcataagaggtatgtattttttctatcaactctcccttttatttgactgttgaaagatatattgttatacccattgcagaaaaattataaacctgtgcacatggtaggcatttaataaatatcaaatgaatgaagtacaaaaatgaatgagactcactggcaaagaaaaaagacgactttaattttgagtatattgtaattctgaagagaatgtaaagatgaatagatgaaaattaacattttaacatttggcatttacgtttattttcagtagtctttgaggtgaatgatgattaactttttaaggaaattagtgttttccatttataaaaaatgaaatttatatacaaataatcaattttttataagagcaaaaaaacaatggttttgaaagtcagtgaaagttgtttttttttttttttttggtcattaggtttattcccaggctggcctgatatgttcaaattcttgatatctttatctttttatagaggtaaaatatacataacatataatttatttcaaccctttttaaaattttgttttcaattgacacataattgtatgtatttctggggtctaatgtgatgttttgatacatgtatacattgtgtaaaaatcaaattggggtagttagcatgtccatcacctcaactatttataatttctttgtgataagaacactcaaaatcttctggttattttgaagtacacagtacaatattgttaatcatagtcactgtatattttaaccattttaaagtttacagtttggtggcattaagtgatttcacgttgttgttcaaccatcatcaccatccttgtccagaattttttcatcttcccaaactgaaatcctgtgcccattaaatagtaacttccatttctcctctcccaacctcgggtgatccgcccacctcggcctcccaaagtgttgggcttacaggtgtgagccactgcacccagccaaaagtaatttctacaggactcagattctttagttctgtttctttaatatcatgtggaatatatatatatatacacacacacacacatatatatacacacacacatatatacatacatatgtataaacacaaacacatacacacacacatatatatacccaccatagtgatatttatttaaaaattcattttttcccttgcatttgttttgttctcatagtagagctactcttgattctcttatcttgaaacttctatgtattgctccacacctagccctaaccctgtattttcatagtattccatttccttcatctttattacaaagcttaaaataattaaactgggaagacagtcttaaaaggtgagggaggtgaagagactcagcaggccaagccagaattctggcacaggaaaagaaagaccacgaacactcacacatgtataatttttgttttgtcacctaaaaatcgatttgtggacaacaaaactaatttgttatgtatgattaagcctgatgatttcacttccttactgaatattcagcagtgattttatcccaagtcctcctttatctaaagcaaaatacctgtaattcatcttttccttaagagattgtaaacatgttacattaaacaatctgaattttaacattaaaaaaaggtaaagcaaaaacttctatttatctttcatactacctgtctatttataggcttctagagagcatgaccaatatctatttgaacttattttatataacatataacttctgaagatacgtgttttcgctacaacccctttgtttttgtatttttaagaaacaacataaatttattacctttattatagtcctagctaatcttaaataacttacgcaagacttatcagccatggatatatttataactcttttgagtctatttatagctttatttgtctctttgtttgcttctttttgtttgtgtacagctatactatccagtgtggaagcccatttcttgtggcggtgagcgcttataatgtggcttttgagaattgagtgttctttaagtgtaaaatacacaatgaatttcaaagacttagttaaaaaatatatcttattaataatgttttatattagttacatgttgtagatatattgcctttaggttattttattataaataaagcatacttattaaaattcattttacctgtttatatttcttttaatgtgactacttaaattttaaaaattatatatgtacctcacattatatttcttttagatagcattgttctaactgaggtaagtcagttgttaggtcttatattggagactttgggagacaaattcatattttacatgattttatgaactataatagtcacttgtcctttatctttggagcaaaaacgattcatttttatttataatgaaattagaggatattcatcagtaagaaggggaggacagattcagattaagttttgactgggggaagtgacaatgggaggagaccctctaatgcctggtaaagtcaggcctgttatatagtaaacatttgatacatattaattttttaaaaattgggtcaggatttgaagaaatagtaataataggatatttcacaccatgaatagagttatagtttaaatgcataggtgtaagtttaggccctggggagactggaggtgcttttggtttttactgcctgcccttgagagtaggagctagaactccgggcatttgtgaaaaatgaataagagaaaaggtggaggaagggatgagagtaagtaaactgagagtgtttggaacttatttctaatttttgcagtctcataaaatttgatttccaagaattgcaatagtttatcaaagtagagttaaatggcttgctaaaactgagaagaaaattcaagttggtctgatacagttcagtattctaagatcaggatcaccatgaatatggatttttccttaactgttttggtagcagcactattatgtcaaacctttctttttctgtaaggatatcctgtcccctcaccacctcctaaaggaattgtttttttccttcctgcaaattgagttacagttttccattaatctgcaataaaaattgaaagtatgttacagaaaaaataccttagaagccaggtcaaatagtattatatgtaataatacagtaactaattatgaagtgctatgtttatttgtcgtgttttttaagagttgaggtttaatgattcttttttttaccaaaatgttacttttcatattgtaagtttctttagagtatctattgctatgaataaaatattctaaggtgtgaattttatgtttttttcgtaggtgttaatctgttcacatgcttgtttcattgctgttgttgttggaagtcgtccacctggcagacaggaagctctgcttgggtgggattggaggtgcagtctttcaatactggactatactaagtatagattccaatggcaatgtaattccatttccttggcctcattaatactacatagcagttcaagattcctggaatggtcataaaattcttttgaactattaacagtttctcatccaggccttaggataaaaaaaaatgttcatttttagggtgactgacatacttattttaggagtctgttgagtagctgtgaagaagcattttttctttttaaaagtactcatttccataagtgtcatagggagtatgttgagcgaataggttttggtcagatttgctgatgctgcataatgacattttggtctacaatggaccacatatacaatggtggtcccataagattatgatggagctgaaaaattcttatctcctagtgaagtcagagatatcataatgtcatagcacaatgcatcattcactgtggtgatggtggtgtaaacaaacctattgcactgctagttgtataaaggtatagcacatacagttatgtacagtacataatacttgataataagcagctatgttactggtttatgtatttgctatactgtactttttatcattattttagcaagaactcaagcttaaaaaaaaagttaactgtaaaacagcctcaggcaggtcttgcaggaggtattccagaagaaggcattgttatgataagagatgacagctccatgggtgttgttgcccctgaagacttttcagtgggacatgatgtggcggtggaagacagtgttcttgaagatcctgacacttcgtaggtttaggctaatgtgtgtgtttgtgtcttagtttttaacacaaaagtttaaaaagttaaaaagtaaacatagaaaaaggttatagaataagatacaaagaaaatatttttgtatagtcatataatgtgtttgtgttttaagctaattattataaaagtcaaaaagttaaaaaaatgaaagtttataaagtaaaaaagtttatagtaagctaagtttactttaatattaaagaaataaacttttttttgtaaattaagtgtagctcaagtatatacattttataaagtctgtggtagttattgtaatgtcctaggccttcacattcactcaccacacaaccactgactcacccagagcaacttccagtcttggaagctccattcatgttaagtgttctctacaggtgtaccatgttttatcttttatagtatatttttactgtatcttttctgtgtctagatatgtttggatatattaatactattgaattataattgtttatgcaatacagtaacatgctgtgcaggtttgcagcctaggaacaatgggccataccatagagcctatgtatgtgggctgttccatctaagtttgtctaagtacactctgatatttgtacaacaacaaaatcaactaatgacacatttctcaaaatgtatctctgttgttaagtgatgaatgactgtattttatcctagaaataatgtttaaccttattagtgatgtgcactctgaaagataaactaatatattttagttactgtatgacaaactgtcactcagtgtgacagctgaacccaattacattgaaaaattatgctgccaaactctgaaataaattgaagatgacctggctggaaaatataggatatagacatttacaacagagatttgaattccaacgaaagaatggttgtagttttggatcggtatgcattttatattttagaaccttaatttattatctgtgtatgtaaaaagattagagcggtattagtgggaagattgtttatgggaataaaatttaataattagatgtgtcacacttgtggcatgttattagttgttaaagagggactctattaatgtagcttattcctgagaaaaaaccacaagtctaataaaagttttgctttatattattatcaggatatgatcagatattaatgtttaacatacactcataagttattaaattatatcattgtccagttttgactcagttattcagtgtgggttactatatttagctcacagatgatctattcttttgctcctagctatttctctgtggcttcccctcctcctgcacgcacccccatataaataccagtctattggatctaaatatgtatattcattttcaatctaacttcatatctggtcacatatccattttatcccacaaacttttattgattacttaccgtatgtaaagctaggcacttcggatacaatgatcaagataaggtctctgccctggagtttatagagttgtagagggtgacaaatatgggcaatgagatgtgtaaattctatcatagaaatcaattagggtattgtgggctacactgaaaaaagaaatctaccaagtaagtcaaggtaagtctttataaaggtgatgaagcttgagttgagttttgaaagatggctagaagctagatctggctacagctgtgtggtccagcatggcggccactagccacacatgtggctagtgagcatttaaaatgtccttagaatataaaatgcacacttaattttgagggctaggtgtaaaaaaaatgtaaaatatctcaataatttcataatatttactacattttgaaatgatattttggatatttgggtatatgtactgagttaatacaagttaatttcacctgttttattttacatttttcttttcatgtggctaatagaaagtttgaagttatgtatatggcttgtatctgtgacttgcgctgtatttttattggctatcagtggtctggagatttctgaaatttttaagatttttaaattagatgaaccattagaagtatagaaagaaactaaaatatattctagcatgccctctttttctctctatgtgtgcatatgtgtgtacatatgtgtctatatatacacacacataacctttatattgttcaagtcattcatactttgggttttctggttatatgtcagtaaacctcatcctaacagatacattgaattaatagcaacaatttaaaaaccacagaccactggggaaaaacttgttctccctactctggcaaaaattgcttaaataattcatggaaatcaatatggcaacaaatttaaaatacattttattgtcagcaaatactttgaaaggaaaattgaaaacgttacagagttgaggaaacaattattagaatcaaatgttggagtttgttttaagtacaatgagagtactcttattcccaacatgtttttatatattatttgctatattgtgtttcttaatgaaataaacaactgctttttgtgagctctataaaaatatatataagtgaatgtacactttcgacagaaattcctgtattccctgcttattgaaaccagaaatcaagaaggaattctacctttacctggaaagcagaagatgtgttttgtgaagatttacttgacttatcagaacaagtctctcttccggtatttagattgctactttgtatattaactgtcaggggcaccatattttaaacaggactctgaattgaatactagaactccagaatgctggtgcttgataagattttaaagattatttagtttttcagatgtggaaacctaggcacagagaaattactgatttaatgtgggatactccgattttaagttgccatactgtggaactggatttcaggtgtttgattttctagtctagcaatgatctctttggttatattaacgtgagtctcttgggtttggctggtgtattagtttactggaggtgtcatgacacatactgcagactgggtggcttaaaaaattgtaatttattttctcacagttctagtggccgcaggactggtttcttctgaacctttctccttggcttgcagatggccgtcttttccctttgtcttcatatgtgctttcctttgtgtgtctatgtcctaatctcctgttcttatgtgaacatcagttatattagattagggcctatccatatgatttcattttatctgacttatctctttaaaggttctatctccaaatgcaatgccattaggctgtactgtgttccccccaaaattcataatgttgaagtcctcacctttagcatatgaatttttggggggatacagtgcagcccataacagctggtcttaactaagcgaaaataagggtaaaatgagtgatagtgataaaaatgtaaggtcttttattagtaatgctttacttaaattcctgtaaaaatgacagttttctatttgtaaacccattgcttttttactttgaattatttcatccttttccatgcttctactcttttcttcccccccccgatatatttttattctcacatgccttcatctgtgcatccaaaggcactgttgattcagtagtatcagcggaaaagcccaaatagttttgactccagctaattaaaagaaaacacctttaaaaaatatatgctgcaatgtttgtagaaaatctaggtcttacttttctttattaatatcaataataataaaaataataataaacctctgttaagtgcatattaggtaccagggattttgctaaatgctttaccctatgactttggtagttttatagatgagggaactaaaggttaaagaaagtgaaataatttttccaagatttcagagcaaataattgttaaattaagcttcagacacaggcagtacttgctatgcttactgcctgttttttagaattcttaggaatttaacttgcaactgtctcgaatccaagctatactctgattgaaattaagatatggaaataacatcatatgttgatagcttttgtggtaactatcgtgtttactatggcaagcattcagcacactgagctttggatgtttaaatatattgaagctttgattcttgaagtcctcaagaatctgtttgcttacccaggcacaaaatcactcagcatcttcacttggcacataaatgctaattcagtagcatgatatacatggcatgtcataatttgcccctgcctgtctttctagtgacattttattttttctcatagctctacactctttagtcataataaactactacacttattttctggaatttaattattcttatggctccttggggttgctcatgttccttagttccatttaggaaatattttattgattacttactaacgcacaattcaaggtttgtttgtttctgtctgcactattgagagtgatgttggggcccaaaagaccaaaaaggagttgtttacaggtggacttggactgttctgaagagaatctgcagatacctatttgtgttttgctaagtggagcttaaatgacaatgggccacaaggagcagggctacaaagggaagagcagggggagaacgttatctatgtctctgggtccattagtaggtacgtgcttgatcccagctggatcaggttaacactggagcagaattaggaacagagggcaatagaaacagtgagtggggaaaggattattgtggtgactatcactttggtgctccatagcggtgcctagagtagaggacccatcacagaagtgttctagcaatgacttatctaggaaactagctactgtaaacttggttatttgtttatttcttcagacttggtgatacatattatggtcttccattaacattatatggtatatgtcagcagcattcttgtatggttttaaaccctgacagaactataaagaccttttggtgaggagaagcagattagtttaaacatacttgtatttctaggtagttgatgggagcatagcatagggatggtatgcccaactctgaggacagaacaggattgggaagatgattcttatctttaaggatttcaagatctaataagagagactaatgtgtaaattaaaaaatactaaataatgtgttcaggccttagtggtaggactagtcagaattcaaatcctggctcttccctttctttgcttgtgactgagtgaaagtgtgtattagataccacagtatcacagagaagaaagcaatgaactatttgaagcagttgggaaagacattaaggtggaggattcccctgagattggctcgaaagggtcagctgcagtttgcacagtagactggtggagtgagggcattccagataaagaaatctgaattggcacagtgtattctaaatagtgttttcttcctagaaatgtttttctttcccagaaaattcatacatattctttagatttagcttctatatttttttatggatccttgtttaactcacatctatctctcaacctcaggagtcacatggttggcaaatgcacttggttagcaaaactgcagttgccatgatcaaggtctcctggatgacaaggggtgggaggaggagaaattaaggtaatgcattaaatgtgtatatttatttataaacacataactaaaagttctggaaaacagttgtttccaaaaccagaattatctgttgttgtttgtttgtaccgaatgtaataaaatgataatgtagttacaagtttttgtaaggtatgttgctaggctgttgactgttttgatttaatattagtaggagctcttcatgagaagaaacactattacattaaaggtatacatcaattatgagttacatgtttatttcagaaatgttaaatatgaaaaaatgtttattggaaaaaggaaatatggtattctgaattaataactttatgacataggcatttgtattcccatttgtatataagaaaaatgaagtttggtggaatttgaagctaagaactttgggcaatatggagcaagaggcttttataagagagtggcatgagtgaagtagtgtgcccattgcatgtagattcatctgattggatagagtagtgtcctcttatcctttcagtgtttcttatatttcttttcctgaaacgggacttgtcagagagcacagcctcttctgtagcgaagtatgtataagttgggaggtgcttctttctagccccaagttgtgcttgtttctcttaggtcttttataactgtaagctgatgtacttgactctctacatttatatttgtaggattaatgaataaatactattagaatccaatcagtttttgtgtcctggttttctgtaaataacttggcctttgtggtatgactaatctgaatccaaatcctggtctgtcttttcgtggctttgtgaccttcaactatgttacatatctctgagcctgtgttttttttttttttctctctctctctctctgtgtatgtgtgtgtacctgtatattctcacatatatgaaaatgaggtaaatgatgttatttttccttttatttccctcataagtggaaactgtatatatgagagaattctatatataacagatcattatattattgtttctgctactatactgcatgttcatttagcacatttattagtcaaaatgtggtccacagatgaggtttgcatattcatgaaatatttgctgttctaagaggagataaggaacttgtgccagaatgcaaatcatctgtgctaagtacactatttctttcaactaacctttcttttttttttttttttctcataacaagactttcttgatgaaggaagcagaatgtcgattcatattttacttctatctcctcattggctggcactctgagtagcctgaatgtagagtgctttgggaagatattttgaagaaagcttaattttatttatattacttttcatttttggtgttagaaaggtttgttattattagtgaaaaggttattaaatttgaacttggattctaatcgtgtctttgctactgattagttgggcaactgaattaaatcttctaggccttattttcctgacggaaaatgaaggttgggttagatatctgtggtttttgtaggctttaacatgttaataattatgttttttaagtactatttttttcttttacctttttttttttaaaaaagcaaaactgagacctcgtcaaagtagtagataagaagcactgcaatagaaacatactttaagaagcctctttttggaatagatgttttattaagctgtagtcaaccatatggcaaggatttgatgctaaggctataatgattgagactgtttttgtcttcaagtagtaatatcctgggaaagatagacaagtaaatacatacaaatgtaaatacataaatcggtagtgtgttagagatatggaccaaaaatgtgtgaaacaggaggctgtgaaagactctctagaacaaaggtaagcaaacattttctataaggatccaaatattttagcctttgtgggccacatggtgtctattacaactactcaccctgcagttgtagtggaaaggcagccatgtaaataaaaatacatcatttttcaacaccaattctctggcactaattaagtgtcctaaaattcaatcctgatactacatagagttagtgcaaacctcttaaattagaggcagaatccttcaattctgacactaattgaaagttagtacagactccacaagttaaggagccagtcccacaagactgcttccatttcagataccagcctgaaataggctacctgcacttctgctcaactgaccacaaattcagaggttcccacaacttccctcaggttctgtaatcactagaatgactcagagttcaggaaagtgctacacttacaattacagttttattataaaggaaacagcttaggaacagccaaatggaagaaatgtataaggaaggcactgagagggagtgggctatagagcttccatgcccttactgggcacaccaccctcccagcagattgatatgtttgccaacctggaagcatcctggacctcgttgtttgagttcttatcaaggcttcaattatgtggcctgatttatgggccacgtaattgaactcaagtaccagccttatattcacttgcttagttttttttgacttggccagcccttcccttgaaactatctaagggccccaacatgagttagcttgttagcatgagctcagctatggtcaaaagggtcttgttatgaatagcaaaggacactcttatcacccaggacattctaaagatttttgaagttctgtgccaagaattgggggcaaagaccaaatatattttaaattatacgataggcagccattactgatatgtaaatgaatggccaatggccgtataataaaactttatttacaataagacattgagctagaactgacctataggtagtagtttgcagacccttgctttagaaaaatgtgaaaaactgctgaaagaatgtgacatttgaactgtttcttctatttattttaaactttttgctgatatgatactattttatagaatttttaaaatttattttcagtagcactaatagatttttttaaggtgctatgagagtgagtaaggaactttttttaaacacatatgctgtgattaatgtgttttaatatcaattattaatatcaattgattgttaatatcaattgattattaatgtgttttaatatcaattgagaaggacttcagttaagtcctctttgtgcctcttactccagtaggtgggcttgaaaactacctactggatcacaactggtaggctttattctcctgagtgatcatgacttttatcacattccttgattagtgatgtttctgttgagaatgctgtttaccttctgtcgtttatgttttgcatttatattttgcatcccactcttgttttcaacatagtgaaaggaattagagccttgggttggagttttattcctctgacttaatgggcctgtgactaggcaggttccacattctgagagctgtccagtgagggattagaaattcgacacttactgctgtgtaataagttaaagcatgaacatttaaaattttttggtttttaaaaaaaaaaaactaaaattttttggtttccgttttttctttttttctggcttgatagttttattttttattttttaacttttattttaagttcaggggtacatgtacaggtagagtgcttttgggagatattttttacataggtaaatatgtgtcatgggggtttgttgtgcagtttatttcatcacctaggtattagcctagtagacattagttattctttttgatcctcccacccttgaccctccgataggcccagtgtgtgttgttcccctctatgtgtcagtgtattcttaccatttagctcccacttacaagtgagaacatacagtattttgttttctgtgttagtttgctgaggataatggcctccagctccatctatgtgtctgcaaaggacattatctcattcttttttatggctgcatagtattccatgctgtatatataccacgtttttttttttatccagtctatcattgatatgtattgaagttaatttcatgtctttgctattttgaatagtgctgcagtgaacatatgcatgcatgtgcctctgtaatggaatgatgtatattcctttgggtatatacccagtaatgggattgctgggtcaagtggcatttctgtctttaggtctttgagaaatcattgcactattttctacaatggttgagctaatctgcactaccaccaacagtgtataagcatttctttttctccacaaccttgccagcatctgttggtttttgactttttagtcatagccattctgcctggtgtgagattgtatctcattgtggtttagtttgcatttctctcatgatcagtgatgctgagctttgtttcatatgattgttgggcacatgtatgtcttcttttgagaagtgtctgttcatgtcctttgcccattttttaatggcattgtttgttttttttccttgtaaatttgtttaagtggcttatagatgctggatatgagacctttgtaagatgcatggtttgtaaaattttctcccattccgtaggttgtctgtttaccctgttgatagtttcttttgctctgcagaagctcttatttgtcaatttttgcttttgttgcagttgcttttggtgtcttcatcatgaaatctttgcccatgcctatgtcctgaatggtattgcctaggttgtctttcacagtttttataattttgtgttttatatttaagtttttaatacatcttgagtttatttttgtatatggtaaaaggaaggagtccagtttccatcttctgcatatggctagctagttatcttagcaccatttattgaatagggaatcctttccccattgcttgtttttgtcaggtttgttgaagatcagatagtggtaggtgtgcatcatatttctgggttcttttttctgttgatctgtgtgtctgttcttgtgccaacaccatgctgttttggttaatgtagctctgtattatagttaagttgggtagcgtgatgcctctagctttgttctttttgcttaggattgctctggctattcaggctcttttttggttccatacgaatttaaaagtagtttttttctggttctgtgaagaatgtcaatggtagtttaatgcgaatagcattgaatctgtaaattactttgggcagtatggtcattttaatgatattgatttttcctatctatgagtgtggaatgtttttctatttgtttgtgtcatctcttgatttctttgagcagtggtttgtagttgtcactgtagagatctttcacctccctagttagctgtattcccaggtaatttattctttttgtggcaattgtgagtgggagtttgtttgtggtttggctctcagtgggactgctgttggtgtataggaacgctagcaatttttgtacatttattttgtatcctaagatttccctgtagttgtttatcagcataagaagcttttgggctaagatgatggggttttctagatacaggatcatgtcattggcaaacagggttagtttgactcctctcttcctatctgaatgccctttatttatctctcttgcctgattccctgctgaataggaggggtgaaagagggcatccttgtcttgtgccagttttcaaggggaatacttccagcttttgcccattcagtatgatgttggctgtgggtttgtcatagatggctcttattattttgagatatatttcttcaatacctaggttattgagaatttttaacctgaagggatgttgaattttattgaaagcgttttctgcatctattgagacaatcatgtggtttttgtctttagttctgtttatatgatgagtcacatttattgatttttttatgttgagccaaccttgtatcctggggatgaagcctacttgattgtggtgaataagtttgttgatgtgctgctggattcagtttggcagtattttgttgaggatttttgcatcgatattcatcaaggatatcagcttcaatttttcttttctttttttttttttgtatcaggatgatgctggcctcatagaatgacttagggaggagtccctccttttcaaattttttggaatagtttcaataggaatggtactagctcttctttgcacgtctggtagaattcagctgtgaatctgtctggccctgggctttttttggttggtaggctattactgcctcaatttcagaactcattattggtcagttcagggattcagtttcttcttggttcagtcttggcagggtatatgtgttcaggaatttatccattttttttctacatttttaagtttatatgcatagaggtgtttataatattctccgatggttgtttgtgtttctgtggagtattccccttaccatttcttattttatttgaatcttctctcatttcttctttactagtctagctaacagtttatgtattttattatttttttcaaaaaatcagctctgggatttgttgatccaatgaatcgtttttcatgtctctgcctccttcagttcagctctgattttggtatttcctgtcttctgatagctttgggatttgtttgctcttggttctctagttcttttagttgtgatgttaggttgttaacttgagatctctctaattttttaatataggcatttagtgttataaatttctctcttaacactgccttagctatgtcccagagattctggtaccttgtatctttgttctcattgtttcaaagaacgtcttgatttcagctttaattttattatttacccaaaagtcatttaggaccagggtattcaatttccatgtaattgtatggttttgagtgaatttcttagtcttgagttctaatttgattgcgctgtggtctgagagactgttatgatttcaattcttttgcatttcctaaagagtgctttacttctgattatgtgatcgattgtagagtaagtgctgggattacaggcgtgagccaccacaccggcctggtttttgttcatattctgaattctacttctgccctttcagccatctcagcctcagcccagttccgaacccttgctgcagaagtgatgtgatcatttggaggaaagagagcactgtggttttttgagttttcaatgttctcgtgctgattctttctcatctttgtggactttgctaccttaaatctttgaggttgctcacctttggattttttttttcttttaatagtctggctgcttttccacaggactgttgcggtttgctgggggtccactgcagtccttagtcatttcgggttttccagtacctacctgaaggtatcaccagtgaaggctatgaaacagcaaagatggcagcctaccccttcctctgggtgctccatcccagggaggtacagacttgttcctggcccaaacatacctgtaggaggtggctggagatcctgactggcaggtcttgcccagtcaggaggaacaggattggagacctgctaaggaagcagcctggccacactttcatagagcagctgtgctgtgctggggtaccacttctgcctctagttggcttgggctctctaaaacctagaggctagaatggctaagttgcccaaatagcaaagatggcagcctgcccctccctctgggagctctgtcccaggaagttttcaaatctttgttggccagagaacattcgccagggtgtctggaggtcccccttgcgaggtcatgcccagtgatgaaaaacggatcagtctggtcatgttttggtagaggagctgtgctgtgctgggggattccttctggcctaggttggtttggactctccagggcctgcaggctggaacagctgagtcatccaaacagcaaagatggtggcctctactccccacaggaactctgtcccaggtaggggtgacactgttgcccctggttagctggaattccaagccagtgggtcttatcctctgtggtgccatggaagtggggtccgcagaccgttactgcctgcttccctggattcagcccccttcccaggggtatgtacggaagtccaacctcctgcgttgctggagttgcagtcacttttgccaggatacccagagccagagtctgtaaaactcctgggcccctctgcatgtctgagtggctgctctgctgagactccacacagctctttgtgtcagactgaaggccctgctggagtgggttcatgaagggatctctcctgacctgagggttgcaaagatccgtgggagaagcatggcatggtttcctggggttgcacattcactcacgacttcacttggtgggggaggttcctccggctttgtgtcactctcaggtgggccgtcatcctatctgcttttcattgttctttatgggttgagttgctttcctgattagtcccaatgcaagtacctggatgtttcagttgaaggtactgtatttacttgcccctttcattcctctctgtgagagccatgcaccattgctgcttcttgttggccatcttggcccaaatcctctgttttctttttgccagagtagaagtggtttcctcttcttacctggacgtttcacaatggaatgaataagcaagctgatatcaatttatcagcttatcttgttagtttcatttcttagtatatgtgaggtttcaaatggtcacaaagatgaacatttaaaaggcctccaaacaaggaaaactggcagtgggccagaactgactattttaatagggatagagagtttgagtttgttactatcctgttgcttaggtaatgttactgtaagcagaggatagagaataaagagaattgcccgtatgagtacatacaaaaatgatgatgaaatgagggtaatgggaaaataatattttagggatagaataaatgcaaaattcagaaaaaccaaagtggagtttattctttttgtcagtagccacagatgagttgctagtatcatttttaaacacaaatggcaagtacttaaatgtgtttatatgtgtggactacagcaatattctaccagttagcagcacatgaaatagcttgttcacttgctggttcaattgaaatgtttttacttaaatacctattaaacattgttgatactgaattaggcttgtcaggagaaaaaatagaacactagttttcacaatttttacccggtagtagctcatgcatgaggctaagcatgtagtcctcatactatcaccttgaggtaaagtcctgttatccacaatttacatatggggaaaggagattaagtaacttccctaggtcaagcaggtagaaatggctgcacaagactcaagccttttactggttttcttcctaacagacataatttcttaagttctgtgagaaaattacaaagaaatctggaagcatcacattatccaacttcaaactatattataaggccttagtcaccaaaatagcatggtactggtataaaaatagacacatagaccaatggaacagaatagagaacccagaaataaagccacatacagccagctgatcttcgacaaagcaaacaaaagcataaagtggcaaaaggacaccctattcaacagatggtgctgggataattgacaagccacatgtagaagaatgaaactggatccttatctttcaccttatacttgaaactaagacctgaaaccataaagaatctagaagataacattggaaaaacccttctagacattggcttaggcaaagacttcatgaccaggaacccagaagcaaacgtaacaaaaaccaagacaaatagatgggacttaattaaactaaaaagcttcagtacagcaaaagaaataatcaccagttaacagaaaacccacagagtgggagaaaatcttcacaatctatacatccaacaaaggactaatatccagaatctacaaagaactcaaatcagcaagaaaaaaaaaatcccatcaaaaagtgagctaaggacatgaataggtaattctcaaaagaagatatacagatggtcaacaagcatatggaaaaatgctcaacatcacttattatcagggaaatgcaaatcaaaccacaatgtgataccacctcactcctgcaagaatggccatatcaaaaaatcaaaaactaatagatgttggtttggatgtggtgaaaagggaacacttttacactgctggtgggaatgtaaactactacaaccattgtggaaaacagtgtcgagattccttagagaacttaaaagtagatctaccctttgatccagcaatcccactactacgtatctacccagaggaaaataagtcattatatgaaaaagatacttgcacatgtatgtttatagcagcgcaatttgcaattgcaaaaatatggaatcctcccaagtgcccatcaaccaatgagtggatgaaaaaaatgtggtgcataaataccatggtatactactcagccataaaaaggaatgaaataatggcattctcagcaacctggatggacttgcagactattattctaagtgaagtaactcaggaatggtacccaaacctcatatgttctcactcatatgtgagagctaacctacgaggacacaaaggcctaagaatgatacattggagtttggggacttggggcaaagaatggggggtggcaaaggataaaagactgcacatggggtacagtgtacactggtctggtgatgggtgcaccaaaaactcagaaatcaccagtaaagaacttatttatgtaactcaacatcacctggtctctgaaaacctattgaaataaaaaatttaaaataaattacaaagaattatgactttctaaggattggatagatatctttttcttttttctttgttttttgtttttttttttttttcatggagcagagactcagacaaaacttcataaaggagagatatataagatgaagtgaaaatctaaggtgaggcctaagcatggagggcattgaatgttaggtgacaacttgaggagttacttgagtcatagagctgttttatttcttttgttcattttacctctcgtaaaccattctgtgctacttttttctccaggaagattgttcaaatttttgaggctttgtagttaaatgctattttgcttctagagaacttttctttttctctctatttttttttttttttttgagacagagttttgctcttgttgcccaggctagagtgcagtggtgcaatcttggctcaccgtaacgtctgcctcccaggttcaagtgattctcctgcctcagcctcccaagtagctggaattacaggcgtgcaccatcacggccagcaaattttgtatttttagtagagatgatatttcttcttgttggtcaggctggtctcgaactcctaacctcaggtgatccgcctgccttggcctcccaacttgctgcaattataggtgtgagccactgcgcccagctagacctattacctttgcttatatacttatgtgtaaatactgaatataaatggatatgaattgtacataattatctttttttttttttgagatggagtctgtctctgtcgcccaggctggagtgcaagggtgtgatcttggctcactgcaacccctgtctcccggattcaagcgattcttctgcctcagcgtcttgagtagctgggactacagtcatgtgccactgcacccagctaatttttgtatttttagtagatactgggtttcaccatgttggccaggctgatctcgaactcctgacctcaggtgatcctcccacctcggcctcccaaaatgctgggattgcaggtgtgagccaccacgcttggctggattgtacataactatcttaaacagaatagatgctaacattaatctgtattgagaagtaatctaattcattttgatagttggagtcattttcccctccagatgaaggctaatgaggttcaggattttgtttcacatttcttgcacctgccatacactaggcattcaatcactatttgtagaaggacagaaggatacacttttaatttaaagttcttttttttttgagacaggtttttgctctgtagttcaggatggagtacagtggtatgatcacagtttactgtagcctcaaactcctggactcaagcagtccacctgcctcagcctcctgaatagctcccattatgcctgactaattgattaaaaaaattttttttttagagaatgggtctcactgtgtggcccaggctggactcaaactcttagtctcaagtgatcctcctgccttggcctcccaaagtgctaggattacaggcatgggccactacatcctgcctaaagttattctttaatcaatcttcaaaccttgggatgggcatattctaagcagtgctgatcaaaaagtaagtatcaatgatttcagggaaattctggaagactcttaagtcagctataattattaatggcaagatttggttctggcacacagacttcagataactaatatttactgataggaagaattgaaaaaattttatagtgaacacccatatatgtaccacctagagtctacaatttacattttactaaaataactttatcacatatctgtatttttatgcatccatcgatctgtctattttttctggatccgtttaaaccaggttgacgccatgcatattttttaactgaaattcaatgtttggctacctccccaccataaaattacatacagtgaaaacatctaatattctgtgagttgtgacaaatgcatgtacctgagtaacccaaacctagaacattatagtcatcccagagagttcctcgtactcctttccagttaatccctacctccatactcccagagatggtcagaggtttttttttcccaccatagattagtattggctgttgtagaatcttgtataaatggagtcttaacagtgtcaatgaacccttttgagtaaaacttcttttatttaacagaatgcttttgcaatttgttcatgttgtgcttatcagcatttgttacttttactgatgagttgtggaccattgtataaatataccagagtaagctaatccattcttctactcatggaactctaggttgcttccagtttttggccattatgaataaaacttccttgaatattcacccatgagtcattttaagattcatgtttttattccttttgggtaaatacctaagaatgtaattatcaggtagagagatggcatatgcttggttttagaaacctgacagaccattttattaagtgattaaaacattttgtattttcaacaatgtataacagatctcttttccccagcatttcatatggtcagctcttttagacattctgatggctgtgtattgataccccactgtggttttaatttgaatttctgggatggccagtgatgtcgagccctttttcatgcctttatgcaccatttaaaaattttcccctggttgctgggcacagtggttcacacctgacttcgggaggccaaggcaggcagatcatctgaggccaggagttcgagaccagtctggccaacatggtgaaaccccacttctactaaaaagacaaaaattagctgggcatggtggcgtgcacctgtaatcccagttgcttgggaggctgaagcaggagaatcactcgaacctaggaggcagaggttgcagtgagccaagattgagccactgcactccatcctgggtgacagagcaagactctgtctcaaagaaaaaaaaaagaaaaacaattttcccctgggaagtacctattcaaatcttttgccaatttgtaaattttttaaaatgtaagagttcattatcctagatacagatttttaagtcagatgtatgttttttggaaattttttaaaagtctgtatattttctttttacttaaagctatattttcaggagcacttttaaatattgatagaatttaattcatcaactatttcttttatggttattactttgtatccttaagaaaacattgctttccctgtagatcatacagatattcttctgtgttttcttctagaggctttatagttttaattctcatgtctgttatctatatgaaattaatttttgtgtctggtgagataagggttcagatttcttttttcatattaatatccatttgtttcatcaccacttgtggaagagactttgctttttctattggattgctgtagtacctttgaagaaagttgaatgatgtgtaagtatgagtctttcttgttccattgatccatttgttggtctttatgtcagtactgtggtgtactgtggtgtctcaattactgtagttttatgtaaattttgaaatcaggtagtttaagttttccaatttgttgttgttgttttgccctaggattgccttagagtctagctgttttttttgttgttgttgttatttatataaatattttataatcaattgtcagtttctagcaacaatcctgggtatgttgaatacatagtttaatgagggggaagaggagattgacttgttacatgctactgtcttcaaatcattagtatcatgtatctctctaatttactagatcttttaaaaatttcttccagcaatgttttctggtttctagtttagaagtataacttttttttattacattttattacatttttattacatttatttatttatttatttatttatttatttaaatgctatttgctatggttggaatgatggtgttcctccaatgtatgttgaaacttaatcctaatgcaacattctgaagaggtgtgtcctttgggaggtgattaagtaatgagggctctgccttgttgaatgggtacccttatatttaatacagtgttgaatgtcggtgatgaaaatgagcatccttaggttgttaaggatattaggaggaaattggttactatttgatcatttagtagattacaattaagatgttagctataggagtttgtagatactatttatctagttgaaaaagtttttcctcttcctagtttgctaagagtttataccatctgaattttgtcggatgatttttctacattgattgaagtgcccctatgtatttctccttttattagtatgataatagttatatgtattttcttaaaatagcttcattgaggtataatttatatatcataaaattcacgtgtttttagcatacaattcaatgaattttagtgaatttacagttatttaactgtaatcaaaatgtacttttataacatttccgttactctccaaataaataatatgctaatttgtagttatttccaattcccacccccagcctaaggcaactaccgatttaccctctccatgtttgccttttcttgacattttgtatccatggagtcacacaatgtgtggtcttttgtgcctggcttctgtgacttagtataacatttttgaggctcatctattttcctttttattgccaagtaatattatgtggatataccacagtttgattatccatttaccagtttacgaccatttgaattgtttctaatttttggcttttatgaataatgctgatatgaacatttgcatctaagtcttcatatggatatatattttcatagatacctagaagtgaaattctgggtcatatggtaaatccttgctttaagaaactgccagactatttccaaagtgattataccactttacattgccactgacaattgatttttgaatgttataaacaatcttgcattcttaggataaccccatgatgtattttccatcttgcgtattgctggatttggtttgttaacaatttaaggatttgtgtgtctgtgttcatcagagattttggtctgcaattttatttccttataatgtccttgtcaggttttgtctatgaatgatttttatagaattcaccaataaaacattggcctgcacttttctttgtgggaaggttttttttttttataatggggttttctttttaatctagattgtttgcattttccttcatcttgtgtcagtaaattgtgttttgcaagggatttatttgtgtcatctaagtagttgaatttgttagcacactgttcataaacatttctctgatattcttttaatgtctgtaggatctatactgataatcctttccagatattgataatttatgttctctcttctctctctctctctctctgtctcttaagcttatggtttatcaacattattaatattattaatttcaaagaaagaaatttggctatgttaattctattatttgttttttattttattaatttatgttcttattattactttgtcctacttgctgctatgagttttctttgttctttgattagctttatgaggtgaaactgtgggtcaataagagctttttcttttctaacactgtataacttcctctaggcactgctttagctcattttacagaatttaatagaattttgatcagattagttaggagtgttgtttttgaaggcatttctaaagattttgttgttattgatttttttttttgagatgaagtctctctctgttgcccaggctggggtgcactggtgcgacctacctcagctcactgcaacccctgcctcctgggttcaattgaatctcctgcctcagcctccctagtagctggaattacaggcatctgccaccatgcccagctaattttttatatttttagtaaagacagaatttcaccatgttggccaggctggtcttgaactcctggcctcaggtaatcctcctgcctcggcctcccaaagtgctgggagtacaggtgtgagccaccatgcctcacctgatttcgaatttaaatccattgtggtacaaagacaggatctgtggacttcagtacttttaaatttattgagactcgtcttatggctcatcatatatttcctgttttggtgaaaacaccatgaacacttgtaaagaatggtgttttatgattattggttgtaatgtttctaagctctcaattaagtcaagttaattatagtgttgttcatatattttatggtttcacctatgggttttttttgcttaattttatcagttattgagaaagggtcttaagagtctcaactatgattgtggaattttctttctccttttaattacttaatatttcagttttgctttatgtattttgaaattcttagcaattgtgtgcacatttgattgttatctgttcctcaggaattgacctttgggttattattattattattattttatactttaagttctagggtacatgtgcacaacgtgcaggtttgttacataggtatacatgtgccatgttggtttgctgcacccattaactcatcatttacattaggtatttctcctaatgctatacctccccctgacccccaccccacaccaggccccagggtgtgatgttccccgccctgtgtccaagtgttctcacactgttcaattcccacctatgagtgagaacatgcggtgtttggttttctgtccttgcgatagtttgctcagaatggtggtttccagctgcatccatgtccctgcaaaggacatgaactcatccttttttatggctgcatagtatcccatggtgtatatgtgccatattttcttaatccagtctatcattgatggacatttgggttggttctaagtctttgctattgtgaatagtgccacaataaacatgtgtgcatgtgtctttatagtagtatgatttataatcttttgggtatatacccagtagtgggatcgctgggtcaaatgatatttctaattctagatccttgaggaattgccacactgtcttccacaatggttgaactagtttacactctcaccaacagtgtaaaattattcctatttctccacatcctctccagcatctgttgtttcctgactttctaatgatcgccattctaactggtgtgagatggtatctcattgtggttttgatttgcatttctctggtgaccagtgatgatgagcactttttcatgtgtctgttggctgcataaatgtcttcttttgagaagtgtctgttcatatcctttgcccactttttgatggggttgtttttttcttgtaaatttgtttaagttctttgtagattgtggatataaggcctttgtcagatgggtagattgcaaaaattttctcccattctgtaggtagcctgttcactctgatggtagtttcttttgctgtgcagaagctctttagtttaattaatttagtttaattgacaaatcccatttgtcaattttggcttttgttgccattgcttttggtgttttagtcatgaagtccttgcccatgcctctttcctgaatggtattgcctaggttttcttctagggtttttatggttttaggtctaacatttaagtctttaatccatcttgaattaattttagtataaggtgtaaggaagggatccagtttcagctttctacatatggctagccagttattaaatagggaatccttttgtttattaaatagggaatcctttccccattgcttgtttttgacaactttctcaaagatcagatggttgtagatgtgtggtgttatttctgaggcctctgatctgttccattgttctatatatctgttttggtaccagtaccatgctgttttggttactgtgccatgtagtatagtttgaagtcacttagtgtgatgcctccagctttgttctttttgcttagcattgtattggcaatgcgggctcttttttggttgcatatgaactttaaagtagttttttccaattctgtgaagaaagtcactgatagcttgatggggatggcattgaatctataaattatcttgggcagtatggccattttcacgatattgattcttcatgagcatggaatgttcttccatttgtttgtgttctcttttatttcgttgagcagtggtttgtagttctctttgaagaggtccttcacatcccttgtaagttggattcctaggtattttattctcattgtagcaattgtgaatgggagttcactcatgatttggctctctgtttgtctgttattggtgtataggaatgcttgtgatttttgcagattgattttgtatcctgagactttgctgaagttgcttatcagcttaaggagattttgggctgagatgatggggttttctaaatatacaatcatgtcatctgcaaacagggacaatttgacttcttcttttcctaattgaatatgctttatttctttctcttgcctgattgccctggccagaacttacaacactatgttgaataggagtggtgagagagggcatccttgtcttgtgccagttttcaaaaggaatgcttcaagtttttgcccattcagtatgatattggctgtgtgtttgtcataaatagctcttattattttgagatacgttccattaatacctattttattgagagtttttagcatcaaaggctgttgcattttgttgaaggccttttctacgtctgttgagataatcatgtggtttttgtcgttggttctgtttatgtgatggattatgtttattgatttgcatatgttgaaccagcctggtatcccagggatgaagccgacttgattgtgctgaataagctttttcatgtgttgctggatttggtttgccagtattttattgaggatttttgcatcgatgttcatcagggatattggtctaaaattctcttttttgttgagtctctgaacaggctttggtatcaggatgatgctggcctcataaaataagttagggaggattccctctttttctattaattggaatagtttcagaaggagtgctaccagctcctttttgtacctctggtagaatttggttgtgaatccgtctggtcctggactttttttggttggtaggctattaattattgcctgaatttcagaggctgttattggtcccttcagagattcaccttcctggtttagtcttgggagggtgtattgttcaggaatttatccatttcttctagattttctagtttatttgcattgaggtgtttatattattatctgatggtagtttgtatttctgtgggatcagtggtgatatcccctttactattttttattgcatttatttgattctcctctcttttcttctttattagtcttgctagcagtctatcaattttgttgatcttttaaaaaaaccagctcctggattcatggttttttgaagggtttttttgtgtctctatctctttcagttctgctctgatcttagttatttcttccttctgctagcttttgaatgtgtttgctcttgcttctctagttcttttaattgtgatgttagggtgtcgattttagatgtttcctgctttctcttgtgggcatttagtgctataaatttccctctacacactgctttaaatgtgccactgagattttggtacattgtgtctttgttctcgttggtttcaaagaacgtctttatttctgccttcatttcattttgtatccagtagtcattcaggagcaggtttttcagtttccatgtagttgtgcggttttgagtgagtttcttaatcctgagttctagtttgattgcactgtggtctgagagacagtttgttgtgatttctgttcttttacatttgctgaggagtgctttacttccaaccatgtggtcaattttggaataagtgcgacgtgttgctgagaagaatgtatattctgttgatttggggtggagagttctgtagatgtctattaggtctgcttggtgcagagctgagttcaagttctggatatccttgttaacctttggtctcattgatctgtctaatattgacagtagggtgttaaagtctcccattattattgtgtgggagtctaagtctctttgtaggtctctaaggacttgctttatgagtctgggtgctcctgtattgggtgcatatatatttaggatagttagctcttcttgttgaattgatccctttatcattatgtaatggccattggtttaatgtctgttttatcagagactaggattgcaacccctgcttttttttgttttccatttgcttggtagctcttcctccatccctttattttgagcctctgtgtgtctctgcacatgggatgggtctcctgaatacagcacactgatgggtcttgactctttatatttgccagtctgtgtcttttaactggggcatttagtccatttacatttaaggttaatatttttatgtgaatctgatcctgtcattatgctgttagccggttattttgcccattagttgatgcagtttcttcctagcattgatggtctttaagtttggcatgtttttgcagtggctggtactggttgctgctttccatgtttagtggagctcttgtaaggcaggcctggtggtgacaaaatctgtcagcctttgcttgtctgtaaaggattttatttctccttcacttatgaagcctagtttggctggatatgaaattctgggttgaaaattcttttaagaatattgaatattggtctccagtctcttctggcttgtagagtttctgccgagagatctgctgttagtctgatgggcttccctttgtgggtaacccgacctttctctctggctgcccttaacattttttccttcttttcaaccttgctaaatctgacaattatgtgtcttggggttgctcttctggaggagtatctttgtggtgttctttgtgtttcctgaatttgaatgttggcctgtcttgctgggttggggaagttctcctggataagatcctgaagagtattttccaacttggttccattatccccatcacttttaggtacaccaatcaaacgtagatttggtcttttcacatagtcctatatttcttggaggctttgttcatttatttttactcttttttctctaacttctcttctcgctttatttcattaatttgatcttcaatcactgatattcttttttccacttgatcaaataggctattgaagcttgtgcatgcatcacatagttctcatgccatgcttttcagctccatcaggtcatttaaattcttctatgcactgtttattctagttagccattcatctaatcttttttcaaggtttttagcttccttgcaatgggtttgaacatcctcctttagctcggagatgtttgttattactgaccttctgaagcctacttctgtcagctcgtcaaagtcattctccatgcagctttgttctttgctggtggggagatgctatcctttggaggagaagaggcactctggtttttagaattttcagcgtttctactctggtttctgcaaatattgcagaacagcaaatattgctgcctaatctttcctctggaaggttcgtcccagagggttacccgcctgtttgaggtgtcagtcggcccctactgggaggtgtctcccagttagccagttaggctacacgggggtcagggaggaggtagtctgtctgttctctgagctcaaacaccatgctgggagaaccactgctctcttcagagctgtcagatagggacgtttaagtctgcagatgtttctgctgccttttgttcagctatgccctgcccccagaggtggagactatagaggtagccggccttgctgagctgtggtggggtccacccagttcgagcttttccggctgctttgtttacctactcaagcctcagcaatggcagacccccctgcccctgccaggctgctgcctcacaggtcgatatcagactgctgtgctagcagtgagcaagtctctgtgggcgtgggatccgccgagccagacatgggatataatctcctgttgtgccatttgctgcggaccagagctgttcctattcggccatcttggactgacctttgtattgttatgaaatgttctttgtatttggtgatacttcttgtctcgacgtttactttatctaatagttatattgttgcacaatctgtcttgtttatttgcatggtatatctttttctgttcttttactattaatttctgaattttttattttcttatttttctgtaaacagcatgtagctgagtctttataaaaattaaaaatccattgtgacattcagtcttttaataggaaaatttgtgttccagtagtatttaatgtaattactgatactggatttaggccttctatcttactactatttgttgtttctttgtcccatttgttttttcttcctgtgtacctccttttctgccttctttggattagttgattagaatttcattattttatatatttgttttttaggcgtatctccctgcattattattttaatgattcttctacatctctagcttttcagtctagagttgttaccatactgtttcacttaaaaaatagaaatgttcatccttacaataattaaaagtcatttatcttcctcttctgctgtagttgtcatgtgtattatatctacacatatatacccaataaatgtattagtctgttctcacattactataagtaactacaagagactgggtaatttatgaagaaaagagatttaatcgattcacattttcacagggtgtacaggaagcctggctggggaggtttcaggaaacttacaatcatggcagaaggtgaaggggaaacagacacatcttcacatggtggagcaggatagagggtgaagggggaagtgctacatattcttaaacaaccaaatcttatgggaactcactgtcatgagaaccgcaaaggggaagtctgcctccgtggtccagtcgtctcccactaggtgccccctccaacactgaggattacagtttgacatgaggtttgggtggggacacagagccaaactatatcattccacacctagccctcccaaatctcatgtccttgtcacctttcaaagcacagtcatggcttccaaacagacccccaatgtcttaactcattctagcattaactcaaaagtcgaagtccaaagtttcatctgggacaaggcacgtctatttgcctatgagcctgtaaaaccataaacaagttagttacctccaagatacaatggggctacaggcattgggcaaatgttcccattccaaaagggagaaatcggccaaaacaaaggggttacagaccccatgcaagtccaaagcccagaaaggcagtcatcaaattttaaagctccaaaataattttctttgactccatgtctcacatgcaagcacactgatgcaaggggtaggctcccaagacgttgggcatttatgctcctttagcttggcatggtatagcctccttggctggtttcatgggccagtgttgaatgcctgtggcttttctaggcacatggtgcaagccgtcagtgggtctaccattctgagttctggaggatggtggcttttttctcacaactccactaggcagtgccccagtggggactctttgtgggggctgtaaccccacatttccccttcacactgcttagtagattctccatgagggctctgcccctgtagcagacttctgccaggatatccagacatttctattctctgatagctatttggaggctcccaagccttaactcttgccctctatgcccccacaggcttagaaacacatagaagtcaccaaagtttgcagcttgcaccatctggagcagtgacctgagatgtatctggggcccttttagccacagccacagctggagctggagaagctaggatgcagggagcagtgttctgaggttgtgtagggtagcagggccctgggctttgctctcaaaaccattcttcccttaggcctctgggcctttgattggaggggctgcgggaaagccttcaaggcattttccccattgtcttggctattaacattcagctcctctttacttatgcaaatttctacatccagcttgaattcctccccagaaaatgggcttttcttttctccctcatggtcaggctgcaaattttcttaacttttatgctgtttcctttttaagtataagttccagtttcagatcatctctttgcttatgcatgtgaccatatgctgttagaagcaaccaggccacatcttgaagaacactttgctacttagaaatttcttctgccagatatcttaaatcatctctcaagttcaaagttccacagatctctagggcaggtgcagaatgccttcagcctctttgttaatggttaacaaaagtgatctttgccccagttcccaataagttcctcatctgagactacttcagcctggacttcattggccatatcactgtcagcattttggtaacaacagtttaacaagtctttagaaagttccaaaccttccttggtcttcctgtcttatgagctctccaaactgttccaacctctgcccattacccagttacaaagctgcttccacattttcagggatctttatagcaataccccactctccagtgccaattttctgtattaacccattcttgcactgctgtgaggaactacctgagactgggtaatttgtgaagaaaagaggtttaattgattcagttccacagactgtacaggaagcatggctggagaggcctcaggaaactgacaatcatggcagaaggtgaaggggaaacaggcacatcttcacatggcagagcaggagagagggagtgaaaggggaagtgctacacaattttaaacaaccacatcttgtgagaactcacccattatcacaagaacagccaaggggaagtccactcctatgacccagtcacctcccaccaggcccctcctccaacaccgaggattacaattcaacatgagatttaggtggggacacagagacagatcatatcaatatacactacacagtactataattttcacttcaagcagtcatatgtattttaaagatgtactaaggacatatattattctatgtttaccaatatgcatgccatttcttttactttttgttccttccagaataagtttccgtcttgtatcatttccctacagcctgaagaaccttataaaagcacttttaaaaaacatgctggcaaccaattcttttaagtttcttcttttaaatttaaaaatgtgtttatttgactgttcttttaaaggatatattttgggtgtaggaattggaattgacagcatttaaaaaatgtaccactgtcttatggttgtttttttttttttcctgatgagaagaaagtagtcattcagtcattgtttttctatatgtaatatgacttttattctctgccttttttttaagctttcctctacccttgatttacaggtatttggctgctgaaccttgtctttttgacaagttttttgaatttttaaatttatatatttcaccaagtgtttgaaaaatgtgtgtgtatatgtgtgtgtatatatatgtgtgtgtgtgtgtgtgtgtatatgtgtgtgtgtgtgtgtatatatatatatatatatatatatttttttttttagacagagtctagctctgtcacccaggctggagtgcagtggcatgatctcggctcattgaaacctctgctttctggattcaagctgttctcctgcctcagcctcccgagaaactgggaatacaggcacatgccaccatgcctggctacttttttgtatttttaggagagatggcatttcaccatgttggacaggctggtcttgaactcctgaccaccacgcccggccaagaagcaaataattttggaatctgtagtcccttaatggggagaaaaggagctaggatgaaatacataaataagagttaaacatttgacttggtaacgaggtatttgaggggaatagtgcccttcagtgtttattcttgctttttttaaggtaaaggctagaaatacttattttatttatttatttttttgagacggagtcttgctctgttgcccaggctggagtgcagtggcatgatctcagctcactgcaagctccgactcccagattcacaccattctcctgcctcagcctcctgagtagctgggactacaggcccccgccaccacacccggctaattttttttttttttttgtattttttagtagagacagggtttcaccgtattagccaggatggtctcggtctcttgaccttgtgatccacccgctttggcctcccaaagtgctgggattacaggcatgagccaccacgcccagccaaggctggaaattcttaatgtgacttctgagcccttgcatgatctccaatgagtctcatctcctgctactgttgcattcattactcgctcctctctccactttgctatctatactgcaaacacactagccatcttatatcgtatcttattagagcttattcatttggtgaccctgttatttctgctttaatttctcctcttcatttctcgttcatcttcctctggatactttcttttcatcctaatgatctcagccgaaatattattttttcagttatttcatggcctctcctgataagattatatgcaccaatagcatcctcgttttctcttttgtagaatttctcattgttgcaaatagttgtttacttatgaatatctgtttaaccttgctacaatgtaagatgtataatgcagtatttttgtattcactggtatattttctgcatctattacagacctttgcatatagtagatgctcaataaatgctggaaggaataaatccagagatgaattgcttattcaggatttcattcagctaattttcagtaaggaataaactgccaaagattagtgtggagactatccctaccagttcctatttctgactcagagtgaggaagttagtctccaaaactaaataaccaagataaatgatgactgtttttcgtggtttgagtatgacccctggttacaacatagagtagtgccgacaggctataatgtctatccctgaaatgagctatagtgcggaacattatgtccaatatgcacttagtctgttacaaaaattttcatttgtaagaaatactgtatttctaccctgtacatttttttccctattttagctcaattttgattatggttcttttgaaaagatatgtagaaacagtaaaagattacctaaaactataaaaaatggcttcataaggggctgggcatggtggctcatgcccgtaatcccagcactttgggaggctgaggcaggtggatcacttgaggtcaagagctcaagaccagactagccaacatggtgaaaccccgtctctactaaaaatacaagaattagccaggtgtgatggtgggtgcctgaaatccctgctacttgggaggctgaggcaggataattgcttgaacctgggtggcagaggttgcagtgagccgaggtcatgccactgtactctagcctgggtgacagagcaaggctctgtctccaaaaaaaaaaaaaaaaaaaaaaaaaaaagttctataagaaaaaagtaaataaatggagtttagtggtttatatgaaataattcaattcaaagggatgccttacattaattttaattatgtggaacgagtttatactaatcagttgttttaataaatgggaaaattaaaatatagctttaaataggggagatttatttcaaatgaaaggaaaaacatattgacagttaagagtgagacagacataggaatattccagcaattgagagtgttgatgatgcatccttggtgaccttttaagaaaataggaaaatatctatttattgatatttcctcctatgtatgtaactacttttaatggttatttttcagatacaatttaccatatttttatcattaattttttaaatctcctgaatatggagaaaatcctacctttactgttgtgtatgagcaataaaactcattataactagtcctgtaaactgtgaccaccaggtaacttgttgataagttggcataggaagggacctcatacaacagggaattcagctaaaatattaaagttgctaattctgaatcttggcagatggctggaagtccaagtcatcttttttctgagactcttgtgcatatggatggtttttggttgggtctgctatctgaagtatctgacatggtaggtattatgggcaaatgataatgttcgtatttgaatagttgatagcttaatgatttcaaagaattattatacattgaaacacaaggtcagtcagtggctggaaatgaatgcacacatttgaagtgagaggactgctgagagcttgttgggtggttgggacctcagtcctaggttctctctgccccgaccttctggcaaggggaatagagttagctcaggaaacaaaggtaaaagcccattttccacaactaggtaaaccaagtaagcattaaggatattaaaaaggaaaaactggctgggtgtggtggctcatgcctgtaatcccagcactttgggaggccaaggcaggaggatcacttgaggtcaggagtttgagaccagcctgcccaacatggtgaaaccccatctgtatgaataatacaaaagaaaatgagcctggcatggtggcatgcacctgtagtcccagctactgaggaggctgaggcaggagctgagattgtgccactgcactccagcctgggtgacagagagagaccctgtctcaagaaaaaaaaaaaaagaaaaactttaagcatgtttaactttatcagaggttgcctgagcaaaaaacaaacaaacaaaccaaaaaacccaataacaatgatttgcgattaggcagccctcagaactagaacaggttccaagaactatctgctacctgttcacctagcatttatggacagaaaacagagtgggacaaaaaaaaacaacttaattggttacagctaggtgttgtgtctcactttaatcagctgactgtcaacagttgactgaagctcagatgctgtaactaataaactcagctttttgttacatgagtacacgctcaagtttcattcagcatgaatgacttcatattagtttggtctgttgggctcagtacaggagcctagtccaaatcaatggcctcctgcaaattttatttaacaggttaaaagtttagtcccagaatatctgaattagagcataaggcagaaagatgaattctcagtcctacctgctaatgggacgtgagcctttagatattctgctgggcttgaccagaattagctcagagcctgagcatttgttaacttgtagctgttgaagcttggaaaagcaaggattccaccttagtgaaattaaatgacttacccaagatcacaatactaatttgaaattgtgtcagaattgggatctaggcctatgtccattcctaatctagtagatttgctatataataccatcttgaatgtgcaaattacaaccttgttacttcacaaagtgtgattattactgtaaagcttaaaaagttgcttgctacttggaaaagcaatcctgaataattaaataaatcttgttatataaatataaaattgcataaaatttttagaaaactgttgatagagtctttattatttattttacattcatatttattttacatcccatgatagatacttgccaccttatatagaacttttgccaatattagggtttaataaatattgattgaatgctaatatctgaaatggtagtcagaggagttgggcttttcacctctgcgtttgtgtgtgtgtgtgtgtatatatataattgtcaacatgatagaatttatactataatcaaaattaccttggtttttagaagtgatttatagtatatttacttttacatctatctattgagtggtcccagcaataattagtgaaacgtaatgtaagaaccatccattatcttctttttataaatgaggaaacatactccaagatcatgtgaatggaaaaggaaacatgggaaaatcatatttctgaacatgagttgtacattaccagattttgttttaggaagactcactattaaatgtgtgtgtgcgtgtgtgtgtatgttttgattaatgtatgtattatgtgttaagtaaatagtatacatgctcattgcaaatcatttaaaaatatatgtgacgaagaaatgaaaaattgccagtaatctcattgctccatggtcactattgtaaacatctgacatttgttaaatctattatttatgtcctgtattcaaagtagtgtggaggtaggcaagatcactggattagtcaggaaatttgaatattctacctgtctgttagcttagtttttgaccttggtgtagggattccgtgattgccaacatttaatttttaaaattatttcttaccttaccttcttctccagtttatactgttatttctattaaataaatatgactttgttttccagtgagataactagattaacaacattacctttattgtcagtgaagaataaaagatgatgtttcacctagctcatgtagttctagttctcaagaatatgatatgtgatactttttgaaatatttaaagtagtttaaacagtatccatttgactctataaaagcctagctgggctctccatgagggaacaattcgaatagatggtttgtaacgtctttttcagttttaaaatgcagatactttgattccattgcacattgatatatgaactcattcttccttattattatttcccaaaatggtaattattttgcttctagaccagcaagctaatatatcaaaaactcttacatgtaaatgtagttgtttaaaaatatttatgctgtgtaatgtcagtaatttatgagttacagacatgatatcccttatatttttgcataataattcatttttaggaaaaactaagaataaagttattctttgtatttttaccagtcttttcccaaccaagtgttactgaaactgtcataccaaaatctttttaccttttaagattctcacttttgaggctgagaactatgaagctagtattccaatttgcattcattgttgtaatttcaggcagcatgtccaatttacttctactgttaggtgcttgtttgttgtacttatgaagaactaagaaggattttctcgtagcccagagttatgttattttttgcttagtgacaatttttacaagagaccttattataatcaaaccaatgaaatgcatcatagtacctttttcagagtgccagtggcttaggaggtattttttttatgtaaacttgttaaaggcatgtaactaactattgggcaaaattcacccccgatatttcacataggttcttttctattttctgtaagtgttggccggtctgagaaataaagggacagagtacaaaagggagaaattttaaagctgggtatccgggggagatatcacatgttggcaggttccatgatgtgcccccaagccacaaaaccagcaagtttttagtgattttcaaaaggggagggagtgtacaaatagggtgtgggtgacagagatcacctgcttcacaaggtaataagatatcacagggtaaatggaggcagggtgagatcacaggaccacaggactggggcaaaattaaaattgctaatgaagtttcaggcaggcattgtcattgataacatcttatcaggaaacagggtttgaaagcagacaactggtctgaccaaaattttttaggtgggaatttcctcatcctaataagcctgggagtgctgcaggagacgggggcttatttcatcccacagctaagaccgtaagagacagctgcccccaaagcggccattttagaggcctcccctcagggacgcattctctttctcagggatgttccttgctgagaaaaagaattcagtgatatttctcccatttgcttttgaaagaagagaaatatggctctgttctgcccagctcaccggcagtcagagtttaaggttatctctcttttttccctgaacattgctgttatcctgttctttttttcaagatgctcagatttcatattgttcaaacacacatgctgtacaatttgtgcagttaacgcaatcatcacagggtcctgaggcgacatacatcctcctcagcttacgaagatgacgggattaagagattaaagacaggcataggaaatcacaagggtattgattggggaagtgataagtgtccatgaaatcttcacaatttatgttcagagattgcagtaaagacaggcgtaagaaattataaaaatattaatttggggaactactaagtgtccatgaaatcttcacaatttatgttcttctgccatggcttcagctggtccctccgtttggggtccctgacttccctcaacaactaaccaagcttatatccttatggtagaaatagagacatactataaatatttataacaaacaaaattggggtaagaatccttcttttgttctattgtttggtcagtcaataaatatatttttaaaaatttttgtgggtatataatatggggaatatatgtgtggagtactttagatattttgatacaggtgtacagtgtgtagtaatcacatcagggtaaatagggtatccatcacctcaaacatttatcctttggctccttttcaataaaaaaattttgttttctcacagctctcccccaatactctctttacccccttacctgaaatctaagtgctttttgttctcacaagtcctctgtaccttatgatgagtgaagagcttgacattctccaggtattttgcttctagaccacttttttaaaaatcaccttctttcagcagagtgttctcactttgaaatctgtgtaatacctgctttgccatgattgttcttatgcttactgtcattagtgattttttttaaaaaaataagctttataaaagtggaagcctgtgtgtgaatttttctgtgattttttttctttttttgactcagccttatgggtttgaattcatttgtttgagtatctccctttaacaacaacaaccttatgaggtagacactattattatccacacttaacagatgtgggactgaacacagttatatgtttaggtaacttgataaggttatatatccagtaagtacagtgtctggattttaacacaggcattctatttcaaagcccagactcttaaccagtatacagtacttacattcactggtaatcagaacaatggaaactaaactgtgatgcccatcatccgtcggtatgtctgtatctatcttccttctgtctgtctacatacctttatatgtatttagattatcaacagattatctgcagcaaaattgggtacagtaatatctttaagggtcaggggaagataattttgaatttagtaatgtcctatccagacattaacattttagaataagatagacataaggacaatttcaggcatacagggactcagaaactttttcatagatcattgctgaaagaattattaatggatatactctagcaagaagggcaatgaaccaggagaaaataatgggatacaggatgtaatgatgcacaaagaaagcagtaaaacatgctgttaaattcaaatatagttgaaaaatttacatgggaattgggagaggaagtatagaggacagtaaaatagtaagctatggttctggtcctgtttcggagaagatagatatgcttgcttgctaatgttaaacttggttaggaaaagaataaatctacatgtaaactgctataataataccacctacaatttactaagcatttatatgtgccagatactttgttaacattttacatggattataagagatacacacacattcactctatatatgttatatagattatatatttataatatatataacacacacacacacacacacgttttaaaagcatacacaaatgcagggatactgatcgagcaagcatttaatagctgtatcctttaggaaatagaggggaaggggttgagatggggaggtgtgaaggtcaagtggaaaattttgctttatctttatagataaatgcttttacattaaaaatgccatcacatattattgtttttttaaaaacctaaagaagtttaagcagatataccaaaaatatcaatagcaattaaatttgtttttttactttccttttttgtttttgttttttagtgtaattttgaatttcaaaaaagaaaaagccttgagaaacacttggcagcaatgataacatagttggtttttttttgttgttgttgttgttgttaagagaggaggtcttagtatgtttctgaggttgaacttgaactcctggactcaggtgatcctctcatctcagcctcctgagtagttgggactataggtgcttgtcaatgtgtctgatttgtggcgtagttcttaaatcttttcaaacttctattaaaaataataactagggtaactgaaggaagaaacaaatgctgggtaggatacagagaaaagggaactcttatacatggttggtaggaatgtacattaatacaaccattatggacaacagtatggaagtttctcaaataactgaaaatagaactaccatatgatccagcagtcccactacataggatatatccaaatgaaagaaaatcaacatatgaaagagatacttgcactcccatgtttattgcagcgctattcacagtactcaaaaggtggaatcaacctaagtgtccatcagcagatgaatggataaagaaaatatggtatatgtgcacaatggaatactattcggctataaaaacaagtggaatcctgtcatttgtagcaacatggatggaatggaggtcattatgttaagtgaaatgagctaggtacagaaagataaataccacatgttctcactcatatgtggaagataaaaaaagttgatctcatggtagtagagagtagaatagcagttcctggaggctgggaaagggaggaaggataggaagagattggtaaaaggctattgtaattttgtaattacaaaattacatttagataggaggagcactgtagggtgactattgttaacaatttattgtatattttgaaatagctagaagagaggattttgaatatttccaacacaaagacgtgaaaaatgttgaaagtgatagatgtgctaattgtgctgatttcatcattatacattgtatgcattgaaatatcactctttaccccatgtgcacaattattatgttaattaaaaattaaaataggtgacagtatatccccgtatcactgaatatgagtaaaacaatggatagcagcaagaattatgggggaatagccagtgaccaggaatggttaaaggaaagataaactatggtgtattctaagatctgaggaaaccagaaaccacaagcaagtgttcacctccaaaaaaggtaccctcagaatgggagctcaggggtcccatctgagaccagcagttgcagttggtagggagctaacaggttacatacagtttgtgggtacaaggagactgtggaaaggtctgagagaataggggttccctgggccttcagtgttctctgacatactcaataaggtttggtcctacaatggggaaaaatttatagaaatagaacacaatttcatcagggcaggaactctgtgagtaaaggagggaaatcttccaaatactaataggtgaatgaccaggaaagatgcatcttagaaagtactggagatgaggctatgcttgagaggctcttacttttttatatttcttggtaacaacagtaaagctaggagctctattctgtccccatgtcccctcttctaatagttaaagagaaatgatctcatttaaacatatgcattagaaaatgactgtattaaaactccacaaaaatatattgtatcaggtcggtgcaaaagtaattgcagtttcagatagtgaattttaaatcattataactaggctcaaacacatacttattaatcaaaataggaaccattacaatcaacacatcttttgccaatgagaaataagtttgtttattcctgtagtatacaaatctgtttcgggatgccatgaactcttggagtgcattttttgcatcctgctggttgtagaagcactttccccacaaaaagttgccgagatgcttgaagaagtggtagtcagttggcgagaggtcaggtgaatatggcggatgaggcaaaactttgtagcccagttccttcaacgtttgaagtgttggttgtgcaaggtacataccgtaagccaacaaataaaacctcagtaaatttcatagaacagggataataagagagcgttctccagccacagtacaatgaacgaagaatgcacacactcaatccaaagatggcaagaaagaagaaaattatgcatagaaaaacttgaatcaacagaaaacataaagatggtaaaaagttggatatattaataatcaaaacaaatagtatgagcctgggcaatatggtgaaacctcatctctacaaaacaaaaaccaaaaataaaaattagcctgtgtgctggtgtgtgcctgtaggcccagctacttcaggggggctgaggtaagagaattgattatgcggtgcagcaagccatgatcatgccactgcactagcctgggcaacagaatgagacctcatcttaaaaaaagaaagaaagggtatgcagtatgtgactgaggttataatgtgggaaaaagaaaatgcaggtatatgctttttacaagaaatgcccaagtagtaaaaggatgaaacatgaactagacaaatagctgcccagcctgtctccccaaagatactaggtgacttttaatgtgcacacatttgattttaggaaggataaagagatctctaaataaaaattccatttcagttcatagatatggaaataatttaaatggttttaattgcatcaagtttgtgattgtttatatgttcccatgtagtttgggaacattacactctgaatttgtcatccatatacattttatttcttaactttaatttttatctcatttagatttggtgggatgctttgtcgtctttttttaagaaaatttaattttattttaagttccaggatatatgtgctggatgtgcaggtttgttacataggtaaatgtgtgccatggtggtttgctgcatgtaacaacccatctcctaggtattaagccctgcacgcattagccatttatcctgatgctctccctcctcccaccctaccctgacagggtgtgttgttcccctccctgtgtccatgtgttctcattgttcagctcccacttattagtgagaacatgcagtgtttggttttatgttcctgtgttagtttgctgaggataatggcttccagtttcatccatgtccctgcaaaggacatgatcttgtttctttttatggttgcattagtattccatggtatatgtgtaccccattttctttatccagtatattattgatgggcatttgggttgattccatgtctttgctattgtgaatagtgctgcagtgcacacacgtgtgcatgtatttttgtaatagaatgatttatattccttgggtgtatacccaggaatgggattgctgggtcaaatggtatttctggctctaggtctttgaggaattgccacggtgttatattggatgctttgtcttctaatgtagatcattcatatggtcttcaagtcttttgtaaattgctgaatgtttgaaatagtttgctgtgattgaaaaggaagttaaagggggaaaaaagcactggacaactagactctggtatgctgctaccactgacaaactttgttactgcctcttgactagtttcttttttcatttatgccctttgaggctctaatatcccattttggaagcagttcttgtggattggggatatcgctgtatttttctctctgtagaaaataccagtgcatttattcgatctgtgcattagcttatatatttcagcaagtccactacttaataaaatgatcatagtaatcccacttggtatatgacatgatgaagatgaaggtgctatctggttaaagatccaaaagaagaggatttataacaaataatgtttgtctggacatttgaatttaagcatcgaaaaggatattaatagaacagtgtgaatttccaaagtagacataatgcagctatgcacatgatagaataaaaatagagcttttgtcttattttttaaaagcttaggagaattaagacatgatttaatgttttatgatgacagtattttgccagttttttattaccttatttattatatattataatgcattaagttgatactgattatcaactatgtgccaagcattatactgttacatgtgaaatggtaaactgtatttgggcagacgatttcccatggcatttttgcatgtcttgtattagcatttgttctggactatcttttcagggattttggtgcaggaaacagccttgagaaacagacatacgtttggcacagggcagatttttttttttttttctgaccatgataataaagatgtttccctctgaggcaaaggttggacaggttttctggcagctcctttaaaagactggagttttcaaagcttgtggttccttctctgtgatgcaaactcactgtgtgtgtgcagcatccacctgtcttgcttctgctttaaccctgtgagactttggaggagagaggggaccaatacaaacatgaaggtcatgatgtctgttgtgcaatgaataatgaaacctttaatctctgaccctgtaaacttagatattttgctgtctatggaactatcaggctaatttgttagcttgcaagtagggtaaaatatcagaccctttgtagttcttgacccaatggagattgattccttggtattagagcatttcttctctagtggagaagacagaaagtgaaacagttacttacagtatccttgataattgttatgatggtatggaagcacctagctggagcacttaattcagttaactagttaaggaagagtcaaggatagcttaccagaggaagtgacatatttagacctgaaaaatgagaataagttaggcaaaagacagagattagaaaagagtttatacttccagatatgtgtatgcataattattttaggcttcccttttttgttttgtgtttatgaattactttgcacattttaaactcttggaagagacaggaaccatttcatagcctccatgggttacattctgtagttttccttaggtataaggtgtatttcttcatttcttataagctgcatgtggttgatcttttgtttaaaaaaagtatatgtatttaaaaatgtatatatctatctgtccagtttgccaattcttgtctttaaattggagggtctagtctctttacgtgtaattattgacgtgtttgaatttaaacataccatattaccaagtagctttttatttgtcatgtcggttcagtacatttttctttttttttcccactacttttggatgtacatgtcttttatttttattcagcatccccctttattaaccttaaaaaattattattttgctattcttttagtggtaaccctagatattataacatgcatgtttgatttattaaagggtaaaataaatttatacttttatcattttctggacaattcatggatcttcaaacactaatttcatttatccttctcccaaattcagtgctattgtttttgatatattttaatcttttccatcttttaaagctcttctggacatcattgttattgataaacatagtaaatatgtatttagatttatccatgtgtttttcctttttctagcctttatttcttcctgcatgtctaagcttccatctgggctcatttactttctgcctgaaacatagattttagtattttctttgttggaaatctactttttacagtctctttttctttctctgcaatttttaaatttttccttcacgtttaaaggatatattcctagatatagaataacagttggcagttattttctttcctaggtttttaaagtttttgaaagagtctcactctgttgcccaggccaggctggagtgcagtggcacgatcttggcttactgcaacctccacctcctggattcaagggattctcctgcctcagcctctcgaatagctgggattacaggcatgcaccaccacgcctggctgatttttgtatttgtggtagaggacttgtgttgtcatctgacttctgttatttcagttttcgaacaatatgttgctgcttctttgaaggtaatacatctttttctcgtcactttttaaaacaattctgatttttagcacttttcctctgatgtgtgtagatgtgattttttttttgtactagtgaaatggatgatagatcagaaatgattctggtatctatagcttaatttatttaactggccttgaaaatttgtttgtaattctgtgttcaaacactgcttctttatttctttctcctatccttcatgaagtgtaattataggtatgatagccctattcattgtatttcacatccttttttcccccctctgtttttatccttatgtccttactatgtccatatgactgaattttttttgatgtgtattctagttcactcattacttcttcaactgtatgtaatgtgctgttaaacctaccattgaattatcaaattcacttatttttcagttgtggaaagtatgttttatactcttctatggttttttgttttctgctgaaatcttcaatctttttttgtttgttagtttttgaactgggtctcattctgttacccatgctggagtgcagtggcgtgatctcacctcactgtaggcttgacctcccaggctcaagtgatcctcctgcagcggcctcctgaatagctgggactacaggtgcatgctactgtgccacagctaattttttttgtattggtggagatggggctttaccctgttgcccaggctggtctggaactgctgagttcaagcaatttgcccgcattggcctctcaaagtgctggaattactggtctgtgccaccgtgcccagccctcaatcttgtttttcacattagtaattattgttttatgttctggttctgataacttcattatctagtcatttgtgtatctgcttcattatctaggaccctatatgtctgttgctttccttagcttttattcacttctaatcatttagtatggctggctattttttattgatgtctgaataaagtatataaaaattgtaaacgcaatttgaggctttggatactgttatcttccttgagagaagattacttttgatttacgctggtgctggtgtgtaggcttgggaccctggcagtcacagattgttacaatccaactaagaatagggatgatttgaagttgtgcctggtctctgcaaggacttacctatatcggtttttgttttaattgaaatgaaattcacaatagctatagttcaccattttaactatttaaaagtatacagtttagtggttttagtatacaattttcccttcgtatccttgggagattagtttcaggacctcccatggataccaaaatctacggatgctctaatcccttaaggaaaatggcttaatatttacatataacctatgcatatcctcccatatcctttaaataatctctagattacttataatggcctatacaatgtaaatgctgtgtaaatagttgttatactgtgttgtttacgaaatagtgactagaaaaatgtttgtgtatgttcattacagacactgtcatccatttattccccaaatatttttgatccatagttgtttgaatccatacacagagactctatgcatacagagggcataatgcagctctgtatttacaatgttgtataatcatcatctacttaattctagaatacttccattacattaaaaagaaacccctcatctcccaatttcctcatctcatcaacccctggcagtccagtaatctacagatttacatattttaaatggaatcatacaatatggtctgttgctactgccttctttctacttaatatatttggcctttttttgtaacccttacttttggggtatacttacttgcaacaattcttggaagtctgtgaaccctagctttgtctcactgttttcatgggcatattaaaatctttgttcaggttctcagccctccaactgttgtttttacagtgggcatttatcttgagagggaaagtagcctaaagtctgggcttacatctctgggtttcctttctctcttgatctgcctttgcagtcctagttttcttggtagctctctgatgtcttcaagtattgtttttatgttttatccatctttctgattcccagctcattggaattagactatgtaaatatttgctgaatgactaaattcatttattgaaacattatttattgaatggaaaatatgtgccaagtactggaggtatagtagtgtacaaagcaacaaaactctctactctcccacaggttacattttagggacagttgataggaaataaagcatacacctgaaatacatagtatgtcaaaaggtggaaatttctgtggagagcataatgcagggaaagatagaatgagttctagggtgttgagagctgtttcaagtaaggtaagttagggaaaacctctttgataagatgacatgggaagagttaactgaagggagagagccatatggatatcagtcagagggaacagaaagtataaagaccccgagtcaaaaatgagctgtcccactgtccaagcaagagtatggctggagcagaaatgaggtggtagattagctcctagctctgggggttggacagatcatgtagagtgctgtacaagtttggattttattagaacagagttgggaagctgctggagtgtcttgagtagaggagagacatgatctgcttagcactcacattgatcctgttaaaactggtatttcggaataaaccagatcctgggtggtgagggtggatgcagagacaccacctggagattttttcagtaacacagacaagggaggaatactcttttagatcagggtgctagcagtgcaagtagaaagaactgaccagaatttagatatattttgaaggtacagacaacccagtttgctagacatttgaatgtgggggcatgagaaagtcaggagttaagttcttggcctaactgatcagaaggatggaagtgccattgagtgaaactagaaagctcgctagaggatctaatttgcaggtgggataggcagaagatcaagagtttgttcttggccctgttcagttttatatgcctgttgtgcagctaagaggagatgacaagaagtaagttaaatatatgaggctgcaaaatggtctgaggttaatatatacatttgtgagttattagtatcttgttgatactaaaaaagctttgagattgaatgaggtcatttaggggtgaatgtgaatagagaagagatgcaagtactgaaaacagagacaattcaaattttataagtccagggctgaggaggactcaataaagaaggtagatggggctcatgcttataatcccagtactttgggaggccaaggcaggaggatcacatgaggctaggagtttgaagaccagcctgggtaacatagtaagacctcatttctacaaaaagcgaaacaaatattagccaggtgtggtggtgctcacctgtagtcccagctacttgggaggctgaggtgggaggatcatttgagcctgggagatcaaggctgcagtgagccgagattgtgccactgcattccagcctgggcgatggagaccctgtctcaaaaaaaaaaaaaaaaaatagatgggccaggcatggtggctcgtgcctgtaatcccagcagcttggggaatctaaggcagaaggataagttgagtccgggaatgggaattcaagaccagcctggacaacatagcaagactgggtctctacaaaaaaaaaaaaaaaatatatatatatatatatatatatatatatatatatataagctgggtgtggtggtgcacacctgtagtcctagctacttggaaggctgagttaggaagatgactggagccaaaaagtttgaggctgcagtgagccatgtttgcctgggtgacagagcaagaccccatttctttaaaaaaagggctagtagctcaaggatgaagtggagccaatgattttttttttttaagttgggatagattttactgtgtttgcatgctgaagcgaatgatctagcaggtcaaaggtcaggaacgagtcttgtagcagttttcttgaggaggggaacaggtatggaatgtagagggcagaggacataggtggaaggtgggctctgtatagtcctgagggtagttcatccacaagagaagggaaggcagattattttggtaaccctacagggttaatagatagaacatatcaaagttgcctttcatcaataagagtaagaatggtggaggaggtcctgtaagtttaagcagggaagagaagcagcaaaatagtaaatggaaaaggaaatagatctgggaaatggattgtagaggagcactgagataatttcaccttctcatctataaattgagaaagtttaattagatccatctcaagacttttaaatgaataagtaattgactaaccacaccttgaatactataatatacaaattcttgctattacttgctgtgacttcgttgtcaaacagtaaaaacaagtgtttgatatggatataatattgatataaacagaattattaatgttagtgcatataaatatgacattcaaatgcaaatcttattgctagcaaaaattttttgatattaatttctatatatagtttaagctatagattatggaaaacagaagcaatgcccatagttggtagttcacatttgaactacataatgatctcgtactactcctaagaatttctaaaacatatttatggaagctaagtttaggtatgtatgttcatttcagggaatattcattttaggctacttgatattttacttaagcttaattactcacaggtgtgctattgcagttgtatgataaaggaaataactaaattttatgactatccaaaacattctttgtgattttttactatctataatttttttaatttttaatacagtattgctctgatatttagcagtattaatcacttgtcatttatatctgtttatcagtgcatagtgccagtgaagttgaagtcatagatactattcccagtaagttttcctccgtatttagttctggctgcccatgtcatactggaaaaataaggcaacttaaatttattgagtacttttaaagttcattttatgccactataatagaatagtacagactgggtaattggtaatgaacagaaatttattggctcacagttttggaagctgggaagtccaatatcaaggtgctggtatctcatcagggccttcttgctgtgtcatcccatggcagaagagcaaagagagggtgggagagagagcaagagggggcctaagtcatccttttatagggaacccattcttctgataaggagccctctcacatgatagtggcattaatcaactcgctccaccctcatggcctaatcacctctctttaggacccatctcccaacaatgttgtattggggattaagtttccagtatatgtcttttgtgggaacacattcaagccataccaagtaaatagcctaagtgagtcacttttgagtactttacatgtggtagagtctttagtcctgcagctatcctgtgagataggcggtgttattctgaaaagttccatgccaaattatggatttagtaagtgacagggttgggatttatttccaagttattccaaatctaaagactgtgccactattaatgatcaattatagttcagtaaagtatattttgtataacatttgaaaataaaacaatggttatatagtcttgtgcctgtgaattgttcttttttacctggctgtatatcatctttaattagtgccttcctggactcagtcaccttcttttaattagcctttattttatgttcttattagaaacttgataatttctacattattgaaaaaagaaattttgtaagtaagagactgcttaggatattatggagtggaactagagttcgagaattgaatggcattaggttggctcctgattgtgtactttagggataggttatttttgtggaagagttagtaagaattcttttatcaaatagatagttaatagactataaggggtagatggttgaaaactaaatatttaaatgttattttaaagctacttacaaatatactgacatcacacaaatgatatgaaatacttgcttaatagatatataatagtttcaaatatttcagtgcatactatttaggtgcttctcatagaatggtcaacaagaccaatgtggaacttatcattagaagtttatagtccagtgtttgtatataacccaaccctgagagatatatctagcccccacccctagaaacttactgttttccctctgattgtaaaatattcattttacaaaatttgtggaataggaaaaaatataaagataaatggaaaagatttataagcccacagctcagagatacacttcggacatatttcactttagtttctttttcctttatacacatttattagcatgaattaaacatgtatcttttttttttttttgagacagagtctcactctgttgcccaggctggagtgcagtggtacaatcttggctcactgcaacctctgcctcccaggttcaggcgattctcctgcctctgcctcccgagtagctgggtacaggtgtgtgccaccatgcctggctaagttttctatttttagcagagacggaatttcaccatgttggccaggctggtcttgaactcctgagctcaagtaatccacctgccttgccctcccaaagtgctgggattacaggcgtgagccactgtgccctgcctaaacatgtattttataagaaaaatctgtttgctacattttgcttttagtttttaattttcagttcttttttttccttttgtctcagggtcatatatgtcattcttttttctcctgtgactcacttaatctttgtattttctgatccattaaattctgctttaacatgtataatttctttttatttactcagttttgctttttagaaattctcaactgcatgagttaaatgcctgacccgtttattgttattatttgctgcttttaatttttgttgaaagctttttaaaatagaaatttttgtaaacaccttctcattaggatataaacacagttatttgggaagttacattcctttcctgttattagcaaaaaaactttttttttatctcaagcaggttctgtgaattgtagggaccagagaacattattttgttgttctagtcacgtattttttatttctctcaaacaagttttgaacaagtgaatcttctctttttcctttacctcatctggtaatttttgcaatctatttgtgccatacttgcagtcttaaaacattttttttgtttgatttttaccacttttaggccttcagattctaaattcattatgtactctgatgccaaagttgttgcatacttcacagttgtcttcttagtagattattgtactactttggcatcatagaaccagaaggccttagaggtcatataattttgatgaatattattttttaaagatctggaaactggggcttggagaagaagtaaactgatgtacctagctcactaaactaatgtacttctgctaaaaggttttagcagaatctctacttaaaagcaggggtctactgggaccagggcaagcctcagtccttactgtgagatgaaagccaggccatctgccagccccactctgcaaggtgcctactccctgcaaacacagaagcttcttggtgggagcagacaccagacaaacaggccaatgtggggacaggggcggggccctacctgttggtgccactgggctcagtgaggttgcccaggccttggctgcagcagtcccgctgccagcactgggagaggttgaagagcacgagacaggccaccagggccactgtcagcagcatgacctttggcttcaggctcatctgcaagaagatggagcaggcaatgaagcccaggacacagctgcaggtgtagtactggggaggggttggtgtcactcaggacagggccgcatcatcacctcctcttgcctctgatccagcactgaccccagagccccactctccagtgcttcagcatcgtgctcttgccttgccgcctcccttctcaacaaaaagcaacgagatctgaaaaaaaaaaaacaaacaaaaaaaaaaaaccacacacaaagcaggggcctagatctctttccatttaaccccattgaatctgatttgaatctggttagtagttctgtgagaagctattacaggatttcagataataagataattgaaataatgtagctattcagatcataaaactcatttaataatgagttattgagaaactaagtattgtgatctaagtggtgttttaggaaggtgaatttggcagtggtattgagtggtgacataggaagatgggaggaggcaaaaaagagggattttgaaactgcctggcatggttctgtgttccatcccagatatctttaacaaaagctaacaaacagtatatacaactactttccatttttttttaatattgtcagttttcttttatgtggactaaagcattacattactctaacaagtaagataatattgcatgatacaataatgaaatattatttaattcaagtcatatagtcattatttttgaaaaacaaaaataatgagaaaattagccttcagaaaaacattatgaagattaggaataattacaaaaatattttagtatatatttaaattctgcattttaaaacgtctagaaacaataactttttatattatgagttatattcataatataaaaatactctcttcagtgtgctctatttgagaacttacataataacctcatttaacattatgtataacagtgattcaggtgggcagattttatttcacaaagtgcagttataattatggctgaattttgagattcggataaaaaaggaatatagatattagtttttctcatataatctttatcttttattcattcatttgaaagtcattcattacacagttgcattagaattgaagcaaataactagaataaagttatgttttatatcaaagcacttaattcttaaaaccccagatattcaagtattgtttacaattaggatataaaaggttagaaatgatgtgcatgttaactctcatgtaacttttgtgagttacactttgatgtgattgagtttatttctttgtaattatattctataatttttttgccatatgtgtatgtgtgtgtatgtagatatatgtatacatagtgtgtgtatacatatatacacatacatgttaaaatgaggataacttgtaaagcgacttaagttttatggtaaaaatggagtttattattttgttagaatctgagtattacatctaactgggatgtatacattgtagtaattaattcatcagcaactaggatatcttggacatttgacaactcatttgttgagtcccgttttggaggggacattttcttgcatgacagttgcaaactgttatctatcaggcactgaggcaggtactagggtatataatggagtgcagagctacaatacaagctccaccgtccttcagcttgtatgtgtatacacacacacacacacacacacacacacacacatttatttattttaatttgagacagattgtatacacacaaatcaagtatagattatgtagtgctaggaatgaaataatgtatttttatccagaataatggagacatacggtattttaggtagtgtagtcagtgaatgcctctttgaagaggcagcaactcaaactgagaagtataagaaagagtcagtcctgctaagagccagttaagagcatgttagaaagaaggaacagtgagcaaaaggcctgggagttgggagaaagtgtgcctatttagaaaccaactaaaatctgagtgattggatcctttaatgagcaaaggggagagtaacatgattacattggtgaggtagacatgagtaagatttattcaggttttgtcgactgtgagaaacagtttggattctgttacaagagcagtgggaagccattgaaagactttaggctaggggagtgacataatttcttttatgttctaaaaagatcatctgccgcagtgggaagggagcaaaggcaaaaaagtggtgatctagtgtagtgcttcatttatagtggtgacacagttatttttttttattaaataaagtgaagaaactagaattaagcaggaatctgttgtttctagttgtttccagtagggatgtttccatctgtacactatttttagtaaaaatgcataaacctatgttttcatttccgttgggtactgagagtgctgagacctacctgtgggtaaatgtgtgtttagtgcctgttataagaaatttgccaaattgttttctaaagtggctgtgtcactttgtgttcatataagaaatgtgtgaaaggtccagttgttttacatcctcttccatacttggtgttgtcagtctttttgatttgaatctggtagatggatagtggtagcttactgtggtttcagtttgtgttttctgaatgccttatgatattaagtatttttccatgtgcttacagaacatttttatatctttttttgaaatatctgttaagatcatttgtcaatttaaaaatggcttatatttttaattaagatgtgagagttctttatatattctgggtacaagtcttatcagatatataatttgcaaatatttttcttcaggctccggtttgtctttccattttcttaatagcatattaattctgtacaagtctaatttattgatgttttttcttgtccttttgtggcttacttaaaaaatatttgcataatccaagacaagaaaagatttttttcttagaggttttgcagatttaacccttatatttgcatatgatataaagtaaggataaaagttcatgtggctgtgtggttgtttctgttgttgtaaatactgttctttctccattatttatcttgtcacctttgtctcacatcaattgatcatctattgatttgttttataatttatgtgggtttatttgtgggtttatttttggactttctattatgttctgttaatgtgtatgtctattcttatggtaatgacatattgccttgatttttgtggcttccttgtaagtcataaaatctggtagtttagggcctctcaagtttgttcttcagtctcaaatttgttttggctattgtaggctttttgaatttccatatacgttttgtaatcaatttgtgatttttctaacaaaaaaccaggcacaattttgattaggatggtgaaagatgaatttggaagaccaagacatcttctcatacttaaatatggtaaatgtctgtatctacttaggtttttcttttctcttgttattattttttaatcttagcaatgttttgtagttttgagtatacactttacaaatatttagatgtacttactactttgtatctcatctttttgtattataaatgatattctttttagttttaatttattgtttcaattgttctttgccagtataaataaatgtaatatgtttgtgtatattgatcttaaatcctgagaatttggtaaaattctttattaaattagaacttttgggtagattccttaggattttgcgtgtagatgattatgaggtttgtgaacagagatagttttacatcttcctttccaatctttatgcctttaatttattcatttttcttcctgttttgcatttggttgagcatccatgataacactgaatagaagtagtcagagagaacatctttgctttatttatgaccttagtgtggaaaccatgcagtcattcaccattaagtatgatgttagctataggttttttatagatgccttttatgaatatctggttgaggaaattctatttctagtttgttgagagcttttataatgaatatttttgaattttgcaaatgctttttctgtatcttttgacatcatcatgtggcttttcatttttagtcagctgatatggggaattatgtcatttgagttttttttttttattgatgagcaaatcttgcactcctgggataaaaccaacttggtcatgatgtcttttttgttttttaatatgttgctggatttaatttggtatatattaagtgtttttgtgtctacgttcacgatggttatttggctgtagttttcttttctttgaaatggttttctgattttgttaccatgatattgttgactcatgggttttgaaatgttcctttcattaaatttttttttgttttttgtttttttttttgagacagagtctcactgtgtcacccaggctggagtgcagtggtgcagccttggctcactgcaacctctgcctcctgggttcaagcgattcttgtgcctcaggctcccgagtagctgggattataggcggacaccaccacacctggctaattttttgtatttttagtagatacagggtctcaccatgttggccaggctggtctcgaactcctgacctcaagtgatccacctgcctcgattaaaattctgagaaagattgtgtagaattgatagtaattctctcacgagtgattgatagaattcatctgtgaaatcatccagatctggggttttgtttgcaggaaggcttgtaactacaaatttaatttttataatagatataggactatttagattggctatttattcttaagctttggtagtttatgtcactcaatgaatttgtctttttaatataagttgtcaaattcataggtataaagttgttcacaagaataacttatctcttcatagtgtctgcagatctatagtcatgacttttatttgtattagtggtaatttatattggttctctttgcctccctccagccgctccagctgtcccacacctctttgcttcatcgggctagataaattacagaactaaccaacatttgatttcaccagtattgttttattgggttttgtatctttgtttttttccctcttgttctagttatattttttctttgacttattttgagtataacatgctcttcttttatagtttcttaatgtggaacctaaggtcattgaattgaaagcttctatagtaatataagtcttttaatgttatacatttctctaaagcactgttttagctatatctaataaattttgatatgttacatttttatttagctcaaaaattttctaattttcttggtgacttctttgatctataggttatttggaataagtttccacatacttaggtattattattctgatgtatagttttatttatttttaattctaccgtgatcagatatcatactttgtataatttgtcctttaaatttattgagatttcttttgcaatctcagatactcttagcttgatgactgtttcttgtacgcttttagaaggctatattttctgctgttggatggtatgtatgccccaataacaatttagtaaagttgtttgatagtgttgctgaaatcttctatattcttttgtaagacagagtctcactctgtcacccaagctggagggcggtggcacgatcttgctttactgcaacgtctgcctactggtttcaagcaattctcgtgcctcagcctccgagtagcttggactacagctgcgtgccaccacacccagctaattttcttgtatttttagtagagacagggttttgccatgttggccaggctggtctcaaactcctgacctcagtgatctgccttcctcagcctcccaaagtgctatgattacaggtatgagccactgtgcctggcaaatcttctatattcttattggtggattttttttatatggggggaggtgtctttttaatctactgagacaggtgtgttgaaatttcaacaaaaattgtagatttgtctatttctctttcatttgtataggctttgcttcttgctttacaaagctattattagatgcattcacatgtaggattgctgtgccttcttgatgaattgattttttttcttcatatgagaagcatcccttcttccggttactgttctttttataaagtctaatttgtctgatattaatttagctctcatttttttggagtttttttttctgcatagggttatttttgtgtcatgggctggcaaactattgcctatctgctggctgcctgactttatagttttatcggaatggtggcacaccttgtctttacacattccctgtgtctgctttcaagttacaggtgaagaattgagtagttatcatggagaccaaatggcttacaagtctaaaattttcagtatgtggccttgcaagaaaaagtttgctgaccctctgcatttttttgtagacagattgtaatggagtcttgctatatttcgtacattcttgtaatctctgccttttgagtcatagttttagattatttacatttaatgtaattattaatattgccacaattctggcagttatcattgctgtttattccgtatttattacatctgtttttctttctccttttcctattttatgtctggttttggattaattgaatatttgttatgacttaattttacacatactcttgatttattaactacacttttttttttacatgtttaatggtttttctagagtttatcatatgcatcattaacttagtgctctctaacttaaaagtaatatgctacttcaagtttagggttaagaaccttataaaagtacacatatatttctcccgccatgtcctttgtgctgttgttgttactgtttttatttctacgtgcattatcttaagcccatagtacattgttgttatttttactttagatagttatgttttaaagagatttcaaactgtggaattttttctaaacaagatacttaacattctggtgctcttcagttttttgtgtggatttaaaatttctgtatgttttcttctgtctgatgaagttacttacatttctcatagtaaaagtctatgagcaacaaattctgtcttgtagttggctgcagaagtctttttttgctttcatttatgaaatagattaggatttttacttgttagactaagagaatttaaaagtgtatagtcgtttggccattaacacttcatttttaactcattttacttgtcacttgactactggcagtcaggtatccttactatatctattgttatagacatataaagccattataaaggtggttatacagcttttgaaaaattgcgtgttgctttaaatatatttgaaagatgtattttcaagtaggcactttatgatagtcactccctttgttttcccttccctagagtttttatagactgtatttgtagcagcatttgatatactcttgggtacagttatttctataacacaggaaattgccaatatgaattacttgagagaggaccagtgtaaaagaaataggaagcaaataagtaattttctattttacttgcctttgtttcttagctggggtacagggtcattaatgtttattatgttcatgtgtaaattataagtatttttctgttatttactaaacaattatctaaaattcatttattatacatgttgatgggggcagatcttaaaggttaaatgcttggtggagataaatatatatgtcttgggcatggtttctctggtattcatatatttatttatggtattgagaagacatggatttaaattctgatgctaacactagctttgggatcttgggctggttatttaatgtatgccaacctcagtttcctcatttgagacacccattgcacagaattttgagaattaaatgaggctatacacataaattactcagcatgtgataaatgttcacaaaatggtgattcttaattatgtttctgcttacatttttatctctgtataatttcatatagctttatctagaagaagatttatgttttagaaattaataactcaagagctttataatatagattgtgcctactttgaaaaataatttgaattggcttacagtgaaagatagcagtatactaaaggaaggaaagcaaaaactagtcaggaagacagaataaagaaaggagataatgaagacaaatatagttatcaaaatttgatccttaatttttaatttcctggaaaccaaggctaaaaggataatatggtggcttacactattcttattgtatattaaaagaaagcatactagttcattaaggtgcttaacattttcccccagattttatgataagaaaaatgtatttctttataaagggacactgtcagtgtaactgatgggagaagtcacctacaggtcagatgcctaaggagatgagaaattatactactgatctcatactatattcttaacttgtttatattttaaagggctttcatacttttttcaatttttatctttgtgtcctgtataagttatattaaatataatttatagtagagctatagtagatcctataaaagtatgcgatcatagaggagggtagtattaattttgaaaagaaatgtttcagatgatctcatcaaggaggtggaagttaagttgggccttgaagacattactaaggtttagagagacaaaagtacgtacatctgtgtgtgtatgtaaatatagttacctatacaaaagaaaaagtgtgagtaaaaacaaggaaatatagaataatgcagtggtcacaaagtagaacatggcagaagtgagcttaggaagactgggcaggtcagatcttgaaggatcatgaatgctattaagaaatttggtctttctttagaaaatcgcaaggctctttttcttccaccttttattttaggtttgggggtgcatgcgcaggtttgttacgtgggtaaattgtgtgtctttgggggttggtgtacaagtgattttattacccatgtggtgagcatagcacccactaggtagtttttcaacccttgtgcacctcccatgctccactctcaggtaggccctggtgtctgttgttccccttttatgtccacatgcactccatgtttagctcccacttacaggttacttccattttctgatggacttaaaagtgggagcttatttgtgttcatgtgataatttgcttaggataatagcctctagctgcaaccatgttgttgcaaaggatgtgatttttttttgttatggctgcatagtattccatggtgtatatgcaccacatttctttatccagcccactgttgatgagcactgcattgattgcatgcctttgctattgtgaatagtgctgcgatgaacatacaagtgcgtgttgctttttggtaaaacaatttttattccttttgatgtatacccagtaatgggattgctgggtcagagggtaattttgggcccggcgtggtggctcatgcctgtaatctcagcaccttggaaggccaaggcagatggatcacccgaagtcaagagttcaagaccagccagaccaacctggcgaaactttgtctccactgaaaaaaaaacaaaacaaaaattagccaggtgtggtggtacacacctgtagtcccagttacttgggaggctggggctggagaattatttgaacctgataggcggagtttgcagtgagctgagattgtaccactgcactccagcctgagtgacagagcaaaactctgtctcaaaataaataaaataaaataacataaaataaaataaaagtagttttgttttaagtcctttgggaaatctccaaactgctttccacagtagctgaactaatttacatcccaccagcagtgtataaacatttccttttctccacaactttgctaacatctattatttgctgatttttgtttttagtagccattctgactggtgtgagatcttacctcattgtgattttgacttgcatttctctgatgattagttatgctgagcaaatatacttgttggcctcatgtatgtcttcttttgagaggtgtctgttcgtgtcctttgcccatttcttaatggggttatttgttttttagttgttgatttgttcatatttcttatagattctagatattagactttttgtaggatgcatagtttgcaaatattttctcccattctttaggttgtctgcttattttgttgatagtttcttttgctgtgcagaagctctttagtttaattaagtcccacttgtttatttttgtttttgttgcaattgcttttggagacatcatcttgaaatctttaccaagacctatgtctagaaggctatttcttagatttttcttctagggcttttatagttttaggccttacatttaagtcttgagttgattttttgtgtatggtgaaaagaaggggtccagtttcaatcttctgtatatgtttagccagttaccccagcaccatttattgagttagggagtcctttcctcattgcttgttaatgttgactttgttgaagatcagatggttgtagatgtgtggctttatttctgggttgtctaacctgttccattggtctgtgtgtctgtttttgtatgagtacctggttactgttgccttgtagtacggtttgaagttgagtagtgtaatgcctctggttttcttctttttttaatgcctgtgacgtctttgttttagactgagagctctagtgggagagtgatgaattgaataaaagagatgtctcatccttttatctctcactagtctcacttgtctctcttactagtctcacttgtctctcactagtttattttgctatcgcttacattttcttctccatcttcattttgttttttacagactcaggttattatattaggttattctaatgatcagtgagaggttcttttctgttttaatctgttttacatactactgacatgctgagttgtttggaaaaaattttaattagctccttattcctattctaagtgaacaaattcttttgcattttgattttttttttcttgaagtctgatataatttggctctgtgtcccaacccaagtctcaccttgaattgtaataatctccacatgtcaaggacaggaccaggtggagataattgaatcatggggacagtttcctccatgctgttctcatgatagtgagtgagtcttatgagatctgatggtttcataagcatctggcatttcccctgcttgccctcattctgtctcctgctgccctgtgaagagatgccttctgccataagtgtaagtttcctgaggcctccccagccatgtggaactgtgagtcaattaaacctcttttctttataaattgcccagtctcaggtatttcttcatagcagtgtgagaacagactaatatagagcctccttgtaatctcactgtatttctctgctttctgtttgctgactgttccctgctttgtttagctagtgtgttcactgctctttatgttttatatctcagttttttctctagtatggggcactttctgttttcaaatgcatggcaatatctttcatagttatccatacccattgcaaatctcatcttttcatgaagatgtattttattggactgctattgtactatcctcttttgtttctgaactgttggttaatacattttagcaaatgattgttccataattgttttatatattctttcaattggccagctagattgttagcttctaaagcagcactaccaatagaaatataaaatgagccagacatagttttaaattttctagtagccacatttaaaaatcaaaagaaacacataaaattaacattaataatatattatattaaactcagtatatctgctactttggtggttagctgatattttgacagttacctacctaaaatgccaagatagagaagtattctattactacaaatatagtcacacccatcctcttaccctcataaccctaactcttggtaactactactctcttttctgtctttattatgttgtcatttagagaatgttccataaatagaatcgtattttatgtgatctttggagactgcttttcttcactcaacataatgtctgtgatatttatccaggttgttgtgtgtattgacagttggttcctttttattgctgagtagtattccatggtatggactttccacagttcatttagccatgtactttttgggagggcatctagttgtttctactttatggctattacaaataaagctgctattaacaattatgtacaggttttgttgtagctatgtttccgtttccctaggataaattcccagtagtgaaattacttgataatatgctaactgtatgtttagttttgtaatatactgccaaactattttcagagtgattgtaccattttatatccttacaagcaatttatgacagatccacttttttttttttgcatccacaccagcacttgctgttactactgttttctgttttaactgttctgatatatatgcagggataactctttgtgccatccatagatcctctttgatcaaatgcgtgttcatgttttctgcccattttctgattcaatggccagcttctttactgttgatttctgttacattctagatgagtcctttatcagatatgtggtttacaaatactttcttccagtctgtagcttatattttcaactttttaacatgatctttctcagagcaaaagtttttatttttatgaagtccaatttattaatgttatcttgaatggatcctgcttttggggtcatgtctaaaaacttttagccaggctctaggtcctgaatattttctgctatgttatcttctaaaagttttatattttacatttaaactatgattaattatgagttaatttttataaaagatatgaaatatcttataggtggaggttcatgttttttggcctgttgataaccagttgctctgacattgtttgctaaaaaggttgttcatcctccatttaattgcttttgtatcttttttgagaataacttgttgataatcatttagggctgtttctgggttctcgcttatgcttcatgatctatgtgtctatcaactcaccagtgctacagggtcttgaattattatagcaagtcttaaaattagagagtgattcctcccactttatttttgtttgttcaagaaaaaatttaaggtattgtaattcctttgcctttcatataaagttcagaattatcttgtttacatctactaaaaatatttccgggatttatagaaaatgcattaaacttatatgttaatttgaggagagttgatatctttattatgttgaatattccatgaacatagtatgtttctatatttatttaggtctttgatttctttcatcagtgatttgttgttaagaatgatagtcttgtacatagtttgttaaatttacatagacaattaattttttagtgacagtaaatggtattttaaagtttctgtttccacatgttccctgatagtatatagaaatagaattgacttttgtatgttgatcctgttacctagctaaactcactgaatggttacagagatgttttcctagattccttggtgatttctttaggccggttcatgtcatatgcagatggaacagttttatttcttccttttagatctctgtatcttttatttcctttgtttgccttattactctgcatagaaattccagtactgtgttgaatagcagtggttgtacaactgtcaacactgtctgcattcaaaactttttcatcaccccctacagaacctttatattcattaggcaatacccccacatttcccccttcctcatctttggtaactctaatatactttctttctctatgaacttggcctgttttagatatttcatgtaattgcagtcatatatttgcctttttgtgtctggttcatttcacttagcataatgtttcaagattaatccatgctgtagcatgtatcagaacttcattcatttttatggctgaataatattccattgtatggactatattattaaaagttattataaatttttaataattaagactgtagtattgggcttctttctttttgtttctgcttattcatattcctttgttcagttacagcaatggtgagaggacaattttctcagaaacttttcttgtctatttgactgttgagggcacaaacaattagtctataacattatgtgttatatatgatatataacacatatatatgtgtttatataatgatatataaacatttagtctataacaccatagtctataacaccactgctgtggtgtggatggctgtaatgggagtccaagaaaaaccatctttgtgggtactgggaggagtttctggattaagtggtatctaaattgatatttgtagatttaatggaagttaacaaatccagagtttgagagggaaccctgtatcatgcatagggagtaacacatacaaaggattttctatgaagtgagggatggtattgtagaaactttccttatggcagtagctgggaattagaaaaaactgaggctgggagttaatttgggctttctgaaaagtgttaccattttagagtttatccaaaataacaaattgcaaagaaatccagcagtttaacaattgttcactttgatttaaataatgaacattgaattattgcgtatgatcctaataatctaagatttcaaatcaagatatttaaagactcactctatacctaaaacatacacaaaaggtacttaaattgctagtatttataaacctcagtgctcttagaagacaacatgtttccaagtcagcattttgtatttcaaaatttttattcagtaaagtttatttactttatgtaaataaaagttactgcagtttaaaaagctcagctgtgatatttattttacacaaattcacttaagactgattcttgagtagcaagcatcattgtggaccacttctctaacagcggtagtaccttttagaattttttgaaggcctggaggaaaagaacaccgttaactgtgcaaatagagtatcacaaagatgcattcagatttgtaggatgtctcaactggtttatccttctcttttatatatggtcacagtgatttgacacatcttttcgaagaacagatttttagtatttagctttgttttttatttagctttttcagctttgctacatcatttcctttgctttttaagatgttttcttacgtgtttttaaagtatttttatttgattttcttatatttgaaccttcaaaatcttctttcttgcttttaactttaacaaattcttttaaattatggtctactacatgtagatgtttcatttcttacccataaaaatcattgtttcctcattttactcttcatagagctttataaatatcccctctctttctttctttcttaaatctacacctctgacttcatagcaagtgattaagtgcattttgtagtctatattaggatcctggatctaccgcttacttatgtgtgaccttagtcttgttgcttaacctcacttatcttcagtttctttctatgaggataatgaagcctcactgtagttcttcataggatcgttagagaattgtttaaataatgaaggtcaactctttttacttattatatgctttagttgctaataagcaactcattacaagcaaataaatattttcctaatcttgggatgatattttcattcagcagttagcctctttaacacgaatgtattaaaagttaacaataaaggttataaaaccatctcactgtagaaagcataggcccattacaacatctgtagtaaatatttttactgcttccggcaattaaatcagagagctaaatgatacatagaaaggggcaatgtgtttttggctgcgaaagatgtacactcaggcttcacataacagagcctgattgttagaattacatatattaattgttaattcctttcacagccgactccaccagcacccctgcaatgagcccatctctgctatttacatatgtaattatttggctctaccagactctgctaaagcagttacaactggtttaggagattcatctaaaaaaattctccaatactctacaattcaagtgtataccctttattctacaaatttatacagaggcccataggcataaacctcattatcggcttctattggttcaatcaataagtgtccgtattgttgattttccaaccttttgtttttatatagtttatttctcgagaaccttttctgagttaccaatcactagtgtacaagattcacagtagtgacagactgaagtcagttgggctcataataatgaacaaaaaggagttttatagtaagacaatggtatggtaaaaaagtgatgtttgagttggtttcagtaaatgtccaagtgatatctaatagagtgtatgatccataataaatttgattttgctggaaacataagacttaagcttgctgaatttcatgatacttcagaggtattcgattggtgactactttttttctttttttttaatagctggaagctggggtggttagagaactgataattgctaactttaactgaatgctaactgtatgtctcccattgtgcctaagtacttaactcaattatctcatttcatgctcccaacaattttattagacaggaactttttttttcaggtttgtaggcacatgtgaaggtttgttacataggtaaactcatgtcatgggggtgtgctgtacagattatttaatcactcggttatgtattaagcccagtacccaatagttatcttttttgcttctctccctcctcccaccctccaccttcaaatagaacccagtgtctgttgtttccttctttatgttagtaagttttcattatttagctcccacttataagtgagaatgtgtggtatttggttttctgttcctgcattagtttgctaacgataattagcctccagctccatccatatccccataagagacatggtattgttcctttttatggctgcatagtattccatctggtatatgtaccacattttctttatccattctgtcattgatgggcatttaggttgattccatgccattactattgttaatagtactacagtgaacatttacatgcatgtgttttcatagtagaataatttgtattcctctggatatatacccagtaatgggattgctgggtcgaaaagtagttttgcttttagctgtttgaggaatcgccatactgctttccacaatggtaaaactaatttacactcccaccaacagcacataagtgttcccctttctttacaacttcaccagcacctgttatttttgactttttaataatagccattcttcttggtatgatatggtatctcactgttgttttgatttgtatttctctaatgatcagttttattgagctttttattcataagcttgttggccacacttatgtcttcttttgaaaagtgtctgttcatgtcctttgcccattttttagtggggttttttttctcttgtaaatttaagttccttatagattatggatgttagacctttgtcagatgcatagtttgaaaatattttcttatattctgtaggttgtctctttactccattgatagtgtactcatagtgtacaagtgttcccttttcttcacatttttgccagtgtttattatgcttgtcttttgaatataagacatttttaactggggtgagatgatatctcattgtagttttgatttgaatttccctgatgatcagtgatgttgagtatctttcatatgcccatttgccatttgtatatcttcttttgagaaattgctatttaaatcttttgctcatcttggtttggattattagatattttcctatagagttgcttgagctccatatgtattctggttattaatccgttgtcagatgggtagtttgcaaatattttctcccattctctggattgtctcttcactttgttgattgtttcttttgctgcacagaagctttttaacttaatgtgattccatttgttcatgtttgctttggttgcctgtgcttgtggggtattgctggtgaaatttttgctcagaccagtgccctggaaattttcttcaatgtgtttttatagtagtttcatggtttaaggtctgagatttaagtctttaatccactttgatttgatttttgtatatcatgagagataggggtttagtttcattcttctgcatacagatatccagttttctcagcatcatttattgaagagattgtcttttccctagtgtatgttctaggcacctttgcgaaaaatgagttcactgtaggcatgtggatttgtttctgggttctctattttgttacattggtctctgtgtctgtttttatgccagtaccatgctgttttggttactatagctctgtaatataatttgaagtcaggtaatgtgatttctccagttttgttctttttgcttaggatagctttggctattctaggtcttttgtgattccatataaatttgagcattgttttatctatttctgtgaaggatgtcattggtattttgatagggattgcattgaatctatagattgctttggatagtgtggatattttaacaatactgattctttcaatccatgaacatggaatatttttctattttgggtgtcctcttcaatttatttcatcagtgttttatagttttcattatagagatctttcacttcttggagtacattaactcctaggtatttaattttatgtgtggctattgtaaatgggattatttttaaatttctttttcacattgttcactgttggcatataggaatgctactgatttttgtatgttgattttgtatcctgtaactttactgaatttgtttattattctaatagttttcttgtgaaatctttaggtttttttcaggtataagattctatcatccgcaaacaaggataatttgacttcttcctttcccatttggatacctttttctagctttctcttgtataattatgctaactgggacttccaggactatgttgaataacagtgttaaccgtgggtatccatatcatgttccagatcttagagaaatgacttttagtttttcgtttttccccattcagtatgatactagctgtgggtctgtagtatatgctttttgttgtgttgaggtatgttccctctgtccttagttttttgagagtttttatcatgaagggatgttgaattttatcaaatgcttctttaacatcagttgaaatgatcttgtggtttttcttcattctgctgatatgatgtatcagattgattgatttgtatatgttgaaccgtccttgtatcccagggataaatcccatttgatcatgatgggtgatctttctaatgtattgttgaatttggtgtgctatgttttttgttgaggatttttgcatcaatattcatcagaggtattggcctgtagttttctttattttattttattttttatgtgtctgtgactggttttggtatccgggtaatacgggcctcatggaatgagtttggaagtattccttcctcctccatttggaagtatgcccttctcctctatttttcagaatagtttgagtaggattaatattagttctttaaatgtttggttagaattcagcagtgaagtgcttttctttactgggagacttttattacaacttcagtcttgtagcttgttattaatctgttcaggttttggatttcttcctggttcaatcttggtacttgtatgtgtggagcaattcatccatttcttctagattttccaaataatttgcgtgtggttgctcacagtagccactaatgatcctttgaatttttgtagtatcagttgtaatgtctccttttttatttctgattttatttatttggatcctctctcttagtctggctaaagatttgtcaattttgtttagcttttcaaaaaatgaactttttgtttcattgatctgttgtattgttttcttcatttcagttttatttatttctgctctgatctttattatttcttttcttctactaattttggatttggtgtgctcttgatcatttagttctttaaggtgcagcatttgattgtctgtttgatattttttctcttttttgatattggcacttataaacatccctcttagtactgcttttgttgtatcccataggttttggtatgttgtgtttctgttattattagtttgaagaaaattttcaatttccttcttaatttcttcattgacccgcttgtcattcaggagcatattgtttaatttccatgtatttgtatagtttctgaaatttctcttgatgtttctagttttattccgttgttgtcagagaagagctttatattatttcatttttttggaatgtctcaagatttgttttgtgacctaacatatggtctgtcttttcagttgatccatgtgctgaggaaaagaatgtgtattctgcagctcctggatgaaatcttctgtaaatatctattagctcaatttggtctgtagtgcagatgaattctgatgtttctttgtttattttctttctgaaagatgtgtccagtgctgaaagtgaggttttgaagtctccagatattatggtattggaacctatatttgtctttagctgtaataatatttcctttatatgtctgggtgctccagtgttgggtgcatatatattgaaattgttatatcctctcacttaattgacacccttatctttatatagtgaccttctttgtctctttttatagtttttgtcttgaaatctcttttgtctgatacaagtatagtgacttctgctctttttttggttttctttggcatgggatatctttttccatctgtttattttcagtctttgtgtgtctttataggtgaagtgtgtttcttttaggcaacagaccaataggtcttgctctttcatccatttagttagtctgtgtcttttgattggtgagtttagtgtatttacattcaatgttattattaagtaaggatgtactcttgccattttgtttttggttttctggttgttttgtggtcttctttcttgcatttctgtcctctagtgaagatgattttctctggtgatttagtttcttgatttttattttttgtgtgtccattgtataatttttggtttgaggttaccatgagccttgcaaatactatcttatcattcattattttaacctgataacataacactatttgcataagcaaacaaacaagcaaaaagaaaactagtaaaaacttgccttaacttcatttccttgctttttaactttttgtctgtttatatctcattatactgcctatgtcttgaaaagtagttgtagttattatttttgcttggttcatcatttagtctttctacttaggataaaagtagtttgcaaaccacagtaacagtgttataatattctgtgtttttctgtgtacttatattaccagtaaggtttgtattttcaggtgatcatttattgcttattaatgcccttttctttctgattgaagtaccccctttagcatttcttgtaggacaggtctggtgttgatgaaatcccttagcttttatttgtttggtaaagtctttatttcctcttcatgtttgaaggatattttcactggatatactattctagggtaaaaggatttttccttcagcaatttaaatatgtcatgccactgtctcctggcatatatggttttcactgaaaagtctgctgccagatgtattggagctcctttgtatgttcttgtttcttttctcttgcagcttttaggattcttactttattcttgacctttgggcgcttgattactaaatgtcttgaggtagtcttctttgggttaaatcttcttggtgttctataaccttcttgtacttggatgttttctctaggtttggttagttctctgttatttgaaggtttactcagaataaactttctacacctatctgtttctttacctccttttaaaggccagtacctcttagatttgcccttttgaggctattctctagatcatgtaggcatgtgtcattggtttttattcttttttctcctctgtgtgttttctaatagcctttcttcaagctcattaattctttcctctggttgttccagtctgctcttaaaggacttgatgcattcttaagtatgccaattgcatttttgaactgcagaatttctgcttgatttttaaaaattatttaaatatctttgttcaatttatctgatagaattctgaatgccttctctgtgttatcttgaatttctttgagtttcctcaacacagctattttgaattctctgtgaaaggtcacacacatatctttgtttctccaggattgattcttggtgccttatttagttcatttggtgaggtcatgtttttctggatagtgttaatgctagtagatgttcctcggtgcctgggcattgaagagttaggtatttattgtactcttcattgcctgagcttatttatagccacccttcttgggaaggctttccagtgacactgtgattcttgcagacttgtagaggtactgccttgatggttttgggcaagatctgggataattctctagattaccaggcagaatctcttgttctctttccttactttctcccaagcacacagagtctctctctctttctgttctgagacacctaaagctggggctggtatgacgtatggcacaagcactcctatgaccaccaccaccatggctgtgctgggtcacacctgaagcaagcacagtgctgggtcttgcccaaggcctgccttaatcgctccttggctatagcctatgttcactcaaggccctagggctctacaattagcaagtaacaaagccagctgggcctgtgtccttctcttcagggtggcaaagtccccctggccactagtgggtccagagatgccatataggagtctgggactagagtcttagaaatcttagaaaccttagaaatctacctggcattctgttgtattgtggctgagctggcactccaaccacaagacacagtccttccccttttccacttttccccttttcccctttccaaaggctgaggagcctcaccccttagccactgccactcctggccatgaggagtactgccagagtaccaccgacattcccttaaggaccaagggctcttctatcagcttgtggtgaatgctgcctggcctggactcaaccatcagggcagtaggttcccctttggctcagggcaggtctagaaatgctgtccaatagtcaagtcctagaattggggaccccaagagcccacttggtgctctaccctactgtagtgttgttggtacctaagatacaagacaaagtcccctttactcttctgtttttatcaagcggaaggggttttgccccatagccaccacagctggtaatgtgcatagtctcacctgaagccaacaagtctcagaaactcaccaaggccctcagcgtagtaccttggtatcactgctggttattcaggacccaagggctcttcagttagcacatgatgaatgctgcctagactgggtcctttccttcaaggcagtgggtttccttctggcccagggtgtatctagaaatgtcatcccagagctagagcctggaacaagggcctcatgacctcagggtgccctattcttctgtggcagaactggtaaacaagatgcaagacaaactcctccccactcttccctctcctcttctcaagtagaaggaaggggtttcttttgtatccacaagctgtgcagtctggggttaggggaggggtgatgccagcattcccttagctgccccagctggtatctcagtgtgtccatgccactttagtccactgtgtttgggcctagttcagcactaggacttacctatgaggtacagtccttatggcctagactgcctttcaagtttacttaaacaccaagagcactctggcctttggtactgaggttttcaggcactcaggtttggactgctggtatcagtgattcccctctggctagggctggttgagatgccttcttgtgggtggacatcagcttagtttggtcaggttttcctttatgctatagcaagatggccccaggttcagtgcctcacaattgctctgttctcccttcaccagcacccagagatgctcttggcaccaagccatgctgctggagtcagggaggggtggcgtcagagactcagaactgttttctatcttttcagtgtctctttcagtgatacgaggttaaaaccaggttctgtgggtgctcacatgatttttagctcttatgaagaagcttttttctgtgtagttgtttgttaacttagtgtccttgcggtagggttagagggacgatctgtggagttttctgttctgccatcttgcctcacctccctcctaaaaaatattcttatatgagattgtaatgtttatatgaacttgcatgaagacagaattcttgtgtttggatcctgagtctcttacccattttgtaacattcttcaacatacttttaactctgtgcctatgattccttatctgtaaaatgaagataataatagtgtcataatagatgtaaaacatgtaaaacaatactaaatgccatgtaaggttaagtggtggtattattactatttatcctatttacatcatattctgtggtcatctgtcagtatttgtgaatacctttcagtgacaggaaattaattttacttcttgatcctaattctactccctgtctgttcctaatcttgttttgcctttgcttcctcttttctcatctactcatattttatgtcttccttcatgctttatataacttttagccaccttcaatgttttttggaataaagtaatgtatgcatacatacatatacatctttgttcctagaatttagcactgttagtgcatggtttttatcttggacattcatatattctagttccagaacagtaacttctagaacttaataatttattaaggaatcaatgacttcaaatttgtcagacgttgtatatgattattattttattcctaaatcttatcgttctttagaccaaaaggatatccagtttgacagtgttcttttttaagaatgatgcttttaactgaatataatagttcctatgggattcgatcaacagagagtaaagagtgttattatgttattttattctatgtgtatttgtctattactgtacttaaaataccaaatgggaggggcagtatgactttggactcatttgccataatgctgaagttaaatgtgttgctgttaaatcagctttcttttacccaattcacatttgtgctttaaaaaaaaaagcattacaagaccttgcatacttctgttcaacttattttttaacattcatttcattatttcaatatttcttataagttgtatgagtttcatatttctttatcttctatatattgagattatgccccagttatatctctttgtctgtaagactagtaatgtcaaaaaaaatgaatttcatgtcttaaaatttatccttagtaaattctgtattttctgttgattatcccttttaaaggccaaaccctctttttaggaatttttcctgaatctcactcaggaatcacatgctgtagtttgctctattttactagatttgaaatcacccttttccatttatgtgaaaattagatttctgtttgctagtttcgatgctcacaatgcctttcacttatttgtagctcttatacttttgatcaaaattaattttataccagaatccttgaaattttttagagtagtagctttgaattcttgttattatttcattctactgtcatcgataacctcccatgttaacactattgtttctttctgtttactttcagctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcaggtatggggttgtctgacaggaaagtataacttaaatgtttataaagtttcacatacttctctttatattctataggtaatgtagatttgttgacattactttgatttaaaataaatggaaatgtgtggaaattttactttttatattaatggaaaacctgaagagtgcaagaagaaaaacatacttactatagtagacaaacataattactaatgttgttttctaaattttagaaaatctcagtaccatggagtgctatgaaatctatcagaaaaataaacattatttttatgtagtatttcattaagcttttacataattaaaataccacaataggtattacagttctgtataatgagcattttaccaaattcttctagttctgtgcccctcaatctggcatatatgcaactatgacaggaggtactaaaagccttatataagcatggtgtatcttttggatatgtccattttggaagaaacttttgtattaaaataaactaatatattatgggctagaacataaaattcaccaagaatttcaagataaaaatactaatgttttgcttgtttgggtgatttcaaacaataactttgaaatctataattttttcaccaccaaccgtttactaccttgcatgctcattctcctgtgtggctagatgcatttcagaaaagtgttttgaatattattccagagcaaatatcattccagaaaataagtttaaagtttaaaatgtttattttttgtaagccacgaatcttcagcctaagtatcttctgacataaaagcattttcataattataaaagtgctgatattaccctccacagtattatacctgatcctggaaagtagttcagataccagagaatactcttttaacattttggcttatgcatttcattatttttaaaatttatggaacaaaacattaaacaagaatggaatgaaaaatggcttaaaaaagaatgcagaattgcaaaaagcatgctttgaatttaaatatttcaaaaaatttgattttctgagaaaatatattaaaaatcatatctaattaccttcagggtggcatatatcttttttttagaatgatttagcagtccctgtattgggtactgatggctaacttgatgaaaaatgagattcagacatctatttcttaaaatacctttttaatattaatagtagcatttctataaattctagaggtacttaatagaaatttattaatatagacttacatgtacacatgttttatagaatatcatatgatcttttaattcttacatctgagcttaagctcttaattttttttttgtaaattggctgctactctatggagtgcagtttagagaatgagccaaaattacatgcatagtagtttactggtacataattcatcagcactgaaatgtgaaagtgacagtgaagatgattgtaccatagaagttcatatcttgacattgctgttacataaagctccttaattcttttatctttttctcagtaataatattaataacaaaatttttcactttttgtaatttctagcatttcccttcaaaagagcttgatgatggaaggatatgagaaaagagaataaatgtcagaaaaatacctctgtcttactttttaatagagaaattaaactttacatattatactaaggaagaaccagtagccactaaaacacgactaacagttcatatctgaatgtattgtagtatgttaaattcaatggggtactttttatttaataatgtagtaaaagtgtcactaaaaggtggctaaattaaacattttataacaaattgatgagaaaatttcttggtcttagtattttttcttttaaaaaaaatcatttctaattactttcaatcttgttctccagcaaagaagaccgtctataataaaattaaactgagctgcttggttgtgttacatatacaatatataagtaattcgtattttttctcttttaaaaatgatttctgattacttttaatcttgttctccagaaaagaccttctgtaatagaattaaactgagctgcttggttgtgttacatatacaatatgcaaggaatttttaaaaatttctaattaaatacaaatttaatagattactttttgtgacatacatgggagataagataaagatgaagtcttgtataacctgaaaaaatttaaacgttgcaaatattttttaaagtttttttaaaagtattttatgtaaacctttaagaaatcttctgtaaaggttgccattgcagctaattgcttaaaaatacttcatattatagcaacattaaatggactaagaaaaaaatacttcatattagcttaggatttttatagtacttaaatttttttgtagaaacacactttttgacctatatgtactaatattttaatacatttttgttgcttcagtgatgacatgttttatttcattaaaatatcactctgaaagtggcatatccactgtcacaattttgtcatagagattattgtgtgttaaataaaattatttaattattaattgattattaattgatgaagataagcatactaagtttccattttgaaatatacaaatgacaaatattttttaaagtctcaaattccagttattaatctgtgatatgatattgaataatatacattatatatcagtactaagtatttcagcttaccctaacctaacctttttattaattgattataagcttttagaatatatatgtgtattgctttgtaataacctttgtagtatgtttcattcttaagaagtgctttagaaattgagaaaacgaagtataaatgtttagatgttcaatttcttgcaaagaacaatgacagaaaaagtattaatcacaatatgtagagaaagcaatcagagacaagagattaaatgtataatttttctcattattaggtgtgctggtgtgtctgttatatgcacataaacactcacactagcatgatggataccactattaatgtgtttaaattacacttctacttatagactagtgtgtaagagtgagggttctgaagctatactgtctgggtttgaatcctgattctaccacttgctaggtctatgttcttgggcaatgggaataaattatctgtgccacaatttgctcattttaaaaggggataataatggtacttacctcataggcttgttaggaggatttgtgaggttagtatctgtaaaccacttggaataatgtttcacttggagtaagtggtaaaaattgctaatgggccaaggaatataccaagaatatattaagaatagataattctgaaagacaatatagtcagctgttactttttcatttgacaataaccagtttgcaattttaaatctttgtacatttgcatattttacctacctttccctgcacacagcaggctgtgttgtggtgtgtgtgtgtgtgtgtgtgtgtgtgtgtgtgtgtgtgtgttctgggaatatgtaaaatctattttacatttctgctaagacagcttaattgcggtggtaatttaatgggggaaaatcatgtaattcaaataaattcttttggttatttaatgagttaaaaattgttaattggaatggctattcatgaggacatttagctgtattagatacatatatatatatatagagagagagagagagagagagataacaatgataacttttttctttcaaaaagtatattaccttgacagatggcagctcatgactagagttcagaataactttattttcctttgaagatcttctagttgatatgttgggggttcttgccagctacagcatcactgtcaaggagttgaagcttttgttcagcatgcttcgaggagaaagtggaatctgggtaagctgtggtcggagggaaaggtattcagtatcagtccattaatacttaatgttcaaaagtttgtctctagagagctatatacttgaatttataatggaaattgctttcttcttaaatgatttagtaaatgttttgtaaatgatttaaaattaatttttctctctagttagaaaacagtccaatgggtaacatggtatattaagtatgattgctaaatttgtacaatgacatttctttcttttattgtttccccagccaagacatgcagtaaaattattatcagttcttaatcagatgccacagagacacggtcctgatacttttttcaatttccctggttgtagcgctgcggtaagttttaaatacatgtgctgatttttatttatttatttttaggtcacctttagtaaggtttaacttacatataataaaatttaccagtttagaaagcacaacttgatgagtttggaagtcatacaaccactactatataatgatttgaacaatttcatcactccccaaaattcccttgtgcctgttggaagatattcccctctacccatccccactccttactacttctgatttactttgtattcctatagttttgccttttctagattgtcatataaataaaatcatacagtatacagtgttttttgttttgttttgttttgttttgttttgttttgtgtttttgacggaggcttgctgtcacccaggctggagttcagtggcgtgatcttggctcactgcaacctctgcctcccgggttcaagcaattctcctgcctcagcctcccaagtagctggtattacagacacccgccaccatgcccagctaatttttgtatttttagtagagacaggtttcaccatgttggccaggctgctctcaaactcctaacctcctgtttgcccgcctaggcctcccaaagtgctggggttacaggtgtgagccactgcacccggcctggtatatagtcttttgtgtcaggcttctttcacttcccgtgatgcttttgagatttttccatgttgtagttttaattactgttttattctgttctctctttttttgagtagtatggcattttatggatataccacagtttatctatcctatccattcactagttgatggacttctgggtttctagtttttggctgttataaataaaattgctgtgaacatttgagcacaggtctttctatggacatatgttttcttatctttcgattaaatacctgagtgagattgctggattttatggtaactgcctgtttactttcatgagaaactgtctactcgttttctgtattagaacattgtacattcctataagcagtgtatgagagtcccacttgatctgcatcctgaacattttcagtcttttaaatttgaggcatttaaatggttatgtacagtagtcccgccttatccatggggtatatatgttctaagactgtctcagtggatacctgaaactgcggatggtactgaaccatctatataatacatactatggttttttcctctacatacatacctgtgataaggtttaaattactaactgcacacagtaagagattaacaacaataataaaatataacaattatagcaatatattatagtaaaacttttgtgagtgttgtgtctccctgcctcccctccttctttgtctctctctcaaaatatcttaatgtactgtactcacctgtttttggactgtggttgaccatgggtaactgaaactatgaaaccacagataagaggggatctactgtagtggtacctcatcatagttttaattttgcattttattcatgactgatgatgatgagcattttttcatgtgtttattggccattcttatgtcttcatttgtgatgtttctgttcacatcttccgttcatttaaaaaattcggttgtttttcttattatcgtaagagttcattatatatttggaatgtaagttcatctattagatcaaggtaaaatattccctgttttaaaaagtcaataaaagttatatattatttgataataaaatgttatttatattgtatgataataaaactgcctgaactaattgcttaaatactaaaatccgaaaggttagtatagggtttaactcttcatttgaaattgtgtgtgtgtgtgtgtgtgtgtgtgtattttttttaacagcaagcacttagaaatctttgactactttgagattatttattagccacctgcatcttcagtcattatgcttggagtagattacattccttactcttgaagaactctgatggctagatatgcaaatacagcttgctacaataagagttataaatgatactgtagatttaggtatgggaacaaaactatgggaacacaattgaaaagagaaaccatgctaggttgaagtccagaaaagcttcacagatgaggaaacatattagtctgctattaaagaataaatgagattttgttagaaggaagaatgatttggatagaagcaacatgatgtataggaagaggaactgtaaaagaactagtggaatagctggtatatttagatgtactttggaatgtggggttgggtagtagaggaggataaaatcagaagggtttgttggagccatagcacgtgggaagtcctgtataacatgaagaaatttaaattttattctgaatgcagaagatttttgacatggaaggtccgtgttgtatttgagaaaggccattatcagcaacatgaaagatctatttgaggatatcttttatgtagaattttgataaagtctaggaaaataaataaatacattcacacatttcttgaagtcaggtgaaataatcagctactttcttatttattccttagaatggctacattttatttgattgctattttcaagggagtcctatattactccttttctgcttatgaatggatctgaatcctttttggttataaatatcagtagttaagtttctgagtaataaatgtcatactttgcctttcttagtttcaatgttgttagcattatgaacattatctcttaatgcttgcatttcttcaatattgattccattaacattttctagctcagtcatttttggctttaaatattcaatctcctttaaccaaatgggttactactgaaaacctagtgtaaaccacagaaaactgaaattgggaggcttatgtgtaagagactgtatactgatgaaactagatggcgacttcttggagtatagtctgaaacccgctatgtaatctagagataaaatctaattcactgagcatttgaaaattgaatgtttctataatcaacaaatactatttaggtgtactgagattgttttaataaaatactagctcttattttatggatttgtttgtgattttctggtatttatactttgattgttatttaatctgcaaaagccatatttgaccttagctactatcacatttctttaactgatactttcgtaccttttctcattgccttgtaggcaattgccttgcctcctattgcaaagtggccttatcagaatggcttcaccttaaacacttggtttcgtatggatccattaaataatattaatgttgataaggataaaccttatctttattggtaagtaatatgtttaattttagtacttttttctttaagtacttgaattctataaatgtatagtctcaaggcaacttagatagaatatatgtatatatgtgcgtataatatatgctagaactgtgaagacactgtaaatcagttttatttatgtatgtatatatgcatttattttgctattgattctaggtcatctgcttcatgattatcattcttttccaattacagtttaaaagtcaaaggtacagactttctgtcccagtctccttcaatgtatatcagttgtgggatttttagtgaggattgctggtccctgaaaaaaattccaaacttttaccagatttcattcatttttgccttttcacttactttgttctatgagcataactgacatatgctttaaaattgttgataataactatgtaagaaattataagataagattatttggtgtagacaactagaatgagttgatcaacctaacaatgtgttgatctgtaagggttgaaagcttgataattttagtatgccagtaatacacagtacagcatacttaacaataagtacatcaaacattcattgattgccatactgtatgctaggcattgtaagtgtttatatatatgatttcatttaatacttgcaatactctgtaataagacggcctgtgttcaagttctggctttaccacctactattcaccttgtacttttggtgtcttcaactataccaatgaggatagtaatagtgtctatcccataggatttaatgagagaatcatatttaaagctctttgtataatggctgggtcagaaatgtgaacacagaaatatgtgagctattactatcttctaagctctattataaaatatatatggataaaatgagaccaagttttaaataagcatctgaacttccaaacataaatggggttggacttcaaagtggtcattttgggagatcatacattaatttcagtggtatctgcatttttcagtgattaaacatttttctacatcgtgataaatttacagctaagggaaatgctcttgtagaagaaaacaactatatttcatagttacatctttttaattttttaaactaaaaatgtactgctttgcttgatcaactgtatcatttatcaaacttgactctgaccaagtttttttttctttttctttttaatttctaagctattttcaaaggtataccagaattagagagcaggttgttatttaaaatgtgaactttgtgtaaatgtgttctgtatttgctgattgcaaatggtccttaaagtctacttggtggtaggcttttgttggcaattaatttgtttttaagtatttctgagattttagattgaaatactaaaagctgtcatagtcttttatttcctagtttaaatttcttatatttacttataactaaccttttatatttttgtttagtttttatttgacacatattaaactgcttctactgtacagggaaataagttttatttttataagaatgtttaatagccattaggtgtttagttctttttatcagaggatattatactattctcagttgtctttgcagttttcgtactagcaaaggagttggttactctgctcattttgttggcaactgtttaatagtcacatcattgaagtccaaaggaaaaggttttcagcattgtgtgaaatatgattttcaaccacgcaaggtaggtaaaagtaaatatttttataactcacctgttatgacagaattcttaactctccttttatgagctctgtagtattctctttcacgggttttcctatgcttttaattgttttctcttatccttgtctgcatttcctttttacttttatgtctaatttttgtcttctgtaagatcagtgttttgatatcttgtggtgtatttctcttacactctctcattatctcagtctgatctgttttatggcattctttcaatagatacttattatctactgagtattggataccattgtaggcactagggattaataaatatttgcctttttttaaaaaagttaaatgttaaacccccagattaagcaatgcacagacacattttttttgtgggagattaacctaatcctagtagttctgaatattgtttcctgagattgaaggttttgttaatttgtgatgctttaataatgctggcttcaaggagaggaatgttgctgtactgttagttttggctcatgaaatgtatctttacttaatatctcaaataatagcagagacaaggccaaaacacattttaaaaactgctctaaagagaaaatgcagagaactgtgcaactgtatgattagaattataagagataattcattcataatcaggtggcattttctagagggattttcctgcctgagtaccagactccatctttgtgtcagaataacaaaccatctgaaaatccagatgaaagaaaaccaggacagagtgcataggggtacccgtcacacatgtttaaggctttgttccccttccaggttcagggttctttcttgggtatatgacagtgagattatcaacgttttttagggcacactgcctcctcctaacagaaatattgccttaccctttgtgattaatggtacaatcataacagatatgatgaacccaaatgtggtgagggggagatctttatttctttttcgtatcttttttgtttgttgttgcttatgatctgatgtgtgtcttcccatatacggaaaaatatattattttgggtggtatttccaaaatttgtttagattttacatgattctaataaaaatatttgctttatatttaatgtcagttattgtcatttctgttaaagaatatcaatttaacagtaattcattaacatatacttagaaaatgatttaaaaagcaatgattctgaataaatatattcattcattataatggtgtattctttcttttttaatacaaattgattattttaataccaatcacattgcctttgctctggaaattctgttttattagaattaaggtgagaccaagatagtttgctaaaagtgccaaattattttgaatttcagtggaatagattagaagtacagttgttggtattataatttttcatgttaggattgtgtgtttttaacaaatattctaggtaacttttctcttcagacaattttaggaaatggtggtttaaagaatgtacaggcaaacaattagagtgaagttataaccaaatgaaattgtcattaaccaataaaaagcactttaacccatttgttctcactttttctattttgtgtcttcttcactgttcacttttggaaaacacattctcctttgtaaagctctcaatatgcagtgaatctaaggggtctagttaggagcagggccagagagtgatgtggattttaaaaagtcttttgtgaagattctcacaaaccttgaaaagtcataaatatttgcttttactgtgtttcattattcaaaataaattcattctcttgtttattcctctctttaattttccatagattccctagctaagttgttgttatccttcctaataagagatttactggcctttcaaaaagaaatctttacattaaagcttttgctttcccagctgtaccacttaaccagctgttagaacttgtgaaaatggatataaaccattagcatgttacctaatggtaatatgtgctctagacatattagctactattgatatcatgctgtacttttaattttcaatttattttcatatcttcaatttataatacatatcttgtggattcttaatatggatctttttattccttattactggttgtgtctttcttttataaatttctttttgagtctcaaactaaatgcagacttcagtatatatacataatatcactatgcacacatagtttccaagtttatttttattttctttagtcaaagtatatcagatcaaaagttaggcttttttttttaaccattgaaaaactcatttgtgtctgttatctgtagagtacagtttggtgtaccaaggaaagagaaaagttacttttcttgtaaataagtactatggtctttactgagatcagctcattaatcagtgcatttgtttattcattcatttaattttatcatatattattgttacaaccaaaagcaaaccttgataaactccaaatctgattaatttttctgtattaattatcttaagttaatggtacccttacccatctaagtgaaaattggaagccatcttagactcccatcttagactccccttttatatgttaacacttcctatcagttctgttagttaattcccatcctcattttaaaattatgagtgcctttgtcttagttccgcagcttatggtgtcttacctaaatctttgcagtggcttttcaattttatctttatccacacttgcctgcctatctcacctccacattgctgccagttattttctttaactatggagcagatcgtttcactttcctgctcagaattatttagttataccacattatgcaaaaaacaaaggcctaaaggtctgtttacaatctggtctttgcctgtttttgtttttgtgtttttcctgctaaacctacacactgaggaaagttttgtcaagcatctgtgctgtattgtattaagattctgcctggaatgtttttttaaccactgtctactgaacagttccttttcatccttcaagcttagtcttacagttcattttattcttttagtgaatatttctatgatagtctttcttctctatttgtctttccttcccagttacttatagtatttacttttattactcccaaatctgtattttagatactctctattctcataactgtttctctagtgaaacttccttgagtgtgtatatgttgtccgtctttatatacccatgatccaaggttgggatagggtacttggcataaagtaggctcagtacattttttgaatgaatgaatgcctttgaaaggtaaataataatcaattttagcataaacaaacctcatcatgggacatagtagataaaaacaaaatagcagtttagtcaatggtatgttatgtatgggtgccaaatacattaggaacttttcctcatagttttcatacattatctatttataatattcacaaggaatccacaaagtaggcattattattcccctttttcagagatgaaaataggttcagagatactaagtaatttgccaaaagccatagagctagtaacttgggaatccaattcatgtctttatgaagtaaaattcttcctgcccagtacattatctggagtagtaagaactcagtaagtattgtttgaatgagtactttttttaatagtaagtacaccaataagtataataatacatctagtatttatcttaaaactgtctttgggcaggaaatcttttcctatatgtaggcatttattcgtgtctcttctctttagaaatgcaaagtttacacattttattccacaatataaagtttgtgtcttctgtgttatttagatagcattctgattgaatattttcaaattcagtgaaggtaatatatgcaaactttaattcttatacttgtaaaattctataagattttccttaaatttatttgacactctttttacggttttttcttgataattttgtaatatttagaaacaattgttaaatgaatactttaaagattttctcttctgattttaatcagggctaacatatatgttggtttcaaatcaagtgaaagacttagtttccaataaattaatgattacctggaatgaaaaaacttaaaaaaggatgtgcattttagacagttaaatgtcttgacctgaccttgcttttatagaagcacactgttgttttgtattactgacttttttgagttaatacactgttttttttttctttttctgttttcttttcttttttttttttttttttgagacaaagtcttgccctgtcgcccaggctggagtgcagtggtgtgatcttggctcactgcaacctctgcctcccaggttcaagtgattcttgtgcctcagcctccctggtagctgggattacaggcacatgccaccaggcctggctaatttttgtatttttagtagacacggggtttcaccatgttggccagcctggtctcgaacttctgacgtcagttgatctgcccaccttggcctcccaaagtgctgggattacaggtatgagccaccgtgcccagcctatttttattttctaagttgaaatgaacaaaattgaattttgctcaaagtattttagataccttgaaataactaatattttagtgattaaggattattgtaactttttatttctgaaaatatatatgaaataattgaatagtgcatttaaataatctgtagaacaaagtttgtattttatattttggtgggagggagaaaccagttaattttccccccttaacttcagaaagcatacttgttcaaatgtttacaaatcatttgtatttttctatactttagaaaaaattatttctatattctcgattttaggctattaactctcaggagactaaaggttgctacagaaatcaaaccatccatattaaaatagatacttaaaatgctttttgataccagtaactataaaatgggcacttaatatgaactctttcatttattcttaataaatattcccacattgttattaaatatataattatcctggatttactaaatctaaatggtgaaattgaagctacctaaatcttattataaatgctaaaatgttgtttctttgacagatccttcctgaccatgcaatccaaagtagaatccttgtttattctttttcagtttatactgttctttttctcttcactgtaatcaccatgatttataattctacatttgtttaattgtgtcatatatatttcttttactagctcataaattctaggagaactggtcagccttgggtatctgcagtgcttggcacaatgtaaattttaaatgaatgaacacaaataaattgtatttctacaatttcgaatcttggtatagtggaaggaacgtcacgctggaggtcaaggggttgtagttcttgtcttctccaggagtattctttatgtgccacttctaccatctgtgaaatgagaaatgagagggggaacttgatcaagtggtattagatgatccttaatagtcctgtcagcatattcttgtagggttttatgaatgttacaattgcattttagactgtaacaaccaaacattacatattgatatatttaatttttttatttaagtggtacatgatcagcattgtccacatttacaatcgatggaggaacagtgaaattcggtgttatgttaatggacaactggtatcttatggtgatatggcttggcatgttaacacaaatgatgtaagtctttatttttctgtctgtgttttaatttgtttgggagtatgatctatcattacaatatgaattaaataataaaatagtttggtagaagcttaaaactttgaaagtttattctttttattaaataaatctttcattgttaaatttagtataagaaaatttctaaaagacatgattagtgattaaaaaaacagaaacatttagccaaagttttaagttttttagatcaaaaaccatgaatcctgtattctgtttttttccagcatcaagcactaaaaaatgtggtttaccccttatttagatatggaaagaagaccctaaacagaagtataacagatagtcactattattaattacatagtgataaatgctatggagaaaataaattggggatacaggaagtaggtgtagggaagggagaagcaagatggtccagagatgattttagtaggaagagttgagcaagcaagatatgtggggaacttcttctattcagtgggaacagtgagtgcaaaggctttgaggcagaataggaaagttcaaggaaaaggcaatttgtctggagcagagggaggaagaggcaaaataatattaagagatgaggttaggcagaaatcattttggccttcataagcaaacaaggcctgggttttcgcatcttactcagcttaaaaatccttggaaggttttcagcagacaagtgatgtgtgcttctattttaaaaccatcagtctgcctgcagtattgagaatattttgaagggaaattacagaagcgggaagatcacttaaatcgcttattataataaaacaaagagactttattagtgtctaccagtatattagcaggggaagaattgacacagttggattctaggtagagaataactagaatcaaaacctcaagggtccttacggtttctctactttgggctttccattgtctacattccggcctgtcagagccaaagtgaaaggtttgttttaatgctgaaagtacctccaagctcaataatatacaacccttcaagcatacctggttttataagaacttacctcttaaacacaattcatttctcagttttgtttgcatctctctaggctttcatctcccgaagggcagggatttgcttatcctgtcttgtattcttttaactagcactgtgcatatggtccacagtttgtcccctagattggggctgggcagactacaccctatgagccaaatctgaccctccccctgtttctggttttgtgtaagctgggggctaagaatcttggcttttaatttttaaaggtttttgtttttttgttttttaagagacgcaaacaaaatcaaagaagaatgggacagaaaccaggtgtggcaggcaaagtttaaaatatcttctgtctgtccctttatagaaaacgttacttttctctgccgtagaaacttatggttgagccacaaccaataaatatttaatagaatgttgttttcagaattagaatacacagatgaaattctgctttttatcttctctccagaggagatctctccagagtctttttattatagagtggaggaaatcccagtggtcttcttgactcattaaatgagaagacagtatcttggaaagaaaagacttagttttttggttatttgtaatagtgccctaagaagtggagaattctagattataacacatatatacattctttatgcagttaaagttcccatacttctaattaaagattgtgtatttaatgacgacaattttttttgcctttgttctccattcacaattttttttgttactttattgcagtacgaaaagtacttcttacatatataatttttgcttattcgttctaaggtgtgaaatagcctgtggggataggagaaaggaactgagccatgactgccttccctggtttgggtgggcggggtgtaagaagtagaggctggaaagatcaagcttttggcttcttcagtgctgaattcctcttgtggagagcactgtaccatcggctttaagcagcagatcttagtcttattgtttatttgattctgtgtaattcctactcatatatgagaagcgattgattttctttgtgtcttttacttaatatggagaagtagaggaatagatttgtaatttgaaaaataaagtagaataaaaaaattagaccctatgtgttcatgattaaattttggaatagtcattcccttgattcagatcaatctctccatatatggatcattatacatcattacagttttaaattagtttaacttttgtaaataaataattataagctattttgcctttaactatagtatttgaaaagtggtaagtctgaagattaagtaggtggctattgtttgtttgcttaaacataagtgtgaaacatgtaactgatcatttttcccaaaaaacttgactggcatttattattaaaataataaagtcttaattgatgctttcttctattattattgttatattttaaaatattcatgataatgaaggccgatttaaggatttaaacctttttgtcattaaaaataatgcatttttctttattacttttaaaaatagagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataaggtagtaataactgtaattttataaattctatggagagttttagatgtaaaatgtggtgtaatatcatttttagtgaaaatctttaatacggtttaagagtcatttctattttttggaatgtagtcaagttttattatatgtttctttttggttcaaagatgcttcttaaccattttataaacttttattcttcagaatattttctaatattcatggcatgccttttgttaacaattctgaaataatagatcttataaaactgttttgcttaatgtagtatttaaaatacaaaaatttgaaatatacatattacttaatgaacataataaagaacttgttaatattactggtaacttggaaagaagagttaaagatttagaaggaaactaagataatatatttcatgggcctaaaattattcaattttagcttatagttttgctttaattgcactaagtgaggaagtaggtacagtagtgagtatactaatttagcaaaactaattaatgtaatttatcatattctttttgttttttaaactttaaaaacaaagactctaggtaagatagagcgtgcacatatatgagttagttttaagtgtgtagtacatctggctaggggagtatataagggttctatttaaatcacattgggaattgtaaagtctcaaactacttcgagctgaaagagaattacacattatagtcaaagtgtttataattctgaaggagtacttgtcttgtatggaagtgtggttttttattgaactcaatttaaataattaatgtgaagattgtgtaatggaaaggagtagtaaatattaaaaaatattccctctttggcctttgtatttttgcattggtatttctctttgtatgtcatatatatatatatatacagagagagagagagagagagaggaaagtttgaatttacccatattaaaagatctttttgttctcagtgactttaataaccataataatactgaagaagaataatgctattatttttatgtcaaggtaacaatacttgctatcatgtattttccatatcatttttggttttgtcttactagctctagaaatgaacttgtgcttgtacagttactttttctttcatgggtctttttgttgggtttgcatcctggttctgccattgttgatcttgcataggaatatttttgtaattcacattttgtattaatatgctgcatgcttttctttcctagttctttgagttttttcataaaatacttgcagtgtctttttaagctctaatagaatgatattaaatagagtgacaagcaaacaaatgaaatataagaaggtagaatatcaagaaaatacaaatccaatatgattgctaatgttaaattttagaattgatgggagcttcctggcaacatcaaggaaaagggctgaatataagcaattttgtaattcttctattcacaaagaaacaaactttgtcctgaacagctttgcaaactctgtaatttgtagtattcttttcacacgtctttcttgtcattctttttaacagcagtgataatgagcagtaaccctgtcatcatgtgtacacagctcatgtgacatagtgtatccttagtatcctaacacacagtagagtacctaaagtcagaacttttaagagatatacttgtaaatttgggcattacatcagagagtattttattaagttttgaaagttctcagctcactgcaccccttgttgttagcttgggttgatgataaatccacgggtaaatgcattttctcaatttgtaaatattataaatacagttgctaccatgacaggcatcagcaaaaattttttatattaaaaagctttttttttcagaaattcagagaatatagggaaggaggaatgcatttgatcagattgtgttttgacagaagaaaacctgagtagttcacacattatagtcacaattatcttggtaaagtcactttctgtgagtgaaggggtagagggctacagtggaatttttaaggtgtagagaatataataactagtggacatttggataaatcacaaatggagtttaaattacttagtgttgtataataacatagtatttatatttttttgccttaagttatatggaactttctttcattgtaatggtcagacaatatttatgattctgagcttagtgtagatagcatgtcaacatacgggcttcgaaattaataaaataagttaattctaccttcaaataatgtcatcaaactgtatattcaatggagcctatcacaaatgattttgacttgctggtcactggagtgctaggtaatttttgttctgtcgaatttttggttttgagcgttgcagtttatcagtaaatattctgtacttggttattttctggaaacagtaaataagttagggtgtcacttattaactaaatcattcagtttggaaaataaaatacagaaattcagaaaatatttaaaatactgaaaatctcactgtagatttgtctagtatggtaaaatttactatcagataagtttactgtggatctctatttggggttatttaatgtcttcaagattataaaatcttgtgtatcaggtggccctttgacataagcttgcaaatcagattttaacaaagtttttatattttatagttattactagatattttctcagtgttatgttaaccctgtgtggcaagcagttagtcttcattgccagatatttgaaaatttagctttgagttctctccttcatttatgaatatgataacaatggttttatgaattgctatatcataataaagttctaactgataagagaaaaagtataacacaacctccaaattaaaattcacttcagaggatttccaatacttgtatggaggggtgagctcctaacaaactgatcttctcacaaataaccatttgtaaactctgcatataatatagataacatctatagggttatggagattgaataaaagcaggcaggctttggagggtagtcaaaatatggaacagtcagtctgcatggactgatatccttattttttgcttttataggagactttctggccagaaagtttctctacaatattgtacggagtagtagtcacacaatttagcatataatcccaaagtattttttctaaaaataggaaaatgtgacttattctcaagggaagagaaaatcatcatataccaacaccaagataactcacatgttggaaatatcacatgaggtctattataactagtgaggtagagaaaaatttacttataatgaattaaaagacaggaagtatcagccatgaaataaaacaaagtcagatggcaattctagaactgaaaaatatatcggaattaaaaataagctgtatgggcttattagcagaattaatatgatagagaagtaaatgaacttgaatatagattgatagaaactttgaagagagttgtgaaagattggggtaaaaaaatagaaccctagagatggatggggcaattttgaaaggtctaataggcacagtataagagaaagccagaaaaaatatttgaataaatgatgttagaaaacttctcagatttggtaaaaggcttacatttatagattgaagaaactccgaaaactccaaccaaaataaatgcaaagagaaccaaagtaggcacattacagtcaaagtgtggaaaaccaaaaataaagagaaaatcttgaaatcaggcagaggaaaactagacattgataagggaacaataatttgaatatctgtacacatctcatcagaaagcagtaaagccatagaggtggaacaaaatccttaaagttctgaaaggaagaaaaaaaatctgtcaacctagaatttttttatccggtgaaaatattctttaagtcttttgaaagaaaattaaataaatttgttgttatttgactgtcattactgactgaaaaagaaaacctggatgattaggagtatatacatgtaatacatatgacaactaacagaaagatttgtggagaggctataaatgcacctacgtagttgaaaagttgctgtattttacaatgcatcttgatagagtgatgttgactacaattcaatggctaaaacaaaattaacaaagtcaaaattgcatgtcttttcttgaatgataggccaaatatgtatccagtatttcatttacccacagcatatgttgtagactcctctttcaaatgaaaggtaacaaaagctcagttgaaaggaaaaacaaaataaatcagtgctagctactacagataaggtacactaaatacaaataattagccttcactaattcatccattcattcttttattaagcagttgggcactgttctagatgctagggatataacaattaaaaccaacaaaacccctgcctgtattttggagaagtagggtgtgcagtatcatgggagaagatagattacaaaacaaaagaaaaatatatagtgtctatatggtgataagagctatgagacacacaaagcaggtaaaaaagttggaagttgatgctagccaagtggatatacggggaagagctttaagggcaaatgccagagccagaataaaggccattagcagaagcttacttcacagattaaagaacattgtgactgttttcctgtgactgttacagaaggagcaaggggaagagtcaaggaagattaattcagagaacaattacatgctttcagaggattgttatgactttatttttgctcttgagtgagaggaacagccattgaaaagttttcagcctgataccaatttgaaaaggatcactctggttactttggtaaatagggagaaaaggtggaaatagggagactagttagggggctgttgcagttatttagtgaaagagctctggaaagtattgagactcgattagatttttgataaagcatatctaaaatatctaagactctaaaaggtcagcttttggatatactttggaggtagtgccagtaggattttctgtcactgtgaacatggggtaagggagcaagagaggattgagaggagcaagtaagtgaccccatgaattttaggctgaaaaactgagctgatggagttgtcatttactgagatggggaggactataaagaaataagttttggcagagaagatcaaatatttggttatggacataggttatggacatagttgtttgagatgcctgatagacatctaaatgtaaaaatgaagaacgtctggagttcagaggcgacatacaggttggagatagaaatttggcattggcaggatatggacaggatttaaaggtaaaggactggatttaggtaccagtgaagtgagttcagagaaaaagataactgagaaatgagtccttgggaaagccagtgtttgtaagttgaggagatgcagaggaaccagcaaaggagaatgaggagaacaagggaataaggagaaaaagcaggagagtgtggtgttttaacttgacctacttgaagttaaatctcctttcttcttcattgaggatactgattgtcaaatagacacaggataatagattagaaaatcctgtaattatacataaagaacagtctcagaataacaatatcaataatgcccaattgttataattactgaaaatacagttaatttgtttttgcatatgttatcttcattctccatcttgccatttttaaaatagttgaggtatgttacaaggtgaattatgttcccctaaaattcactaaaattctaaccctcagtagcccgtaatctgactgtttttggagacagggtctttaaagaggtaattaaggttaagtgaggtcatttggttattgggccctaatccaatgtgactagtatccttataaaggggaggaaattaggacacagccacacgcaaagggaagaccatgtgaagacacaggaaagaaaaggtggttagactgtcttcaaaccaaggagagagtctccagaagaaaaccctgctgacacccatatgtcagatttacagcctccagaactatgagaaattaaacttcttttatttaagccatccagcctctgattctttttcatagcagacccagcaagctaatacaaggtcttatctgtgttgtgagcgcacacagtcactacataccattgactcttaactcttacttaatcatagttctataagtacctgtgtgtttaaggcttatattatttccttatattgatgtgtttcggctgtgttttagctctttctgtagtagattcctcaggaagagttcatggaaatagtatttcttgagaaatgcattttgatactagtttgtaaggggctttatactttatacttgaaagccattttgcctggctataaaatccctgacttttctttctttggatgtcttaaatatgctactaatttttctctggcatgaggtattggtattgaaagcctgttgacaatgtagtatcttctccattacaaggcacttagtcttgttagatgttcaaaggattttttttttctttttccttatatctagtaattttggtagatatgtattggtgttggtcactgtgagttaatttctcaggtatgtggtgtccactttcatatgtagtttgcatcttttcatattttaagaaattgttcttgtactatacttttagaatttcttctatttccttgctttggttttcttctccagacacttgactatgcatgtttatttactttgcttatctttaatatttctcttaaatcactcctcatatttcactttctcttaaatctttatctccttctttatttctctctcattttaaaatttaaaagtaaaataaaaattacaggaaagctacaagcactatcccagtcagtttttttcctgaaccctgagagtaactactgacatgatggttatttaggaatgtgtttatttccacatatttgtgaattcatcaaattcctttatattattgatttctaacatcccagtttggacagataatatactttgtattatatctgtcttcataaatttattcaggtttgttttatgacctgagtttggtctattcagggaatgtttcgtgtgtacattttttttttggaaacagggtctctccttctgtcacctaagctggagtgcagtggtgcagtcctagcacactggagccttagactcctgggctcaggctatcctcctgcctcagctcctgggtagctgggactataggcacaagccactgtgcctgactaatttttcagttttttatggagacagggtcttgctctgttgctcaagctagttttgaactcctggcctcaagtgatcctcctacctcagcctcccaaagtgttgtgattacaggcatgagccactgagcccagctatgtgtactttagaagaatgtgtattaagctgttttaggatggtgtgttctagagatgtctgttagttctgtttggtttttgttcaaatcttcagtttccttcttgatcttatgaatggaaagttgagtattgaagtgcccaactattattattaagttgtgtgtttctcccttcatttcttcagagatttcttcatgtattttgatgctttgttgttgggtgcacatatgtttacaattgctatatcctcctgataattggcccttttatcattatccaatgtctttttaatatctagtaatatatcttgttttaaagtctattttgtccgatattagcacagccattccagctttcttgtggtttcttgattttttcccattttatttactttaaatatgtttttatctttgaatattctataaacagtatgttattgaatcttattttattatccagtctgacaatctctgccttttgatttgattggttatttcattcatctttaatgtgattatcgataattaggtttccatctgtcattttattttttgttagctatgtgtctcatgttctttttatttctttatttcttctttactgctttctttggattatgtgcttattttcttatatagcattttcaatttttaaataatttttttcacttaaaaaacatttctttagtgattgcagtagagcttaccatatacatcttaactcactggaatcagccccagatttatattaattttatcctagtgagttatataaatgttacttctatagagctctatttgttttctctgtttttgtgatattattgttatacatatagtatctgtatatgttacgaacccaacatgacgtaattattacttcatataattgtgtcttttaaagaagctgagagaagaaagatacagtatatgtttatagattttgttatattgatcttctgatttatcatttatgaatctcttcatttgtttctgtggattcagttaccacttggagtcgtttccttagctcagtacaactttgcttccatctaccttctttgttatgctgaagtggtccatactgaaaagaatgcatcatactctacttatttgagtgtaattagtacaaaatatattcataccttcttttcttcttttaaaataattataacagttttattgaagtgtaatttacatgccatacaaatcattaatgttaagtgtacaagtcaattatttttttataaacttacaaagttgtgcggacatcactacaatttaattttagaacatttctatcaccccagaaggatcctacctgcctatttgcagtcactcctcattctcatccatctcctcctagtcatacagatttatataataattcttcctctgaaaatccttctgaaagaaataatacggtaaacattgatatttatataaaggcttatacttttatgtaaaatattttctttaaaaaaaattttttaagactcaaggtctcactctgtcacccagggtggagtgcagtggcatgatcatggctcattgtggtctcaaaatcctggacttggtgatccttccacctcagcctcatgaagagctggaactacaggcgtgtgacaccacacttggctaatttttaattttttggtagagatggggtctctctgtgtgttgtccaggctgatctcaaactccgggcctcaagtgatcctcccaccttggcctctcaaagtgctaagattacaggtgtaagcatagtacatgtccgcctttatatataaatttaaagacatagaaataacctaatactgcaagtaaggaaagataagaaaattttcttcatttaatggattctatgtttatattgaaattacattatacactttttttaaacctaaaacttgtagatttattacataaacttgttttcctcctacaaaccaaaatagcgtatggtatgtatcatggactcagaaaaactaagaccaatcaatgtttttccaaataaaaataggttttattagatatcttacatttccacaaaatgattttaaatcttttaagagaatatattaaaatttgttaattccagtgtaagcagtatgaacaaaatgaaagcaagagttttgttctagacaatgggatgtacaaatgtttcagcagtggtaaattgcagacacggaaagctgatttcagtgtttaacaacttatctgtgtgttttaattcagtcactgtttttttgaatgcaggtatgctgagttcttaagcattctagtgataacactaccctcctcattcaaaaaaaagtattatcaatgacatacttcagactacagcatacacaaatttttaatcgttcatgttgctcttgtcttggcacatgcctgataactaatggtttgcatccagttttcttttagatagtctctacacgctagtccagaagtaaaaactgacatgtttggtctgcacagtgttaaaatgtttgaattaaattttaaaatatagtgattttagataaaaattcagatttcatgtttctcttgaaaaatatggaagaactagcaacattgaacagttgacttgagctgaggagtgggggccacttttagaaaggacaaatcttctctagtttgaggaagtccccatctggcccaattcacttatatgcatatctgtatgcctcccgtaagaacttgagtttgggacatttaatttaaccttataacattagagtaagaaaattagagccacatcagcctaatgatttgctcagcatgaaaaagataattagtggcagagtcaggattttaagatgatttcactatcgaaacattgaatatggagtataaatcagaagacttagaattacgtgctggccccttctacatcttaatttctgtaacattcagttttcatagttgtaagttgaaattaatagtaatactgatatgtgattattgcaaaggttaaatattatttatcattattagattcatatctgcagagcaattttaaccacatctaacaatacctttcttgttatagatggcataggtttagttcttgtgtttcataaaaagtaataacatgttttaatgaacttctcttctgagttttgtatgtatattgtgatattattattgagtagcattggtatttcataggttgatttgctttttagtaaagatgtgaatatttttacatgttaactttttatagcctcaaatgatagtcatttttctctataagtaattcatgtgccaggcactgtttatttacacaaatactttttaaagtgttaacaagaaaaattcaacttaagctctgatgtagtcaagtaacatcctatttatatataatatcaggtttgatattttttctaatgaaatgattttgccagtaatcaaaaactttaaattagaaaatgaagatctgagcatttttattggcataataaaacttaactctcattgaattgaagtgacaataacaaagtaagtaataccactgaatagtccctgacacatgaaaggtacacaagtagtttattattgtaaatgtttctctgctttaaaacttttgagtgtaattgttgcttttaaaaagagtgtttaccttagttttattttttcagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggtgggtgaatcgtggctttgttttcatgttcttgtcagaatttgacagtatctttattttatatatcaaacattgctcatctataaatctatgatttttttgcttcttttttggcttttgcagatcttttaagtgaaactttaaagaatatctctcttttctatagcaatatactctaccctggccttgtctccttagtaggaaatctgtcatatccattatcttatatagcctttgaaattaaatcaattaactgaataagttagttgttagatataaaaacatactttgctttaagaatgtattactaatattctctaacattaaaattacttgtctttaaatccatcaatagtatttctgattttaaaataacgtttgattttaacttaatatttttagtgtgaaaatgcctcaacctaagatttgaaatttaaaagtgattagcaaaggtattcacttttttgtcttatatgtgtataaaaattataattgaaggcttaaaaatgtccaagtatgttatttaattctattataaaggtatttggaacaaggaaatagtgatgaaatcattctatagaagtttaataaacatttttgtttttggacataggatgtgaaagcgatagtaacacattcaattcatagtgcaattcattcaattggagggattcaagtgctttttccactttttgcccaattggataataggcagctcaatgacagtcaagtggaaacaactgtctggtaagttttctttgcatgtacaattgctggtattttatacacacttaagactatgcatgatgtactcagtgctgtgtaaatgtattacagtatttgggttctgcccttaaagtgtaataaaaaattttttagaactaatggagatagatatttatacaataaataaagaaaacgctgacatttaggttgttatatcataaaggaatgccttccttgataataaatagaaaattcttaccaaagatagcataatgattataatatgtagttgagggaaaaatattaatcctgaccttatcatttgcatatactcatggtttgaattgaccatgaaaccctgtcaggttgaagaaaattactagggtaaagttattcagaagaataacatttattagcaattacataatttatatcttaaagaatggtattattttataatgcttttgtcatggcataagtctagcataatattaattgacatcagcccttatttatatatagtttatatgtgaggactcaatctaaccaggcaaatccatgtttatgtaaaaattaaatctcttctaatgagtgtgatttcatgtacatttttatagtttctcttttattaaaaaaaaccttatgtgccagactctaatttaatgttatatcttagaattatacatacaagaatttaaaaatgaattgtagtagctattttgattatacacattgccatgcttggggattttaatgggcaagttatatagataagcattaatttttattccaaaagtaacatagtagtgcttcattagtgtatatatatacatatacatgagctccttaatgggttatctaattttgaattgatggcgaatctagtgaatgaagatatgagaaaaatttaaggtacaatgaaatgctttttctcataattattatctaaattagctattaatgaaattccattttagtatttctaataatattatttctgttttgggaacatctttatgtaaagtataaatctaaatatggatatgagatttgtacatttataacattcacctcccgtctatgggtcttgccttcttttatatcaatatagtgtaaaggttggagttttgaaagtaaaaagctttgaagtgaaaaggaatcctgaggttatgtcctgctgtgatactattttgcttgtgagatcttaaataatctaattggaaggcagctcagcttagtggaaaaatcaaactttaaatttcagtcctttatttaaattcaaaatgttttactatttatcatctcagtgaactaggacatattatgatcagtatttaaaatctagtcagtactgtgaaaagaagtgggagatgaagtagccactagaaaaatccatgtattaatttaaatatttcttatgaaataatatgaaatacatatattatcaaatcttactgctaaaaccatatgtaataggttatttggtttattcatccaagacacatggttactttttactgtctttcttcaaaactcatttaatatttatattatatcttggtatttaaattgtatttatttcatcgtggagataaaagatagtgtgaggagtcagcatacctattttcattttgattttagttctttaaatcatcctaatatttccctatattaactaattccaaccttttcagtgatgtctattatgtcttttgtttgtttgtttgtttgtttatttatttatttgagatggagtcttactctgttgcccaggctggagtgcagtggtgtgatctcttggctcactgcaacctctgcttcccagattcaagcaattcccttgcctaagcctcccaagcagctgggattacaggcacctgccaccatgcccagctaattttttttatttttagtagacacagggttccaccatgttggccaggctgatcttgaactcctgacctcaagtgattcacctgccttggcatcccaaagtgctgggattacaggcgagagccactatgcctggccctgtttatagtttagccaatagaaaacattacaagaatgatactgctttcctctttaatacgtactcaattccaggctaccctgtgatttagttatgtactatttttaattcttatctattactttttcattaattatttcagtatcctaaatatctgagatttgctctttggtacagacaattgtgtggatcagtaatacagtcttttgttatttaatgttttatagggaaccattatagaaaagtatgtgcatcagtgaaatagtctgtgattttgcaagctgttaagtgggatttctccctctatttgaaaaatacagattcatggctatgcaggggtgatagaattttatgttttatggctatatcatcagttcatatcgatgattgggaccttgaaataggatttatcatcttatttagttgataataaattgttctagattaaggataatcaatttgaagtttttaaatcttacagagaaaatttaatatactcctttttggaagtctgattgcatggtaaatagatgactgaaagttgcaatactgtctaatttttaattacttttttgagaaatggagctaagctcaaatataagttacttctttgccctctgtgtttcaagctgaagcattttatcttccacatagttttctctactaagtagtaccttttaatgaaacttttcattgtttcttaagccttacctctgttggcactactactttgttttatcaactttgatgagtttttactttatataggggatttagaatttttaaaaaattattggctgggggtggtggctaacgtctgtaatcccagcaccttgggaggctgagagtggtagattgcttgagtccggaatttcaagacagcctggacaacatgacaaaacctcgtttctacaaaaaaatagaagaagttagacgggcatggtggcatgcacctgtagccccagctactggggaggctgaggtaggaggatcacttgagcccaggaggtggaggttgccatcagttgtgatcacaccactgctcttcagcctgggtaacagagcaagactctgtatcaaaaaaccaccccaaattattgaaggaataatttcattttctagagtcttcaaagatggatttatttttgctggataatttttgtgactttttaaattatgaaggccacttatagttgttttatgtatggactttcaagtcagacaaacatgggttcaaatcttgaatttagtatttattactagtacaactttgtgtatgtgattaattttttgagcataactcaaactctgaagtaatatagctttcgtattttgtgtctagaatgactcaagaaattaaatagaaactttattttcctttgaattggatgattatgtagactgagtacatattcttattgagtacatgttattgagtacatacatcttattgagtacatatttttcttacattgagctatgtttttaagaacatgggtaattatgtaggtgatacaaaataaaaccttcctcattgtgtgacctaagacagttttgctttgaaaaaaaattatgttttctggaacaaggtataaattgagttttgtatatcaaacaattaaaaatacaccaggagaatagtttcattagaaaccagtgtaatatattgcgtaagtgttcttttggtggaagacaaatttgggctcaaatccctgtcctgttttatactgtccgatgttaggtgatgggatattcatgggtgtgtagtagtggtacatggcatttattgaatacatactgtgtgctagtcacttatttttaaaaaataaattttattgtgtatgtttaaggtatacaacatgatgttatgggatacatataaatagtaaaaaggttactatagtgaagcaaattaacatgtctgttgtctcacatagttacctattttttggggggagggaagtggctaaaacgtactaattatgaatcacatacaaaatataattctgttacctacagtcctcatgttgtacattagatgtactcgttcaacctacatatctggtactttatttactctaacctacatctccccacttccaagccctgtgtcccttttccctgatagccactgttttgttttttatctctgtatatttgaattttgccagtcatgtattttagtgtaattatttgctgatgaagaagagaaaaattgaataacttgttcaagatcacagagacataagtggcagaaccagggttctaatcctgcaagcctgactctagagctctgactctaaaccactgtggactactctgagaatcacttttgccagctgtggaatgattttaataagtgccaactttatctgattgtaatatgaattaaaataagacatgtaaagtatctgtcatagcgtctgtacatagcatctggcatttaatgagttttctttttactttcttccgtgagttactagtctattggttagatgcaactttttaattattaaaacttagttttaatgttattgtaaactatgatcatttttataaagtagaaatttcatgtgataatttaaataaattatcttaagtatatgaatatttttctaggaaaagcattttttaaaattacaataaatacagtttgtttgctagaaggatggaatgtaagaaataaaagtgtttagagaatcccataaagcatttatgtcaacagtcctatcatatgaacagtcctcttgtaatgtgaatatttatgactcattagtttgtttagtgaacttaaatcacaatttattttttaagattaccttgctaattaatcaaagttattccagtgattaacttgaattttacagccactttaataattaagcagccccttaataattaagtatttcattctaatattctgattagcactattgtaatacataaagcaacagaattacctggaaaatttaaatatttcagcgtctaactgccttagccagatttcctcatacacttagaagtgacatgaaaatcctttatctgaccatgtttcctgatttttaattcagaaaaaatatctattatatacagcgttaaaattttattacatactcttaatccaacttaatctgacttaaaaataatatgtgattgtttttaatagggaaaataattaaaattagtacctgtttataataattgcttatcttatggaggtggtggttcttatatatagaatataattattaatttagtttccaaaaacatttaaaatatttgtattaggctatagtttatacagttatatttacttaggtttttcggaaagaatataccactgatatgtcttaagattcatatcactttgtttgcctttaaaaaaattgctaaattggtactgaaaacattttgaagtgatagacacaaaaaaatacatttgatgtacttgcactactacttttagaagagaaaaatgaagtaatttggttagtgagatttaagcagagtaaaatgaaatatatattgaattcactatgcaaatgaatttataagtagtaaaaagtaaaatacattattctgtctgaaacatcaggaaacattacatttaattttcaaatagctttttcttctttttaaatttagcgacagccactttcaatgctatactactttgtgttgtttagttttcaacacttaatttttctctgtaaatttttctttgtcttgttacaaggtttatgcttttatctttgacccttcactccctctctcttgctgtggaaaaaaggcacctttttggcaataagattaactacaaattattccttgcagaaattctggcgaccatggacacatcttcactaaatttgttgccttaattttcttctagtttgcatttccacattctgttgtctttaatttttcagtcttactatcttctaacaggagtattgttattttactcatgccatagatttcatttcttttaactgtcttacattaccttccttcatttattttgattttatgacagtcgtgcaggtataatggcatcagcccaaaactaaaataaatattatttgcctttataaagagtattaccacatgccataattcatcctcagaaacccagaatacttttaatagattgtagctataatactgattgtcacaagtgtttaaaccctcttctttttccatccaggggtgagatgtgatgaccataacatgtaatgaatggaattttcaagaaaagatttagtaaagcatactaaggagattctagctaacttagtattataattttattggtttttgtttctaattctactcagatttttaggtccacaatcttgttacctaggctggtaacttccagtgcttatctctagcttgccttcaatttaggcttatacacataaaccattgatggaatatttccatgtggaaagtatctcaaacttaacatgactcaaataaaaattcataaacttctcatctacccaatttctattgcttttgattttctaatgttactgaggaacattgtctccaggcagtctcttaaattagaaccccaagagaactcatcagttactttcctccctttgaataattaaaatattagctgttcctgtatttcccacatacaatctatcatgataaactattgatattattccttaaatacctcacaaagctaccctttcccctccatccatattgctactgccttagtctaggttcccattattaattacttcagctagtatatatccagtaattgctgttgcccttttccagtaattttcaatgggtagaagagttatctttctaaaatacaaatctaattatttcacaccagtggtcattcactggtttcctgttgcctcagaacaaagtcattatctgatttggtcatgcttacttatcttctctagtcacatttcttgatagtctttccaaacccaaattcctatatatagcaataaggacaaagggtggaaaatgctagcagggacattctagaacatgtatttatgaataaaaggtgctacaaatagggacggcctcagcaacagtgtatagttgggaacatggtttttctgcagtccttggatttataatgtcagtgaattagggaggagatttaacagaatacttcatttaaggtgtcttggagtcttactacctgctttataaataaaggggaaggtttctgtgcgcttaaatctggctttcagcttcagaatagagatggagtgtctgctgtcatgcaagtggacaataagcaaagccataggtaatctgtataccaaatgacccattatttgttggccaataccctgtttaacagatcttgtttaataatcagcacagagaaacctatcagcatagaacttacattatccagcatttgctagttatagctgtagtaacaaacaacctcaaaatctggtagcctcataaaacaacaaaagttaattgttttttcataactggttgtgctgtgttccctgtgtcttctcattctgggtcctaaaagattagctgtgatatggaatatgtttttcttgtgtcaaagaagagcaagaatctgagttaaacaatacaattgctcttgtagcttctggtcaaatgagatgaatgtcatattcaatctgctagccgaagaatgaccaaccaagcccaacttcaatgaggggatttggttgtaaaatatatgtcctggaagtgggggtggaaagtaagtctttggccataggcaaggatttataatcttcttactgagatggaaaagtcggtaattgggaataataatgcaatctcccatgggacttatgaaaaagtattacggtgcacaggaaggaaacccatatcctgaagacttgaggcaagccgacttataaaactttgagaggcccaggcgggcggatcacgaggtcaagagatcgagagcatcctggccaacatggtgaaaccctgtctctactaaaaatataaaaattagtggggtgtggtggcacgtgcctgtagtcccagctacttgggaggctgaggcaggagaattgtttgaacccgggaggcggaggttgcagagggccgagatcgcaccactgcactccagcctggcaacagagcgagattgtgtctttaaaaacaaaaaacaaaaaacaaaacctactaggaggaattcagaagaaaattttggtaaaatttagggtacaaaatgaccctgtatgaaatagcagaataccataaggctgacattgagacaatactatcagaatttagagatgatggccaaagtctatatttttgccagacattgtagaatattctgatataaaatcaggtgtgggggaaaaaacaaagaatgtttttctaattccttttggtaacttctcgttgaattaaaaactgtatatgtgccttcttttggatttactggagaaagtaaaaattaaaaatgtaatggttacaaaaatacggaaaacaagggaatgggaatagaaccataaagcaactgttaatataaagtaacaggttatataacctagagatactattaactgttaaaagacagaaactcacatattcattcaataagccagaatccaaatatgtaagctttaaagagaaactgtttcatttaaaactaaatggtaaagaatataggtctcaatttttggtctgctgtagtctggcaatttttttcttagtataccactaataaaagtgtagatagtatactaataaaaatgtggctattttgtcccatatagaatgcatggatggtatctttttacctaagaaagcacatattcctcatttgctggttagaataaaatcatttgttaagctacacagaaataatagaaaatagtccaccatgtttgttacattttatctagaaagtaggttaggtcactcactactaagctattccaaaacgttccctaaaattttacttctcatgggatgtgggcccttttgcaactattcattttcacgtaattcatggtggttttatactttttctataggaagtgtcaagacatactgcatggcttgaatgataaattttctatagtataggtacccatactaaagacatagtagtagtagtagattattataatagtaatattacctatttctgaagtatgggtacagatgcttgtttctttctgcactgtgtagtttttagaacaacacaattctcccttttcaatggttgcctaatgctgagttggcaccttcaaattattttgtcaagagagtataggggtcatgtaccatataaaattaaaaaattgtttatttccatatccagaacatgcaggtaacttttgtccctcctagtacaactgtcgtacatattattttaattgatatcattgaggatctctcccttggtggcctatgggtgcctattaatgcatccagcatttagaaacagggaagtcctttgcaggatcattttgacattactttactgaggatagtagtcagggacttgagtggggtcttacgtatctgatggaaaaagaagattcatacattctctgacaaagaggttatgagcaaaacctctgcctttaattatgtaatttctagatattctttatcagaaagtccaagctgaaattggagggtaggttacaataaggctcagctggaagaagaaaatatttttgccatggagaggagggcatataacctttggggcggtaaagctgactcatagcagtttgggtatttggtatgtatcccttgtaactcagccaagtacactaggtagcacatctttaatatagttgaagaccagacttaaataggtttagaaacataaggagttctagtagataagcactgttaggaagcaaagggtaaaaagtttagcactaattggttcctgtgaaatcaatgtggaagtcaggcatgagacacataaatttatttactgccaaatatttttacagatggaaatgagatacaggagttggtacctttggtatcttatgtatagtgaataggaccaggtatgatcccttccagcaactcttggtggagctttaatgaggatccaatgtcagaccaaagatgctggcattcatcatcccaagtttatcagtagggctttttataccgctaaaaggtttaccttaacacaatgactttatgatttaaaacatcgaatgaaatatgtatacataaatgcttcgtagtatggcttgctgctggaaggcctagagggaagtttcatgtgcctcacactcagcaattcatgggggaatagcaggagtcctatttttctggtggctgtatatctcatcagggttatgagcatctgcctattagagcctaatttttgtacaaatcctagctatttattatttttgaattctatcttggcattttctgtatttgtggtgaaaatattgttgaagttgatcttctttagacacttcctttgcaatatctttattaatgggcaaccatactctgaatctaggtattaaattttatatgacagcttttgtgaatggatttacttagctatcttgataaaatacatatattattttttgaactttttttcatagaaacaaacaaattcaatctaaatatttattaatggctttcaagatgggcaagctttttttttttaagtgcttatctccattttgcaacaggcaaatatggcaggaatgacaatatgtgtgaggcatttgagaaaacagtttggaggatattaacaatgtttgtttgcataactttttattttttaccttttatgccaactcatttgcaaagaacagaagattttttatataatctaacagcaatttgtggagtataaaaaagtgaatcttgtttttaagagtatttttttcttttcttcaaaatttattttgttgattaaaaatactttgcgaaatttataggtgtatgtgaatatttgttacattcatagaatgtgtaatgaccaagtaagggtatttgatcatcaccatcaccttgagtatttatcatttccattttggtaactttttttttattatactttaagttttagggtacatgtgcacaaagtgcaggttagttacatatgtatacatgtgccatgttggtgtgctgcacccattaactcgtcatttaacattaggtatatctcctaatgctatccctccccacttccccaccccacaacaggccccagtgtgtgatgttccccttcctgtttccatgttttctcattgttcatttcccacctatgagtgagaacatgcggtgtttggtttttttgtccctgagatagttagctgagaatgatggtttccagcttcatccatgtccctacaaaggacatgaactcattattttttatggctgtatagtattccatggtgtatatgtgccacattttcttaatccagtctatcattgttggacatttgggttggttccaagtctttgctattgtgaatagtgcctcaataaacatatgtgtgcatgtgtctttatagcagtatgttttataatcccttggatatatacccagtaatgggatggctgagtcaaatgatatttctagttctagatccctgaggaatcgccacactgacttccacaatggttgaactagtttacagtcccaccaacagtgtaaaagtgttcctatttctccacatcttctgcagcacctgttgtttcttgactttttaatgatcgccattctaactggtatgagatggtgtctcattgtggttttgatttgcatttctctgatggccagtgatgatgagcattttttcgtgtgtcttttgcctgcaaaaatgtcttcttttcagaagtgtctgttcatatacttctcccactttttgatggggttgtttgtttttttcttgtaaatttgtttgagttcattgtagattctggacattagccctttgtcagatgagtagattgcaaaaattttctcccattctgtaggtggcctgttcactctgatggtagtttcttttgctgtgcagaagctctttagtttaattagatcccatttgtcaattttggcttttgttgccattgcttttggtgttttagtcatgaagtccttgcccatgcctctgtcctgaatggtattgcctaggttttcttctagggtttttatggttttaggtctaacatttaagtctttaatccatcttgaattaatttttatgtaagatgtaaggaagggatccagtttcagctctgtacatatggctagccagttttcccagcaccatttattaaatagggaatcctttcccatttcttgtttttgtcaggtttgacaaagatcagatagttgtggatatgtggccttatttctgaggactctgttctgttccattggtctatatctctgttttggtaccagtaccatgctgttttgcttactgtagccttgtagtatagtttgaagtcaggtagcgtgatgcctccagggtcgggttacccacaaagggaagcccatcagactaacagctgatctctccgcagaaactctacaagccagaagagagtgggggccaatattcaaaattcctaaacaaaagaattttcaacccagaacttcatatccagccaaactaagcttcataattgaaggagtaataaaatccttacagacaagcaaatgctgagagattttgtcaccaccaggcctgccctaaaagagctcctgaaggaagcactcaacatggaaaggaacaactggtaccagccactgcaaaaacatgccaaattgtaaagaccaccaaggctaggaagaaactgcatcaactaatgggcaaaataaccagctaacatcataatgacaggatcaaattgatacataacaatattaaccttaaatgtaaatggggtaaatgctccaattaaaagacccatcagtgtgctgtattcaggaaacccatctcatgtgcagagacacacataggcttaaaataaagggatggaggaagatctaccaagcaaacagaaaacaaaaaaaggcggagattgtgatcctagtctctgataaaacagatttaaaccaagaaagatcaaaagagacaaagaaggccattacataatggtaaagggatcaattcaacaagaagagctaactgtcctaaatatagatgcacccaatacaggagcacccagattcataaagcaagtccttagagacctagaaagagacttagactgccacacaataataatgggagactttaacaccccactgtcaacattagacagatcaacgagacagaaagttaacaaggatatccaggaactgaactcagctctgcaccaagcggacctaatagacatctacagaactctccaccccagatcagcagactatacattcttttcagcaccacaccacacctattccaaaattgaccacatagttgtaagtaaagcactcctcagcaaatgtaaaagaacagaaattataacaaactgaaactgtctctcagaccacagtgcagtcaaactagaactcaggattaagaaactcactcaaaaccgctcaactacatggaaactgaacaacctgctcctgaatgactactgggtaaataatgaaacgaaggtataaataaaaatgttctttgaaaccaacgaggacaaagacacaacatagcagaatctctgggacacattcaaagcagtgtgtagagggaaatttatagcactaaatgcccataagagtaagcaggaaagatctaaaattgacaccctaacatcacaattaaaagaactagagaagcaagagtaaacacattcaaaagctagcagaaggcaagaaataactaagatcagagcagaactaaaggaaatagagacacaaaaaacccttcaaaaaatcaatgaatccaggagctggttttttgaaaatatcaacaaaattgatagaccgctagcaagactaataaagaagaaaagagagaagaatcaaatagatgcaataaaaaatgataaaggggatatcaccaccgatcccacagaaatacaatctaccatcagagaatactataaacacctctatgcaaataaaccagaaaacctagaagaaatggatgaattcctcgacacatacaccctcccaagactagcccaggaagaagttgaatctctgaatagaccaataacaggctctgaaattgaggcaataattaatagcttaccaaccaaaaaaagtccaggaccagatggattcacagccgaattctaccggaggtacaaggaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgcaaaaatcctcaataaaatacaggcaaactgaatccagcagcacatcaaaaagcttatccaccacgatcaagttggcttcatccctgggatgcaaggctggttcaacatatgcaaatcaataaatgtaatccagcatatgaacagaaccaatgacaaaaaccgcatgattatctcaatagatgcagaaaagacctttgacaaaattcaacaaccttcatgctaaaaactcttaataaattaggtaatgatgggacatatcttaaaataataagagctatttatgacaaacccacagccaatatcatactgaatgggcaaaaactggaatcattccctttgaaaactggcacaagacagagataccctctctcaccactcctgttgaacatagtgttggaagttctggccagggcaatcaggcaggagaaggaaataaagggtattcaattaggaaaagagaaagtcaaattgtccctgtttgcagatgacatgattgtatatctagaaaaccccatcatctcagcccaaaatctccttaagctgataagcaacttcagcgaagtctcaggatacaaaatcaatgtgcagaaatcacaagcattcttatacaccaataacagacaaacagccaaatcatgagtgaactcccattcacaattgcttcaaagagagtaaaatacctaggaatccaacttgcaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcagtgccatccccatcaagctaccaatgactttcttcacagaattgtaaaaaactactttaaagtccatatggaaccaaaaaagagcccgcattgccaagtcaatcctaagccgttttggtaacattttaagtcctctattccagctactttgaaatgtgccctacattgttgcaaactatagtcactctacactgatattaaacatgagaactttgaccaactatctaactgtatgtttgtaccgactaactaacctttgtttattcctcctgctaccctggtacccttcccagactctgtatctatctttttactatctgcctccatgtgatcaattgttttagtgcccacatatgagtgagaatgtctttagccatttgcctgttgatggaaacttaggttgatttcatagctttgcttttgtgaatagcgctgtgttaaacatgtgagtgcgtgtatcactttgatatacagatttcctttcctttggataaatactcagtagcaggattgctgggtcgaatggtagttctattttaactctttgaaacatctccacactcttttccatagtggttgtattaatttacagtgtgcaaaagttccattttctttagatcctcaccagcacctgttattttttgttctacttataatagctgctctaactggggtaagttgatgcctcattgtggtttagatttgcattcctcttatgcttagtcatgttgaatattttttcatatacctgttgacaatttctgtgtcttcttttgagagatgtatgttcacgtccttagcccactttttaatggggttattttttttttattgttgagttgtttgagttccttgtatgtgctggatattagtctcttgtaggatgaatagttagcagatattttctccagttcaaacacaaattgtctcttcactcttttgattgtttcctttgctgtgtagaagctttttagttttatatagtctcatttgtctatttttattatagttgtctgtacttttgaggtcttaaccatgaaatatttgtactgaaacaataaaacaactagaaaaaaacatggtgaaaacacttcaagatattgatctaggaagagatttcatgtctatatttaaaaattaaaatatttatattaaaatgcttccactaaagttggtacctaatcttatataaggaaattttagagtacactctggagaagtccagtcagcacaacattaaaagtatgaatttggaagtggaagggattacagctttggctgaagcatgagccactattaacatcatcatacagcttttggtcagcaatgaattttataatagttacggcagaaggaagttgtaaatgatgtaagtcataaagtagcattaaaataatattccagagagatttttttcaatagtaggcaaggaattcttattatatgattgtgtaaaatcatgaacagcttcagaactgtaaaagaagtcatggcatctatcaacattacagcccaaaagtagacatttatgaaaggcatggatatatgctctagagagagcatcaactttagacaatttcagacacttggacagaatagtcagaaggcaaaataaaacgttttgttacttgatgtaggaacaaatggtataaccagagaaccttgtagactatatttgacgtacattagagataagatgaagattttgaagtaggaggtttgttaaacgatgttggttttcatcaagtggtcaagttttctatagctggagtttggagtaaaggggttggtacggggcaccaatagtaatgtaacacagggaagaagaagactttatattttccaggcattagaaaggtgcagtgttttggtattttggataggtactgaggtatcacctaccatagttagtgtcagacaggaatctattacggaggttgaaaaatcctccattattattgcagccatagctactgaatgcaatccaaaaggcaagcaagctgctatgagattaaggggagaacttcagtgagcaattggatattgtttgttcttttgaatctcccttaatgtaccctaaataattccatacttcaaaagaaaggtaacaggtttaatataattaggaaaactcaatatagggactttggacagacgttatttaggaaactgataaatcttttcagttttctggttctgtgatgacagcctgccagtttttatggtcgttgagctattgtaatataatccaatttccatggttagccatagccatgtggatttctcaaactatatggtctgggggtatcccagatagcttctatttaggaaaatgcaaggtgatgtttttagtagaacttagtaaaaatttggcttttccagtgtattctgggtcaagtttattggagtacttgatatgaaagataactaagaattagatattaggctggtagggtctctgaaatacatagtagtatacaaactttttttaaaaaaaatctaaccaaaacagcatggtaccggtaccaaaacagagatatagatcaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaactgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggagatcatcattctcagtaaactatcacaagaacaaaaaaccaaacaccgcatattctcactcataggtgggaattgaacagtgagatcacatggacacaggaaggggaatatcacactctggggactgttgtggggtggggggaggggggagggatagcattgggagatatacctaatgctagatgacgagttagtgggtgcagcgcaccagaatggcacatgtatacatatgtaactaatgtgcataatgtgcacatgtaccctaaaacttaaagtataataaaataaataaataaataaataaataaataaaaatctggctgtattagtcagtgtaggttatatgatatcaaattagccatgagaccttagtggctttatacagtaaaggtttatgtagtgttcctgtaatcaaatatagtttcttcagcaatctaaggtattgggtttcaccatcctatttcagagtagcccagtattcattgtaggaggcggggagagggactagagaattatgcataggtttttcattgttgcaacccacaagagatttctgataacatttagttgatttagtcacataattaactataatggggttaggaaatgtcttctgtatacacacgaagtaggaaaatgacatgagaattattaataacaaacattgtctctagcatacttggtttcttagctggtaaaattaatgggttgcaatggttcttggttagaattataggttttggtgtgaaaggatttgacaactattagggatgtggtggcatagcagtattaaacctgactttaactgatgtgatgctatatgccaatatctgggcatattgaacaactctgtctaattagtatgttgagatcaagatgtggggactcagaaggattttttgagtcatcttagtttggagcttcattcaagtcagtaagaatacaaaaaaatcagttccaattctggttaaggtagagtgagcacactctaccctgtttctcctactcaatgcaagaaaaacaccctacatggacagaattcacacagccactatttcacagctctgaaaagtgaataatagcaggtagaatggggaacaagagcagaattcacagtgcctttgaactggaagtgagttcactatactttttgtccctttattatcccctaacatgaattaaatggattgaaaacctgaaattgtgcaccagggtgcagtgagagacaactctgggagaaatcctctagttctgagtgccctgttaatttttcttttcttcacgttgttctgttatggcccagccctcatgtggtcttatcaccaatggaaggctatagaagccaaaactctgagggaggcttttctttgatcagtggagctagagtcctaagagggtgggacaaacacccttttcttcttaatctctctgcctttctgccagtggccctggatatgaacagacttgtagaatacattgcagagcagagaaactaaagccccagcgttttgacagaagaactgaaaagaagagcctcagaactgaaaatatcagggatgtcatggaaagggaagaacatgagaaagtaaccctgtaaaattttttaatgaaattcagtcctgagttgtgcatacatggatctaatccaaattacaagttgtagctgctacaataaggtaagaaaatgaaagtcatacagattataaaggaaaaatagaattatctgttttcacagatgacatgattgtctatgtaaaaattctcaaggaaatgacttacacataaattctagcactagtaagccatgtttagcatactagtgtcacaagatacaaggttctcatacaaaaatgacttgtatttctttatattaacaatgtacaatgtgaaaccacatttaaaaataacattaaccacagcatcaaaaatgttaaatactgagatataaatttcacaaaacatgtacaggatgtgtatgctgaaaactacaaatttctgatgatagcaatcaaagatctgaataagtttagggctatatcatattcatggacttaacatataaagatgtcattaaattggtagatacatgtaacataataacaattaaaatcctagctgaatatgttcattaatgtagacaagatgagtctaaaatttatgttgaatgacaaagtaactaggatagttaaaacagttttggaaaagaataaagttggaagaattatacttaactgactttaagactgacttttaagctgtaataatgaagaccgagtaatattagtaaacacatatatcagtgaaacagaatagagtccagaaatagtcccacacatatatggacaattaatttttggcaaaggtgcaaaagtagtctaatggaggaaggataatcatatgccaaacaaatgtgctttgacctaaacctcacaatttatatgaaacttaacaaaaaactaagtctaaatataaaacatgaaactctaaaacttttatgggaaacgtataaggaaatttatgggacttagggtaggcaaagctttcttagttgtgacgacgaaagcataattcactaaaaaagggataaatttcgttttgactttgtctaagttaaaaacttttgctatgctaaagatgcaatgaaaagacacagtacaggctggaggaagataacagcaaattgcttatttgacaaaggatttatgtcaagaataaataaaggactttcagtccttaacaataagactacaattcagtttttaaaagtggacaaaagagtagacactttaccaaagagaatataaggatgtcaaaatagttcatgaaaagatactcaacattattaaccaacagataaatgtaaattaaaactatataaaaccattatatacctagtagaataaaaaatagctgttgtgctaaatactggcaaggatgtgagaacaactagaacctgttactggtgggattgccaaatggttcagccagtctgaaatacagtttggcagtttattataaagttaaatatacacttattgtatagttcagcctttctactcctcggcatttatttatgagaaatgaatggaaatcatgtccacacaaaagcctttatgtgaatgtttatagtagccttattcacaattgctattctacaacccaaatgcttttacaaatgaatgggtatacaagctgtggtacatccattaatactcatcaactaaaaagaatggactcgatgtatgtacttacttggatgcctctcagaggcaatatgctgagcttacaaagggagacttagaaggctacagactgtatgattccatctatgtcacattcttgaaaagtaaaaatatgtagtgatagagaaaagggataagtactagagcctatgggtattgagaaggtgtggctataaagctgaaaagtgatagcacaagtgaattttttggtgtgatagaactgggctatattttgattgtggtggtggttatacaaatctatgtatctatttaacattctcaaactggtacaccaaaaaaaaaaaaaagagaaatttcactgcatggtcatttaaaaaataaaattaactattaaaagaatagaaaattcctgacctgtgtaaagcctaagtattaaagaattgtttcaactttgtgtattcagctgtttatctgtttattttcttgcatttgcgaattccagcacttctagtgtatgttaatcctatttctcttaaataggttggggcttgggtgaaagtggagccagcaccaagataaaggactgggcatttggccttcctgctgtggcatgttttgaccttgaagggcattagagtatgcataaatagttaagatcatccatgtgtaattatgacctgtttccaatttagaacttaagttctccttaggggttaggaagttacattattaaatttctaaagcattcatctatccatatttactatagtggtggctgccatttgtaaaacgtccaggacgttttcataaagtgactacaacatttagtgcactgtaaggggtggtttgttagttgtggttaatctgtggtactattaggctttgaaagttatttcttttacctttgaaggcttttagtaaatatatgaaaggagcttataataaaaaggcattttgctctcaaactatataaattttgttacatactatatactaatatatagtaatataagagatttataatgatttttttacatatgaaaattttaacattttgttttcctcagaagacaaattgacacatttcaagcacttttttatacttcttaaaactatatttgtcaaaaataaaatacgctatacaacataaaattaaaaatctctgacaagacaaaggaagatataaatgagtaataacctcacttttaatagagtctctaaggaatgctcttaaatatccatgacagtggtagcaattcagtttataaggctgccttgcctttttatcaggatgaagaaaaaggtagaaattactgagaagagatttcatggctccgggcagactcagtgatttcatgtgctatcttatgtatccatctgtccttgtattttactgtgttgcatttcacagttttccttatttcattctgcatttaccgcctatgtaggcattggtcttctttgagatcacatcttcatgagggcgttgtctaaaagtgactgctaaatatacctggagttagaaacatgtggtttagccctttctaatgttgaactgtgaaggaaatttaactcttacaacttattgtgagttttttgtgtgtcaccgaaaattatcttggatgcgaaattgtcttgggtgtggacttgaattgattaacgtacagtgaaatcaattatttctgctatgatcactctcatttaggaatagttttgtagtgagagaaatactatagaaatatgatattaaatattttacataattttaatcatcttttaaaatatttcactgtaattcagtcctaaattaggcttaagagatgaaaccttttaaaaatgtcaaaagatttttcccccttactgataccgtaaatctgatttggaacttaatctacttaatcaattactttgcaacattcttttaaaaggggtggaggtattggattttagggggaatctttactttttatgtaaggtatttccagtcttcttaataaaaaggtgtttatttaaaaagccaatctagctgtggtacttagctttttcagtaaaaaccaaattgaatagccagtttatgtcttcagagagctacctttgaacagaacttaggtttatatattcactcttaatcattttagttatgaattagttgtatctttatgatatattgaattctaaataatataagtacctcaaagataataaaactttatggatcacattacatgagttatctacattagttattaaaaaaattaaatacaaattgaaatggataaagttacagtaaaataagtcaaaatctatatttaaattttaatggaatataaatatatatattttattataaacaaattagttatgtttatacatagttaataaatattctcaggtatttgtgggccaagactgttgtggtattctttatcaataaaggccaaaaagctctggagaagtaataaatatgctaatttataagagatattattatactatttctttcatttttttcccatggtctagccctttaaaatatgatacttgaaataaatgttagtttctaacttaaatgaagcttattaagaattacaaggtggtaattatttttaagaaaaaacacccactaggttattaacatcattttccttaaaaagatacaggattacaaactcttatccattcttgaagtagaattgctacttacagaacatgtattatggtactgtctgttgaaaagtttagcaattatatatcatgacataataatcagcatacttttggtctatgaagtaaaatactcctatgaaaatctgttcctaggtattgctatacttttcaagagaattttctatgttgtattagttttggctgacacagatacttgctttttggtttatcctatagtatatatttagatcctctgcagatgaactgatgtgttctagacaggaagtggtatgtaggagatataggaatgggctgaagtatcctttatatttgcctttgtatctaggggagttggaaataggcaagaatggagagaaattttgtatggcagtacacagaattttgcaagtttattgtgagccctgcaacaatccgatgcattttagttactggtaagtttgttaaattatgtttgaaaatgtacctcttcgaagatggccatctatttactattacgtccaccatgtcaattataccttattgtaaagatttttttttttttttgcaaagatgtggtattgctattgcattgggttttaggtataaattaaaacgacttttgttagtgaatgcatttgacatttcaattggtgtcctggttaatattgaagtgaaattaacactttatggatagcagagtcctgtgttaagattttggaataataatattaatatttctgtttttgtaatggaactccactgtgtttagaggtctgagttaactcattagatgtttgagagtgagtagttattctgacataaaagaatgagaaaatccatgtcatccttgcaattttacatggttctatatagtagggcgatttactgtaagaaatacttttttgccttttttcatggatcatagggaccattgtgaggcatttctagtcgttctttttggcagtgctcatgcttaggaatccattttccccctaaatcactaactttggtgtatgtaagaattctatgaacagattaggaaattgtgtaatctctacccatagttttctttattctttttaaatatctaggcagaagtgttaggtgtaatatagtacttagcaattattcgtgaagtggccttgactattcaattcatttaaaatggactagattgcttaacagctgtgcttctttacagaaacatttttttaaatcccaagagattccttggtagttgtatttttcttgtaagtgtctgtctttggcttaaggacaaagtaaaagaatatcattgatttgtgatagtttacttttttttgtggtttaaggatataggatcagttaatataattgaattttaatttcctgtaatgaagtactttatttctagatactatattttgtctagctggtatgtaattcattaaactatgaatttttataataatgataatgataattttgctgttggttcttgttatgagaacatttctaatttgaacaaaagtagccacattatgagaaaaatgtattatccctattgaaactggaagagctagaataattcaaaaattagaataacttcagattccttttgggctttaataattttcaagttttccttattaccagattgtctgaatcacttgtaagaatgagtacttctgcatttaaaatatgtttagaaatttgtggttttaccctttcttatgaatataaataggtaatttatggtatattataaaacattgtaaattgatactattttaattcatgataaaatctggtctataacaatttattttgagctacattaagcatatacaatgaaggaatatgtatttccgttatttagaatactatattcatgtatcagtgttgctggttaaaatcattatatgtaactgtgaagtaatgcattatcaaagcttaattcaatgcaatcatttctttttattttgtttcttcattgattccaaagacaaatcaagtgcttaactttgacacctctttgtctgcttttatgtatttgtttatatattgtgtaattgtcacttttcatttcaatattacataaatcattttatttgctctcatgagcttttcttagggcatacctggacataagtgacatgttacatatttctctggattttttttaatgaaaggtttttgaagaatagttctaaatgaaaagtttatttaaaaatagagtttgttgttacaaagcaatattgcatctatatttaaaattctctacaatagcttgttattcaaaagaatagtatgatacaggctttattatgatacattataaatgatgtgtatatgtttcttaggtttacttgaagccagacatataaatatacgtagagataaactttgatgttttactttggaatgtaaaaaaactacacagttatgattcagtttattatatttaatttgtaaaggacaacagtagttttctcatgcttatgaggaaatatattctttcataatataaggcataatagtcattgtcagtaaaatagagatgagatttgaatatggttatcttttggcataataaaatactgaagtgggacactgtttataataaacatgtgatgattacataatgatgtctgtactttacatgcagtgctactctgttggcattcctggttgaactacttaaaagttcagtagccatgcaagaacagatgctgggtggaaaaggctttttagtcattggctacttacttgaaaaggtaagtgatatgtgttgatggttttattgtgtagcttcacagttggacagctgttaatcactaatttttttttctgtaatttcactttccattgactgtgtagagattatactatttgctaattcacaaacgtcttagatttaagtgtagacatggaattaactgggtatcggaagtgtaattaagaaattttgaataaaaaaatctaaataaaaaatttacatctatatctattcaagcaataagtatcatttctcttaagttttctaagtagtaccccctttatttctactctcactttctaaggtgtcacttacccatggtcaactgcagttcaaaaatagcatggaataaaccatttataactttctaaattgtgtgctgttctgaggagagtgatgaaatctcatgctgtccctcttcatcaagccctggacatgaatcctccttttgttcagctttttcatgctgtatacactgtctctccattagttatttagtagctatctcagttctcggactgaaaatcgtatttattatccactaggggtcttggaactatcgcgtcaggataaggagggagtactgtagttgtttctttgctatcttttcacttagacttttttttttttttttttgagacagtgtctcactctgtctcccacagtggagtgcagtggcatgatcttggctcactgcaacccccatctcctgagttcgatcaagcgattctcctgcctcagcctcccgagtgtctgggatcacaggcgcgcaccaccatgcctggctaaagttttttttttttttttttgagatggagtcttgctttgtcacccaggctggagtgcactggctcaatctcggctcactgcaagctccgcctcccaggttcacgccattctcctgcctcagcctcccaggtagctggaactacaggcgcccaccaccatgcccggctaattttttgtatttttagtagagacagggtttcaccgtattagccaggatggtcttgaactcctggcctcaagtgatctgcccgccttggactcccagcgtgctgggattacaggcatgaaccaccgcgcctggccttagactgtatctcgaaagtcttttttattaagataaaaatcttaatctatatttagtatacatgaatttacctgttaagttttgtgttattttttaattatgcggtcaaaatttttattttgtggtaatagaaacattattttgtgctctttttccctgctcttaatatatattatttaaagtagtttttctgatctacgcataatataaacaataaaaattagatgggtttactttttcccattttgtgtcatttatgttgttttatgacctcttttgctttagtcaaagctgtgcttttatgatgagtgctgaatttctgattatgatctcacaggagtttagttgtattatgtgatttcctttgaaaattaaagtgggatttcatgaataagcgtttttttataacaaatacctatgtcttttattagcactctctgaccttttcttatcagttagttaactctataatattcagctgctctgaaaatgaaactgttggagaagtaatagaagtgagatctcaactaagggataaacatatttcctttgcaaaaaaattgagaagatattttgaagtagttttaattttacctccaattgttttacatttgaaatattatcaattgattaatggataaacaaaatgtggtatatacatcaattgaatattatttagtcacaaaaataatcaagttctaaaatatgctatattttatatattacatgtctttatacatattgtgtatataacatgtcttttctttgaaacaagtgttgacctttctttaaggattaatgattgaaaagtggtagattgttaagtagattgatcattggtagcatttctttattaagatgattttttccataacattattaagaacttaaggtcctttggcttatttttttgaatgacagaatactctttttctgtatctagagtataatatttgtttagaagatgtatgataagctacatttaacatgaatttgataacatatgaaatgcctttgtaagattactgtgtgtgacaggatttctgtgaggacttaccccgttaaataatttgctttcatttgtttgatgagaatgtatcagaaaattctaaagtaaatattcttttacttaaaacttagcttataattagaaatatttgtaaaagccttcaaataaagacatatgttaatatttcaaatattataatgtcaatttagtggatgcaaaatatttcattgtggttttaatttgcacttttcctagatttcgaataagattagacattttcatatataattatagaaaattaatcttttatcttctttgttattcatttcctttaccagtattccctatgtctcttcatgattcccacccctagtcaacccataattcactttttggctttatgaattgcttattctaaatatttcacataagtgagatcatacaatatttgtctttttgtatttggtccattttgcttagcataatgttttcagtgtgcatccatgttatagcatattttagaactccgttcttttttacagctaaatagtattccattagatgtatatacattttgcttctccattcatcagttgatatacatttgtgttgtttctatcttttggctattatgaataaagctgccatgaatgttcatgtgctaggttatatgtggacatatgtttttatttctgttcagtagatacctaggagttaatttgctgggtcctatgtttatttgagaaactattgatgtttttcaaagtgactccagcattttacatcctaccaaccatatttaagagttccattttttccacatccttaccaactcttgttttgtatgtctttttgattctgaccctcctagtgggtgtgaaatggcttatcaattttaaatttgcatttttgggatgactagtgatgctgaatatcttttcatatgcttgttgtctattttcatgtgcttattagctatttattgatatatattctttgaagaaatatctttagatcctttgcccatttaataattgtgatatgtgtcttattattgatttgtaggagtttttttttaatattctggatactagtcccttaatagacggatgattaacaaatatatttctccattctttggatcacattaatttgtatttccttgatgacaataaagttgaacatatatttattttcctttgggatatcttcttttgttaaatacctctttagagtgccaattttcatttgggttgtctgtcattttgttactgatttgtggaaatcatatatgtattttggatgtgattacttcattggatatacactgcaaattatctcttcttctttggtgtgacttttcactctcttaatggtgatttttgataaacaagttactaattttaatataggttaaaattttcagtttcttttatgactagcccattttagacccatatcctgaagccataagattattctgtttccttcttaaaattttgttttatctttcatatttagatctataatctatctggaattgaattttgtatatggtatgaggtataagggtcaaggttctttttttctataatctatctagaattgaattttgtatatggtatgaggtataagggtcaaggttctttttttcccccatgtatgtcatctagctggcccagtaccattttttgaaaagatgatttcccactgcattgcagtctaatctttgccataaatcagatgaccatgtatgactgggattttttttgtgtgtttcagacagtacaacagtattttaatttgtatagctttttagtatggcctgatatttaagagtatgtcatctagctttactgttgttcttgaagattgccttggctgtttttgggtctttccatttccatatatatatatcagcttatcaacttccaccaaaaaacatgaggatttttattgtattatattgacatctttcctatattgaatctttcaggttatatacttggtatattcttttactaattgagattttcttttgtacttttctgtatggaacagtttctgtctttttgatggatttatttccaggtatttgatattatttgatgcccttaaaattttaatattttacacttgatcttacccaaaaggccaagaagcaattaaaagttttgatttttgttactggtacatagaattataattgatatttatgttgaacttttatataccagtctttctgttcctctattaaatctagtcatttgtagattttttcagaaaaatttttgtagacaataataacattggagaatgatagttttgtttttttcctttctaattttagggtttttttccttgccttgttatgccacctaaaaagtgccagtacagtgttgggataaaagttgtgatagtggccatccctgtcttattcctgatctcatgggcaatgcttttaataattacactaagtatgatatttttaatagattactttgtgtggattttttagttaaattaaggaattatctatttctggtttcctaagagttttctttattataaacaggattttatataacatcttttctgtagtacttgagatgattaagatgtttctttatttttcttaatttagtcaattacatggattatttttcagattttaaaccttccttatattcctggactctcgtttactcctaaacctactcctattccaacctggttttcattcttacatgtcctttaagatggctcatgtctttgtcaccagtggccttcataatctgtcctgtgattatttctcagttcttatcttatttgacctgtgaatatttcagttgaacattctttccttcttgaaatgctttcttgcattgtgttttgtgatggcttgctttttttttttcttacttattctctctcattagttctgcttcatctttctaaattctgatgactgttctgtcccagtgattaatcctggaaagcgtttcacttttccatctacacagtaccttactctaattgagattatccacttctacagtttccatgatcctgtaaatactaattactctcaattgtttctcctatttttagttccacttggatttctggtaatcttcttgactaaattatccaaactgatttttctcttaatttttcatccttcagagttctttatcttatttagtggcattactattcaacaagtagttgaaaccaaaaagttaattctttttgactctactttttttgcgctctagatccaaactcaggaaattatgttgtcttactgtcaaaatgtatccagaatcaattactacttcctctttacttctcagctccttaccatgtcagttgatatcatcttagttcaaaccatgatcatccttcaccattggttacctacaatccatttttcacttgcagttagactagttatcctaaaatgtgccaaatcttattcaagtcttcatccttctcataatgaagtcataagccttatacctcacttcatctcttcccactcttcttgctttctctattttaggcaaaggtctttttgccttttccttaagaactaaaatggtaaacatttacccaaggacttttgcatttacttcccccattgtttccatcactctttcttcagatactcacagactttgattctatgcttcattcaggattttgcttatatgatgccttatcacagaaatattctccgatcattctaaataaattagtattccttccataaccatcagtgtttacctatgctgctaattttgcagcaccattctggcatgttttatattttttactaattttctgcctccttctgctagaatgtaggctttatgaaagcaggggcaatgtatatatatttttgtctccccttattgctgtatcttcagcacctagaacagtgcttagctcagtaaatggttgttgaattgagtatatgaaaagtccttgtatgcttgtctgattacctgcaaagagtaacttttttacctttcttggaggagtgctcacattttgttatttttaaataatcactggcaaggttagtattaatagtataggtaatagaagtttcattttttaatttcttaactaataacaggttactggttaactgccacttagcttttatatctccttgtcatagaagatgtcttaggaagatagtatatgagaggcctttttattaataacaattttactgttccacgaaaaaatttttaggtgtttttgttctgttttgccaaaatgtgatcttgtgggaaacttagaggttatccagcgtattcaataggatatttttgattgtggttagtagaaaatttgattcaaagtatcttaaacattaggaaaatatactaactgatgtaactgaaagcctagtgttagatggcatatcagttatattcttggcagggaacagatggcatactcaacctaggtttttgagaagactttaatgcaagggtatttaaaaagttgtaagcagggagcttggcaagatttgaagagatgagggaaataagtgtttagcataacccaaagagaaagttattgtagctattaggagaagggtacctgatgggagcgtggtcttcaagaaaggagtatagtgtaagtgtactgaaggggtaaaatctggaaaatatatacccaacttcattttctttctgtcctttaatttcttgctaatgtcttcaattagtcaaacccaactggaaaccagtaggcaagggagcatcccaagcataaaaataggacagggaaggttggaaaggcagcaaaaggttggaaaagcagcaaacagtaagttgtgtttcagggctgggttatctaagtctcaataatgtcatcagagacccaggttttatctatatctctgctgtaccagctacagtgttgattttatgctaaagctgatactctttgaggtcacaaggctgccagagagaattggcgctatagaccttcacatccaggtgaagaaagcgagctcatttctgtcaattactgagcaagattcttctctccaatttgattggttagcttagagcttggctagcctacctttgaaccagttgttgctatgagaatgctaaactttgatactgaatctctgagctgatcattgcctgccaccctcccctccactccctaccaaaacaacaacacatgattaatctggttggattaggctatttggagcacaaccttggagtcctgggaggagcagaatggataatagactataaggtacctctacaattacaatagttttacacaatttattgaatatatactcatacacattatatgtatatgtgtgtgtgtatattatgctttctacaataaaaatgaacatttctgataacctgttctattatgggctaatctaaatgttggaacaatctctctttattgaatagaagtttctctttgtaacctctagtgctcctatttggtttagttaattctggagtggatgctataacgcaactatttgtataacttcttagatattatttccaaatatggttagccatgtcacatatagtacttcttaaaaattatgtattctgccaccacatgaaagtaatatatagatcaaattccagagcttacattttctgtaagatttaaattgtatttccatctaaaggttacagatttataactataaattatccaagtatagatctctttctaaaatagctttacttgagaaaatgaaaacaaataccaaaatataaaaatattttaaaaccgttaatcaaaggaaatacatttaaaagcagagtcagagatcttctttcttcttttcccaggctgtgttttttcctacctattctattcttactgtttttgaatttgacattaattcagttaaacatttcctgagaaattagggtagggatcaggaggataaaagatgaataagataatatcctttcttatattaggaaagagatttcttttttacactaacaataatacaaggaggaaagataagtactactaagaggtaaaggtaacatgctgttgaagagaatattcatttatgcatttatatactatttacaatccaaaattgtaggattttgagtaggtcaataaaaagacacaattttagaaaaatattttccaaagaataattttagaatgcaaatctgctacccaacagcattaattggtatgcgaaaacaatggccccctccgccttttttttttaaagtaatgtagaaggccttgtgatgcttctagtataccttttaatatcatggtccaagttccaaacttgtttctatattatgaattcatcaagtggatatgtttataatggtcagcctgattttataatatgggttaatgttcttcatgaggacatgatgaataatttttatgagctacagtctggtcacctagcatgtttatctagtaacaggatctgactgtattctattttagagttttaagtgtaagagtagaatgtatcagatcatgttcttgaaatcattactactgaataaaaatagaatgtataagataagctatgtgaaattataattagtgaaggagctggctacagttttaaataactagtgatctcttattttaatttcatccctttacaaatattttttaaagtactatattattttcattgatattcctttaaatatgattacccgatctttactttttaaactcaaatacttgttttggttcccccccctttattaactcagctatttatttagatcatttccaccatcttctgtaaaattttcattgaaaattatgtactaaggtttggtttgaattttgtaggctattgcttatgtagtaagcaccattggtaattttgtcagacacataattctattatattaatactaaatcatttttaaccttataataatttgaaccaattaagtggcccccttcttagtaaaacctgttaaccatccttctgcaaatgttttatctgccccatagtttcttccatgaacttagtaacctctaacattttacatattttacctttttattttattaactatgtgttcctgccttatcatctcttagaatatgttctgtgaggaagagtttttttcttcaattttgctagctgcttttttgacagtgccagggagcatatttgactaatagtgagtaatcaacatgtatattttctaaatgactaaaagtcttgagttctacctttaaggtaaaggaaatgtatgcaagggtgttacaaactgggggagcaacatggtaaagcagggaagcaaacgtgtcctgtgggtgaaattggcccacagtaatattctgtaggactcagcaaagaggttagttttggtcctcaccaatctttattgtctcctactctagtttacacattgttgttagttatttgcaatcattttagttcgtgaccgtttatgtagaagtgtgaaaattcatgaagtgcttaagtcaaatatattgagttatccttattatgagcatgaaaaatgtagctaaatcatatgggaggtaaaattggtaagacaatttcatcccttttaaacttagattgttttaaactgatattcagacttcagttagtgaagaatagcgaggaaagatgtgttgtgtgatgtgtgcttcaggattgagtgataggtgattctttaccctatgactgaaaggatagtgatactacaaaatagtatcactagatgaggaagaaaagatttatgtaggaagataaattttttgatatttgagtttgaattatcagcttttatgaagagcatttttttaatattatagcatttttatctgaaattgtattctagtatagcattgtccaattaaattacaattcaagcctcaggtgcaatttaatattttctagtaaaaaaatacaggtggtattaattttaataacgtatttagcctagtattttattttgataatatgcaatatattatttcaacatctattcaataagaaaatatgatttttaaaaatattctgagctggaaaaacccagttttttcatacttatgacacatctcactttcaattgcaatattccagcagctcaatggccacatagggcttctggctactgtatgagatggtgcagctttaaggtttggtttcaattttggagagtctgttgtttaaataccattggtaataggtacatggtgatagtagttgaaaattcttgaagcgagtgttcagcatagacatagtgttatatgaagctgtgaaagcatactatatcatccaaggatagagtatttatggagaagagaaggccaaggaaataatattttaagcagtattttacatatttttaagcagtatttttacatattttaaacactatcactttttatttctatgtctaagatctcttcttgtatgtcaatttctacaaaaaatgaaatgaagccattatttataacatttcatttctttagctaatagtagaattatttaacttgaattatttatctgtaattgtcttagatcaggcttcaaataacaagctatcactcaaagaaatagctgaaattttagatctcttaaagttatattttaatagcaaagaaaacaaatgtttatttcatatttattagggatagcatatgaaaaattcatgtgtccttatgctaaatcagaaattatacaatttgatattctggatgtttcaagctagaatttctgttttctttcttagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggtatgaattttatacttattcagtttgatttagtgtaatgttatacattatagttgctggatctatagtattcagtggaaaacatttgaacattttagcttattttatagttaatctgtggcaattgtgttaggcagtatcaggagatcaaaatatttataagcagtaaaataaatgaaacaataggtaaaaaagaatctttgtgtaacactgcattctaacatctttagatgtgatacttacttttcaatgaagaaaatttgctataccaatttttgaaagactaggaaagagaacagataactaattgtattatgactgtaatcattttgctggaaaattgctttcattttgaaggtagaatttatatcatgacatgtaaataatactaatttaaaaataaatatatacatgaattaaatattttccagataataacagaaaattcttattgttttatatacaaggatttagtcctagttgaaatcaataatgagggatattttgattttgagctatcttttatagtttaaaaatatctcaccgagttattaattattgcctaagcccaaatctgaattttgacaactcttttttttttttttttttaaatgttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaaagaagacatttatgcagccaaaaaacacatgaagaaatgctcatcatctttgacaactcttttaaccaaggtgtctgacatgccatctctatgctcacatggtcagattgtgaaagcgaactatatgttatggccataggtgaggagaatttgaaattgcatgaacttttaggatatatgacaaaaatatgtatgttttcagatatgctttagctgactgatgttctattgctatgaagaaatttttacattgaaagctactgaaatgtactttaagagctttagttgacttttaaaatattttaatctttttatcagattaatttcaataaattattaaatcattttaaaattatttaattgccacagctgttggactacctctattatgagtttattagaatatgttaattgcagattatatattttttaaatataaataatattgaagaagaaagttatttttaacctcataataaatggtcatttcttggtctttactaattcacatttaaattaaaactgaatgtatataatatgagcacttgaggcattttaaattcattttaatgatctgttaatattctgtattaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattaggtatgtataccacttccactgtatttacatttgcctatgattattctgtattctgagtactgttaaagtgagcagtgtacatgactatgaaatcactgaaatgttttctttcttatatagcaaactggcatattgagaattgtttgtggtaaagaagtttagggcttttcaatattaaattatttcggaataaaatcagttaaaaagcaacaatagtctttattttagcctgtatgcttttttttcattcaggaagatacattcataatattaaaaacagataaatgatattggttataactggtgtgttctagtacatcagttgctttcaacattttcagattgttaattttttatattttattccaaatttatcctttgttctgactataatggaaactaattcttcactgtgattttttttttgaaaatatagccagtttttctaattatacaaaaaatatagaaaataaaataatacagaagaaaaaatatatttatgacccaaaccccaagaataattactgatatgattttggcatgttttcttccagtgtttctcattgcatacatatataaaaatatttaaactttttaattatagattgagattttctcaatttttctatgttgttcttttctcagctcaatgtagtaatgtaaggggatgtaccatttacatcgtttctaaagttttgattctgtaaatgttagagcattctctcatttatatatgtgtttacctccatctttgatttgtttaaaattactgagaaaggggctaatgacaaatattttaaatttttttcaggaatgtcatattattttacagttttaccagtatatgttagagtacttccttttgcgtgctcacaatagcattgaatattatagttttataataatcccgttgataaggaaaaataacactttcctttttttttttttttttttttgagacggagtcttgctctgtcacccaggctggagtgcagtggtgctatctcagctcactgcaagctctgcctcccgggttcatgccgttctcctgcctcagcctcccgagtagctgggactacaggcgcctgccagcacgcccggctaatttttttatatttttagtggagacagggtttcaccgtgttagccaggatggtgttgatctcctgacctcgtgatacacctgactcggcctcccattttactattctaatatttatataagcttacttttatttctttttattaatggggctttagaagttatttatactcagatctgttgttttgtccttttatggcttcttccattgcttttaagttagtaatgcctaaaatttattggatttttctgccaagcactctacatgttaatttgtttaataatacatataatgtaattatagataaatagacatattcatatacatacataagactgcatctatatataactttgtttttgatattatcctcattttaaagattaggaaactggaagttggtacaaaccgaacagcaccaaaatttgaatcatatccatctgactcagagacctagttcttaaatgctacactatgatagagttttctctagtctaaacaaatcatatattcacacataataatttctgccttaaaatattaatttctaatttacagaaaagttacaaagttgcaagcattgcacaaagaattctcatatgtccctcaccagattctcaatattttacatcttatcactttagcctttactattctctcatgctctctttttatgtatatataaacacacctacagatatatacacattttttttctgattcgattggtaataaattgtagacatgatactctgtcacctctaaatactttattgtgtatttcctgaaaggtaaaggcactttgttaaataaccagaggacacccattaatatcaggaagttagcattaatatgatactatcatctaattcagagaccccattcaaatttcactaattacactaataatgtcctttctaggaaaaagaaaattattttgccctaagtctgttgaggatcgtatgttgtgcttagttgcattcttacttttaatgttcttcaatgtaggatagttttttagtatttccttgtctttcaggaccttgacatttttgaataatacagaccagttatttttttgaataaccttaaatttgaattttctgtttgttcatgatgattcaggttttttcatttttacaagaaataacacagaagtcatattgtatctgtctccttgtatcatgtcaaggaggcacatgatgttgagttgtccttttacaagtgatgttaactttaaacatttgattaaggtattatcttccaggtttcttcattacaaaatcactcctttctctttggtaattaataagtatttggtggagaaatacattgaaactatataaatagcctgttcttcaacaaagtttcacctacttgttttagtttgttgatgattcttactagattatctttattgtgatgactgacaaatgatattttctaagacattaattaagttggcatatctactgtaaggaagaacttgttttactcctccactcatctatctatctatctatctatctatctatctatctatctatctgtctgtctatcatcttttatatcagtatggactcatgtattcaatgtgttatatcaacagttagcatactttctttgcaaagggccagatagtgttttaggcttacggagccataaggtctctgttgcacatagtcagctctgacattgtattgcagaaataaccacagacagtatgtaaacgaataggtgtggcttgttctagtgaaacttacaaaaacaagtggcttcatggatttagtcctagggctgtggtttgtctgtctcctgggttgtatcattatttcgatgctcaagatttggccagtaggacccttcacatggattatgggacaaatgcccataagtttttaatactattttactttctgaaacaagatgtttctgacttgtcctacactttccttatcccgccctgaaattagccatttttccaggaagccctggtttgtttggtggatatggtttttagaaaccaagatgtggatgtgaggtgtgcttcttggtttttgaatgtcattgcttctacgtacttttagtggacagatctaggaaatgatgtttatatctatgtatataggtacatctcaactgatttatctgtattaaaaccatgagttcacagcagtaccttcaattccagtccaaagccacatggctcaacctagcctcaaactttttaaatttgccgctttcttcttcaatagtgagaaatcttgctcctattgtctttaatatatttatatattttcttattctactttataaaaccagtgttttgatacacacggcataaccttctcagctttaacattgctagtcatctgtaaccataccctcagatttgactctgaatggcccttgttgtctcctcagccccagttgtttctttggcactgccaccctcctgacctctactgtctccttggccctgaccctgaaagtccttccagactcacttggctctggctctgtaagaccctgggtatcaccagggcctctgctccctccatagaacccttgcccctgaggcctcactggctctagctacatcaaagagaaggaaaggaagagtaccagtacatatattttaaatgaaaatgacaggaaagtggaatcagcatttattttcctttatcatttaaattattattttactttaacattttaatactttgaaattaattttgttatatagtagaatgtaaggttctgacttgaagtatatacttttctaaatgacagcatttttcaataccattttaaacaaatgctttcttttaaggacactctaaagataatttgcactacactagctttcgtagaactattcatgtgtaggcactcgccttgagaagtaggatatttttgctttaactgtaacttaacacttttgtctcttaaattattattatatatagttaagtgtaaaagcattgagatatattaaaaatattataggtcaggtaatacatatttatggtagcaagtgaaatcatacaaaggtttataaataaaatgttactactctcccaggtagccaatgttaccagtcttgtatatctttctactgctttttctctgctcatacaaacatgagcttactcatgcatacatataggtgtttcaaagctttattttgaatacatcatgaacacaaagtggtataattacatatatcgatgtaatatataaacaagttataattataaatataaatataaaatgaaccttatttaaacatcactaagcctaagaaacagaatattaccaatgagcctgaatattctcatgcgtgttcacacctcttttctactccctgtcatagaaataactccgtcccaaattttacgttatttcttttctttacttgggtgcttattattttttactatgttttactcttgctatttatgtatgtattactaatttattgtttagcttctatagtttacataaatagtattatttggggatttgtttcttcattcaattttatattagataaatccgtttgtattttattttgcagaaatggatttatatcatgcacaaagcacacaaatatgtatatatttctttgcaacatgctgtttatattatgcagtatacaataaaaataattattgctaacatttgagtgcttgtgattaaaatgggcctggtactagtctaattcctttacatatgttgatctatttaatcctcacaagatgtcctatgacaagcagtattattattcttaccctaacaataaagaagaaaacaaacctaaggcacagagatgttataaaactggtccaattttattaattggtagcagaaatagaagaataaggaaattattactaagacggtatctgtctgttcttgaatggagtgtgggtgtggtcaggaaaagcaatgtggcacagagctgaggtctggagcatggtgagggctttggcatgcagggcaggatgggaccacaatcagttgttagatattcaggaattttatgagcaccttgttaaatcattggtagcttgaacttgaaatcagattattattaatatgatagaaatcagaagtacataaatgctcaaaatcaggacctcatccctccactctgcagataattcctttaccagcataccaatggttgacgggtttccctgtcaggctactgtcagtgttcaatttcttgaccaaagaagtgtttatacaggtgttcatttcatgataattcgttaagttgttcatgtatgttttctgtacattggcaatattttacaatgaaaagtttttttaaagtaataccaagtgtcaataggaggggaagagtactttgtgcatcttggtggcagtggggcaataaaaggtggagagcagtctgggaaatagggaagatatttcttttattataataggcgggatggattttttggataataacttgcttgcagatataataatcttcatgtaaatattaagtgaataagcagatgctatacattatacatgaagggattatgcttttaaaacttgtaaagcagtagataaatactggttgctacaagaaaggcttaatgttacaggatttttatgaatctagcttcattttttaaaagtattctgtattgtatattatgcatattagaatatattatattttcatttttattagtaattaaatattttgaaattactttaaaatttgtacgttatgatagaactgatatgcacattttaatattttatactcattttcacttattgacgcagcataaatgcccactataatatgtattttctgtatacaagtgacatagaagaaataggctgcaaaacaaataattgcaataaaacagagtgtcattttttctgtgctttgttaaataatgtgtggggtgaaaatggagagagtccttaaatgaagacaagtttaattgagagtggaagacatattgggaaacctattaatgtaataaaaacagaaaaaaaagcattaatataaatacttggggattatacatttataaatggatattaatatataacaactttttaaaaagttcttttttccacaaaatcagacattcagtaaataatttgaaattgtcaaaaatttgaaagttaatttttggatactcatatattattaaaattttatagcattaatataaatattgtaattttaataaagataattattcaagaatgccatagtatcccaagataattgcatttagctaatttaatatcttgtattttttattttacttttttttctgttttgttctagatggtccccggccatcacaaaaagaaattatatcactgagggcatttatgctactttttctgaaacagctgatactaaaggtaaaataattttatataatttaaaataatagtatattaggtagaaaggaatttctggcatgttttaaaattattaaattagtaatagctacctttaattcatgaattgctttcaaaattctccacatcttagtattcacttttattgaacttaactaacttctgattaaatgctctctgaaatcttccctattaagggatgtgacagaaatggacaaggaacatatgaataagaattgagcccttattcttatagtaattgaccattattcgagaaaatgatctgtgtgccagtttaataaggcttacataatgtattttattgtagtagaattttttaaatgttaagatgaaaccaaagtgaaaataaatataaattgtgagatagtacacaaaaattgatactgtatagtcttgcatttatattgttttaaggaaagagtaagtgattagaaaatagtcataagaatacttagatggtcaaaatatgctaactttttatagtgaatgtcaatcaaatactaatgacttttaaaaattgatataattttctaaatatttacttaacttgaaataatacagtctataaattgtgaaatgtgtggggattttaattaaaatatcactacattaaactaactcttattttcttttacaatgattattttgacatcttttttaaattaaaattttaattttagatgtaaagtaataaaatattttttaaaaattaggatcgaggggtcaaggaagatgaacttcagagtatattaaattacctacttacgatgcatgaggtaggacatgttatgggccttttattttaattatttaagccaatctttagagtaaaattttaaatcaacattggtgatttatgcaggatgaaaatattcatgatgtgctacagttactggtggctttaatgtcggaacacccagcctcaatgataccagcatttgatcaaagaaatggaataaggtatgattataatattagtattactattagactttaatggagcacagttgttcctcctagaataactgctattctatgaatatttgaataaatatagcaaagtcttgcacataagagaataaatggagaatgctgctattgatcctcgaatactcaggaaactgatgaagtgtataaacagtagtctcaggaatcaagaagagtaattaaattgtatttgctatagtaaggacattacaaattgtgaatagagcatttttttttccaagaagacacgaaaaagcaaggcacattttaccaaaagaggatacaatgaaattttatgatatgaggcccgagagagattatagccagatttggaaggttcatagaatggtaataactttagtggtttttttctttcagctggtgatgaaaattaaagaattttgagtaggggaaatgttgtgctcagattgctattttgttagatttacaatcaccagtgtgaaacatgagttgaaggacaaactgatgtagcaatatcagcagggagattattttattcatcagtattaaagatgatgacttgagacagtggcagtgcaatggaaataatagagatgaaagatgttttggaataacaggccaaagccaaaagaaactgaaaaccaacttttgttgtggcaattgaaatgtaacttggtagataggtgaaatataatttcttaattagtatttttatgaacttaaccctatcatttagctttttaaggaattcttcgtttttatttttctggagttttaattagtgggatgagcaggatatcgaggttatgccatgtataactcagtgaatttccacagttttattgtgaaaaagagtttggaaataatatatcagtgactgtcaagggcttttttaagtgccttttttacttggccatttatatcaatgaataacaactttctagacttgaagaactccttttcaaattagagaagcaatcactatctctttatgcatatctcagttgtgatatgagtattacctttgagtttataattcatagggctgccaatctatttgaagaagattatacatttagtgattaacaactgttacaatttttttttctttttgagacagagtcttgctctgtcgcccaggctggagtgcagtgtgcagtggcgcaatctcagctcactgcaagctccacttcccgggttcacgccattctcctgcctcagcctcctgagtagctgggactacaggcgcctgccacaatgcccggctaattttttgtattttgttttagtagagacggggtttcaccatgttagccaggatggtctccatctcctgaccttgtgatctgcctgccttggtctcccaaagtgctgggattacaggcgtaagccaccgtgcccagcctataattttttactctagagtttgagctatatgaaactgttgatacttaactgattttacaaaataatgacaatttcatatagctcaatctaataatgtagtacaattactctcactcttctgaacttatatttagattgaataattagtgtccttgtccttagattttgctttgtttattatattacttgataaatttagtgaatcagttgaagatatccacattactcttgtagaagataccaaacttagattgtctagtatgatgaaatgcagaaatataattgtattattttgacacatcggaaatatgatcctacaattgagagtgctatttggtaagacctttaggatttacatgtattttaaatgtatggtacgaaagaactaattaagcacaacagattaaaaggccttgtgctcatggctgaccatgagcagaacatgtcagattgttacccgtatgttaaaaacaatcacacagattaaaaaacggcctttccttgacacttcagcttttctacttcaaaaatgtggagaaagctggttcagaatagtataaaagatgaaaaaaataggcttattagatagaaaatattgaaagtggctaacgaatttatatgtctgttttctagaaaatagccattaaaggctaacagttgtatatgaagtattttgggaggaaaattctagtctgttgtaattcatacagttgaattcagtataacagttgaacaaaaagaatgaactcagtttaattctgatggtatgctaattgggcttaaggaagcccttgtaataacagaacactgaagtaagcagctaaaaatttgatgtttttatatctgggaaatttcaaagaaaggaatagacagctacctctcttatatagcttagaccatttgcttactgaatatagtgagcttaagcagatgtattaggattattgttatttagtaataatgtatattacaagtaaacattaattaacaaagtaaatttcttattcatactgtatcacatccctaggtatgtagatgtgtgatggacctagacattttcatgtttcaacattagtcataatttctcttgacccagggtggggtctaataccttttttcctgctactcgaagttattcctagacaatagaaactctgtgagaacttccagttctatatttgagtgtagccacatttttagactgtgagggttttttttaattttttaatttttttttagagtctcgctctgttgtctaggctggagtgcagtggtaccatctcggcttatggcagcctccacctcctgggttcaagcaattctcatgccttagcttcccaagtaactggcactacaggcatgtgccaccacacctgactaattttttttgtattttggtagagacagggtttcaccatgttgcccaggctgctcttgaacttctgcgctcaggcagtctgcccaccttgacctcctaaagtgttaggattacaggcatgagccaccatgcctggcccagactgtgagcttttactttggttctcaagactatttttgctgtttagtgttgcttcttatgatttcttgaatgtgttttttttttttgacatgtctgactttgctattctcagacttgtcttttttcattactgatcttggttcctaaaagttttgaaaatggatttcagtgtaaacccatacatatttatgaatgtgggatttgaaaaaaaaatcttccaaaggaaataatcacttttctcatagtttattctttaatagatgaaatgcaaagcataaaagaaaaaaagagaaaaagaagcagtatcaataacatcttttcttttttaatagtataagctcttggcaaaactaaaaataatgactttaagctatttgttcccctttgtatcactgaaactatgaaaattatattgcatcttttactagattctcttgttcagctgagtactttacctcaaaatatgccatggcattttattttttcagaaacatatttaataaaataaagcacactataatgttacagcccctaaagaaccttcttgtattctagaatttgttgccagtgtatatagttgtcattgtcccttctactttatggaaacaaattactttttttaatagaaaaaatggaataaaatttctaaacacttaaacaaatgttataatgaatatggccctacttttatatagtacttgaagtgattgtataggttaagttgtatattagtggaggctattttgctccaagtaacagaaaacctctaaagcttttaaagtaaaaactgaacaatatacttgttaaaaaaaaccttaccaaaggattataaatcatgctgctgtaaagacacatgcacacgtatgtttattgtggcactattcacaatagcaaagacttggaaccaaaccaaatgtccaacaatgacagactggattaagaaaatgtggcacatatacaccatggaatactatgcagccataaaaaatgatgagttcatgtcctttgtagggacatggatgaagctggaaaccatcattctcagcaaactaccgctaggacaaaaaaccaaataccacatgttctcactcataggtgggaattgaacaatgagaacacttggacacaggaaggggaacatcacacaccggggcctgttgtggggtcgggggaggggggagggatagcattaggagatatacctaatgtaaatgatgagttaaggggtgcagcacaccaacatggcacatgtatacatacgtaacaaacctgcacgttgtacacatgtaccctagaacttaaagtatataaaacaaaatcttagagtaggaaccaggaattgtagggctgttaggaaacaagtttgctttatctactgctttctgtaagctgtttaatccttccttctgtatgttgactagcctttctgaacagaaacaaaacgttactgttctagtttctattttaaacagtttttgaattcaagagcccagcaaagaggagatattgtttcttagacctcattccaaattctcaaaaaggagaaagaactaggcaggtgcctacctatcatctaattagttataccaagaaaacagggttagggtgcaggtggctcacgcctgtaattccagcactttgggaggccgaggtggtcgaatcgtttaaactcaggagttccagactagcctggtcaatttggcaaaacctcacctctatattaaaattaagaaaaaagattttaaaaaagaaaatagggttatcaagtttaaatattggggccaattcttagagagaagacatgtggcctaactaagcatgtgttagtatgttgggaggcagtacttatgaacaccagtcacattgcccttttgagtgtatggctgaaggactgtttaaagaaaaattattaaagcatgctagtttttaatttttccaaagaattataatcctgagaagaaaatcttcagagttttatatttcacatatgtataatttatctgtaaagcatgtagtgtgtttttgtttttaatattagtaagtttttaaaagataatttatatattttgtagggtgatctacaaattattggcttctaaaagtgaaagtatttgggttcaagctttgaaggttctgggatactttctgaagcatttaggtcacaagtaagttgatatttgtcataatgcattctagaaataactattgagattatgtttttatgagttttctatgtaatgtagcatgaaatttgacttgaaaaatctaacagcggaaaataatagctttctgtggtagaaattgtaaaaatgttttataaaatatattttattaatagtagattgtgaaacaaaattacaatttaagtaattagtttatttctatattcttcctgaaaagaaagcattatctattctgaagatgtaataaaatattttgtcaagataaaatgatgcacatataggtatgatttcaaggaaagctttcttgacaaggaaatactgtgtatatgctgaggtctttctcagagttgatcttatgcttacatgctgagtcagtatttgttattagtttctaacagtagggcttattgattaattttgtgacttaaagatgctagaatacctcatttctttccccaaatcaagaatttgaatactttctaagaacactttttgtgtaagaaactgctgctggcttaatgattgcaattcatgctacactatccagtgtaggaatgttttaagagtatattttccttacaaatgaagccaaggaagtagtgcaactataatttaaatgttactagatgaggttcctatcagaacctcattttcgcccttgtttttttttttttttggtgcttacttaaatttgcaaagcgcttatttgtaataatcatgaaaactgcacaaaattcagacaagacatgtctaacaagctgtatagcctagaagtttaaatatttttaaaatttcggtaccaaagaataattaagtaagggagactagatatactatggatatggatataaggaatagttcaaacaaagccaggattgtagaaaaggatatatatgtgtgtgtatacacacacacacacacacacacggatatatatacacacatatatggatatatatatacatacacatatatatggatatatatatacatacacatatatggatatatatacacatacatatatatggatatacatacacacacatatatggatatacacacacatatatgtggatatatatacacatgtatggatatatatacacacatatatgtatggatatatatacacatatgtatggatatatacacacatatgtatggatatatatacacacatatatggatatatacacacatatatggatatatatacacacacatatggatatatatatatatggtatatggaactgtaagtacacttggtgacagagtgctgggagtgaagaagcatatgccctttttatattaagagataaagatcacttctttaacttcagttaattaaaataaactgactggagaaagttaaaggattgtagcccaagatgcagcctcctaaaaatgtcaagaaagcacattaaaaaatttacgaaaagatgaaaactcagttaatacaaaattaaaaataacaagcaggcagtttcctgtataaagatgctgtttgagatagcctattttccccctttttcctgtaaaatgtataaatgatacaacaagaagtaaaaaatgtactctctatcacaaatgttatcacaagtagaagatagatgcaaaatatgaactccagaatacgggtatcagctgcttaaagttgctcaggttgggtaaaagctgttaaggctaaagagaagataaaatgcaaagagaatggtgagagagttcacttatagcaaataggaagtgtcagtgaaagtagagtttctgaagatgagaggcacaccttaaattacaaaaatagatcatttgtttgaaataatagatatacatatatcatgcctgatagcagagttttatttgaatcagattggtttcagaaaaggagaagatatatcacaaagaattacacagatgagctgtatttgtggcaagcagtctatctctgtggctatagagaaaggaaagtttgtggattgtgaaagcaaaaggttacccttgtcccttcttttacacatatgcatggaagtgtcctgcagacagatggtccacgtaaattagactgcatcaaaagaattggcacatcatcagtgcaggtgaatcagataaaaaacatggaaaaaataagttaaagtaaccagtacatgaatagcacttagcagaaaaatattgctatggaatacatagcattttgatttaaaaatttcataagttaaaaataaacaaatgcatacatacatacatacatacatacatacatacatagcttctgagaaagaaccactaaacagaatttggagaagtaatccagctactccggaggcttacgcaggaggattgcttgagcccaggagtttgagtccagcctgggcaatgtagcaagatccatatctggaaaaaaaaaatgttgtaagaaatgttaacatagtgatatggtttggttgtgtccccccacctaaaatctcatcttgacttgtaatcctcacctgtaaagggtgggaccaggtagacataattggatcatgggggcagttcccccctgctgttcttgtaatagtgagtcgcatgagatctgatggttttgtaagcatttggcatttcccctgctttccctcactccatcttcctgccctgtgaagaaggtgcctacttctccttgccttccaccatgattgtaagtttcctgaggcctccccagcaatgcagaactgtgagtcaattaaacctctttcctttataaattagccaatcttgggtatttcttcatagcagcatgagaatggactaacacagatagcatggaagtatttaattatgagttaataaaatattggacaaatactggaagaaaataactatacacaaaaaaataaaattggaaattgctcaaaggcaaaactctggctagtagcatagtgaaatacacagaagataaaactgaaaaaaaagcaaatattatgaatagatgaaaatatgagtttaggattagaaagaaaatgagcgacatgggagaaaaacaaattaccataatggcataaattggccaggtgtgctggctcatgcctgtaatcccagcactttgggaggccgaggtgggcagatcaacgaggtcagcagtttgagaccagcctggccaacatggtgaaacaccatctctactaaaaatacaaaaattagccgggcatggtggcaggtgcctgtcatcccagctactcgggaggctgaggcaggagaattgcttcaacccgggaggtggaggttgcaatgagctgagaccgtgccattgcattccagagcctgggaagcagagggagactccatctcaaaaaaaaaaaaaaaagccaaaataataataatggcataaatggagttcccaaataagaaaagcagaataatggaacaaaacgaatatttaaatctataattcagtgaagtctagatgtaagattttgccatttttatttagaggacatattgtttgccagggaaaactgacctagaatggttagcatcaaagtgcattactggacttaaatagaagaatactttgtataatagtgcacaaataaggagaaaaatgagtctggctttagactctaaaataaccttcaatacaaaaaactataacaatcataattaaatgaagaaagtgggagccaaactatcctttaagtaaaaaggatgctgtcaaatattttttagccatacagcaaattatttctgtgactaaatcttgaggaaattgtggggaataaagtccaaccaactaggaatgactggagaaactattgctaaggaccgctggtgagcactgaataaatttaaccataaaactaagactaaaataaatgttcatattactgtgacagaccagaatttactttttatatatgctaataatgtacaaatgacacaaccgtaatgaattgggaggggactgagaaaagaaggaaagtagagcaagtgcaaagagtcagaatttccatgtaagtggacagatgaaatattacaaatataggcctattgactaaaatttgatgatgtagatgaaaggaaaaaattaagagtaaatatgctgacatttacatttctcatagtagggaaataccctttttaaacagatggaggattacttattctttcacagttaaaaagataagcagttctataaaattataaagctttcaaaatatttaagatctgtatggataaaactaagaacaatgtatgtaatggaactttgaaaaatccgtaaagatcagtaagcataacataaaatatgaaatatctaagaccagtcttactgtcattaaaaaaaaatgtaaaagcttttataaatcagctgttgtaagaaaaatatcacaattgatcacagtaatgaaacccagttctgtatgcaagaaacatacccaaaaaccaaagtggttttgaaaggttgaaagtaaaaggatgagtaaagttttattatataagtacaaagaaagcagaaaggggtggggggaggggggagggatggcattgggagatacacctaatgcgagatgatgagttagtgggtgcagcgcaccagcatggcacatgtatacctacgtaactaacctgcacattgtgcacatgtaccctaaaacttaaagtataataataaaaaaaaaaagcagaaagtaggaaccatgatcttagtattggacaaattagaatacaagccaaaaagcaataaccattagataaagaagaattctttataatgataaaatagaaacattcataaactagaaattacaggagaaacagacagtcacttaaagtttaagacttcagaacgaactttaattcacctatttcagtccacaaaaagccaagaagatctgaaatgggataaatctttttgaccttaaacttgtgggtcggtgtgtaggaagattggagtgctatcatgctggctccaggggctcatggtgcaggacttatagcttgctaagttttatactacaagtcagtaagtttaaagggtgctctgcctgacactacctgcagggatctcatcatttaaaattcacagccatgagatttgaccttgactctgtgggtagtgaaaaatagcaactcatctaaaggggcctactagccagaggcaggatgagagaatcatcaaactgtgtacccagtgaagtaaaactatggtggaggctgttgtggaacatctgaatttcatttatacaaagagattttgagattcaaatagagcaccaatgataatattctgctcttttagctgatgattttttaacccttcaccctacttaatggaagatctgaaagcatggatgaaaaatagagagtgagagaaaagataaagccttagaaaataagagacttcacatgtggctattaagagttcaaaaccaaacaccacatgttctcactcataggtaggaattgaacaatgtgtgtgatgtttctccttaaacatggggggaggggggagggatagcattaggagatatacctaatgttaaatgatgagttaatgggtgcagcacaccaacatggcatatgtatacatatgtaacaaacctgcatgttgtgtacatgtaccctaaaacttaaagtataataaaagaaagagttcttagaaaagtgatgagtgtaaaaactagatatcctgaaacactttgatctactaaaaacttagaaatgttagataaaaatatgtcaaaaatcctattaaatatataggtgtgcacacaaaagtaagggaaattctcacattccagaaatgaaaatcaagcatactaaaagaaacaagactttaaaaacaaggtaatttaaaaataaaccatgtaattaaaaaaaccctaagtaacttgtgaaaatgtaaaggtagtaattacaatgaacacctatatggaaacattaaacagattagacaaagcttcacaaagaattggtgaactgagggatagaactgaagaaattacctagaaatcaacaccaataagcaagattacaaccatgacattaagagagggggaaaaaaggaaaggtttcaaatatggctaataagagttatagaaaaggggaagagagaatgaggaagaggcaatattcaaagtaaattactaaagttttacaaaattgatgaaagacctgatttctcagattttggaagtaaaatgaattctaatcagggaaaattagtatgaaatcttaccacaaagtgaaactccagaacccaacaaggacaaggagaacaacaaagggaagttagccatataatattaaaagaaatataatattttagtaaagaaaacaatatagtacatatttgtgaataaacagcaaagtgcagtccatagattgacccaaatacttagtgattttagtgctaataaaggtgccatctctgatgaatagagtgatgatttacttttaaaaaatgctgtctgttaaaggaatggaacaaatgatatatttttatttgcatttaaaaagttaataggcagttataacaaatgtaccactctggtgagggatgttgacagtggggaaagctgtgtatatgtaggggtagggacatatgggactccctacattctgctcaattttactgagaacctaaaactgctctaaaaataaagtgcatttaaaagagaagggtaaagtggtagggaaatgagaaattataaagtgttcacttgtatgggggagctgtgagtgatgtggaaatgtaaaggatgagttgggtgtaaaatctctatgtatttttttatgtcatatatttttaactaggtaagtgtattacttattctaaaaattaaatgataaaagctgttattgcattatttaaatatataaaaataaactttaaggcaaaaaatttaatgaggatgaagggggccaccatgttatgaaaaaggtgtaattcactaggaatgtaaaagtttcaaatgcgtatacacttagtgtaggtgagtcgtagaaatctattattgactaaatttggaagagtattttacaaattttaacatatttttttccttagaagatcaattacaaaaaatctcaaaagtataatttgaaaaaaaaaatccattggcttgagtgtcatacacgttcttttcaaacacacaaaactatagaaattatttaaatgagaccataaagtaggctcaagaaatttaaacaaattgtcatacagatgactttctctgcaaacagtgcaattaaacaagaaatcaatgacaaaaattaaacttagaaaatagaaatatatatatcttctaaataactataacaagaagttattcattatacaaattataaaatgcagtaaaaatatttaaaattatgtatatttacacttgtgagatttggtctaaatgatactagagaaaattcatagttgtgaatatttatattaaaagcagaaaggtacttaggttttcatttttctaggttctcggttatgcttacctcattaattgtcagcctaagaaggcaaaagaaatagtaaagggcagaagtgaatgaaacagaaagcaagactattaaacagagtaacggcaaggccaaaaagccgtattattcacttataaaatacttttccatgactagctaaagaaggaatcggccactatttcacctaatataattcatacaaccatgataccaaaattggatatggattatccaattataagggaaatttatggtcaatctcccctatgaacatgagtctatcagttacttttttaaaagtatacagcataaccaaattgagggtagtcatagaatgtaaaggtggtttaacatcaggacaacatttcatctatttattaacaaaggagaatagctatataattatgatgtgtgcaaaaaattttcataaaattcagtatcatttgtcataaaaatttttagcaaaccacaaatagaaaataatttattcaatctggtaacatatgtctactgaaaactttccacagtcctatttagtaatgaaatgttagaagcatcccctttgaaaaactaacaattaacaaaagcctgctttcaccacccctgtttgacatcctattgggtaatattttggcatttatgaaacactccacttaaagctagcaaaattgttttcaagtgcatatgcagcattctccaaaaggtattatgagttggggtgtaaaatataaaacaagtctcagtaaatttaaaaactaataaatcaaacagagtgtattatctgaccacacagaattaaatttgaatgaaagaggtttgagaaattgcaaggtatttggaagtaaagaacgtaactaatccctgagtcaaaaaagaaatcataaagaacattagacgttagttagaactgaacgaaaacaaaaccacagcatagactacttactgaatgcttatgcattgctgatggaatgtagaatcctgcagccatgttccaaaaggatttcctaatttcttaaaaagtattaccatacttaggaatgtatccaaaagaagtgatagcatgttcatagccagacttcgcatgaatgttcttagtactattattactattattattattttgagatggagtctcactctattacccaggctggagtatagtggcacgatctccgctcactgaaacctctgcttcccatgttcaagcgattcttctgcctaagcctcccacgtagccaggactacaggtgcgtgccaccatgcccagctaatttttttgtatatttagtggagatggggtttcactatgttggtcaggctggtctcaaactcctgacctcagatgatctgcccaccccagcctcccaaagtgctgggattacaggcgtgagccactgtgcccagccagtactattattaatagtagctccaaactagaaacaatccaaaagtcaatcagctgatgaatggacaaacaaaatgttttatgtctatacaatggaatactattgtgcaattaaaagggaacaaactactgatgcatgctatgacataatgagtcctaaaactattatgctaagtgaaagaagccagatgcaaaaactatatactatatgcttctgtttatatgaaatgtccagaatgcaaataagtggttaaatggggctagcaatgggagtgggaattaactgccagtgggcacagggaactgttgaggatgataaaaatgacctataactatattgtaatgatagtggcatgactctatataatttttaaatgaattgttcatttgcaaaatgtgtgaattttgtggtatgtgtattatagttcagtaaagctagtaaaaatgtgaaaaacaaaatttaaaactctttggaagtgcaggataatagtattatcaccttggattaaggaaggatttctaaaacaataaatacacataaatcatacagcaaaaagataaatttgaccattagaataaaaagtactttaaaagataccataaaaagtgaaaagacaaggcacaaagtgaaagaagatatttgcagtttatctaggatacagtggatttgtatcctaaacatacgaaaaaaattgtgcaaataaattagaaaaagaaaatctgttaggatcatgaagaatataaacagacaattcactgaagaggaaacttgagttagcagtaaacatatgggtgatatactcaacttcagtagtaatcaagaaaatgcaaataaaacatgcatttaatgcttatcaggatggtaaattttaaaactgttgacagtatcaagtgttgacaaaggatgtacatcagtggtaactctccagtcactggtggaattatatactggtacaatcacattgaagaacaatttacaatttttgaaaaagataaatatacttatactctatgactaaggaactctctccttgacatagagaaagtctcatgtgtgtgaacagtgttcaatataacattgctaatattaaaagttggaaacaacatagaataggagaacagataaataaactaaggtatattcatacagttggatatattcagaactgaaaatgaatgaagtaaagttaccttgcacaaatcaaatataaagcagtaaagcaagttgcagaaggatacataataatgatgcaatttatttcaatttcaaaaatacgtgaagacaaaattgtaaattgcgtatgaatagatattcatctaattaaaagtataaagacgtacatgggaataaaaaacaaaatttatgattattggttatcccgaagtagagtgtgaagaatgggatgatggacaggtatccagaaatacttactaagttggttggtggttacatgaatatttattatgtttaaaaaaaaaactgagtaaagaaacgtatagcaaacaaaagtaaagcagaaatttattatcactgtaaaaatcagatgggatttgaaagcccaaaacacaatgagttgaacctgaggttaaaagttcaaaagagaatgtggaaggacattctgtattttgaaaggaataatttaagtagatggtgttaagttcataaacctgaaaacatcaaatagcgatgtcaaaaatataaagcaaaattcatttgagatgcaaaagaacttgataaaatagaataatggtagagatgacatatctctctcagaatgggaccaattgataatacatacagatatagagaaattgagtaatagattcataaaacttggctcaacagatatatgttcaatcttacatattttgaggatatacttcatggctaaagaagatatacaaaaaaaaaaggcgggtcatgtcctgggccatcaaatgaacaaagcagacagagtagacattttattggacactgcctcctgaccataatgtgataaaattggaaataaaaaaagaaattatgcaaaaatatcttacctacttagaaattaagaagcagtgtgaagatatcctttagagaatagaagaaaataaaagaaaaattagaaattatctaaaattttctgtacttcatagcaaaaactcttatcagaaataaatacctccattactgaaaaataaagattaaagttagaagaactttgtacttatattacaacattaattaaagtacaataaagtaaagtaggaagtacaaattagtaagggtggaggctaacatgaagaaacgagaaaaataaaaacgaactgttgaaaggatcactaactacaaagctgatgtttttaaggaaccaacaaaatgaatcaaactttcccatacctcattgagataaaatagaagcttttgaataaggaaagccttttcaaattataggacagattataataattataagaaaaatatagtacattataatgacatataagaggtccacttctaattcttggtaatatcattttctatatattttatgtgttcattcattcggtttttcccacatatacatagtacttttccatcaattaaaaaatgggaagggtaatatccagtcattaataaataaaataaaactacaggagcacaaaacatgccctgttttgcttcactagtaatcaccaacaaacctatcgtatgctcccttaatgcagaactgtgttttgatatagtttccgtgtaaacattggtgcatatagcattgagttcctataccttatcctccattctagcctcaaaataaaatgctggggagatgtaggttaaaatctgaaataatattacaactgtcctgatagattgaagaagatcagaaagtataataatatctactagttgagtaactactgcttcttactacagaataatatatacaatgatagccaaaggaaattggaaatgtaaatacaattataaattgcttcctgaaaaccattaaaaattaaaaatacagtaaatggagagctatgctgtgtacattaatgggaagactcaattatataaagataaaattgtaataaatcaatttgtaaacatgtcattctggtaaaaaatataatttttatttaaaggttaaaaaaactcttcaaaagctaactcagatgaacaaataagtaaaaatgtcaatagaagtttgaagaataagaataatgagtatttattgtaataagtctagtggactttatatcaaggaataaacttaaagaaggggtgtagaatagaaagcacagaaacacatcctgatatacgtgtatatctatatatatatatgtatgcttagatactagaaacataattaaaatatgaattattcaataattggcagtgggaaattatttaacttctggattgaaggtggagaagaagccttcaaaccatatcaccacacccagccccctcccccctcaaaaaaaagaaaaccaaaaccacaaacattttacaaagaataaacatttggaattgtggacttccagatcaagttgataaagagagatgaaagaatatcccttgtcccaacctaatgaaataaacattatatagtaaagtagagactctccccctccaaaacaacaaattcaaatgtaaccagacaaggaaagcagcatcacataaagcaatgcatgcaaaatattgacagcgaaaaaaaagaacccagagattctggagtgacttcgtaagtatccttccctcatttctatccctacaaagccaacggaattcctagatttctcccttaataatccccacattagagtgataggaattgattagatatacctggtttttcttctttaggacttttggtgagtgaaaatagttcttttttgaaacaaggagaatgaactgagattgatgttctgtgatgaaaatgggattccaagtttttgtattaacttatcacactgagggatcaagtcaaggcctgaaacaatttccttttggaaatgagatatagtcccttaagtaatgtatggaaaaagcacaccatcttctaggaaaatttgacagagaatgataacactaagatatatagtatttaaataaaagtttagtgattaaaaaagagagttcctaaaaagaaaatggaaaacctaggcaaaaaagaagtactttcaaatggttaaacatttggctggcctcagacttctcccagttgaattcagtgccaaaagaaataatgcagtgtctgcaagttctgaaagaaggtgtgacccgagaatattatatcctgccagattgttaagtatgtagacatcaggtcagaattcagaagacagacttcttcatctcctcttgaatggcatccccagtcaattgagagctgagtcaaaagaaaaaccacaaatggtaaagacaaggtcaaggaagtgaattcatttgaagtagacgaagacccaacaattcatacataacagcagtgttacaatgaaaataatttaagtgttttaaaccttgatgttcaaatagcaatatagctcacaaaaactagatgacataaagtgtgaggatggtaattatctgtctttaatataaaagagtaaattgatactttctaaaattgaaatgtttagttaattatgtaacactttgttgttttattcataattattttttaagcctcatagagatttttaattagaaaaaagccctttggccgggcacggtggctcatgcctgcaatcccagcactttgggaggctgagatgggtggatcccttggtcaggagatcgagaccatcctggctaacacggtgaaaccccgtctctactaaaaatacaaacaattagctgggtgtggtggcgggtgcctgtagtcccagctactggggagactgaggcaggagaatggcccgaatgcaggaggcggagcttgcagtaagccaagatcacgccactgcactccagcctgggcgactgagcaacacacagtctccaaaaaaaaaaaaagcccttcatgtggtaaagaaagtcatctgaagttttaaaaatttttttattgtttcatgcccttttctttattttctgttaaatgtgagtaaaattacatttgatgctttttatttaaaataaaatttagtatgagtttcttctatccttctttattccctctttcttcccttctcctttattaccttctcttactctccataaaaagatatctaatgtttattgttatttattgtgttacttttgggtagtagaattttaagtcttgtactttctgtttccctacagtttatgaatttctatgttgtatatgatttaacacaaccaattaaataattatgaaaaatgagttaaaataaaaatcattttaaaatgctatagtagaaagaatgagtattaagtataaatgaagaaatgacaggatgaaaacttgatagattttattcaagaaaattaaaaaaaacctttgatgccacaaaatcccttgaaattcagaaagtggaaaatatttgtaaatgagttgacaaaggaataattttcctgatattattaggaatctcataattagtagaaaaaagatgaacacacagaaggaaaaaatgggtcacaggacagtatcaggaagttcttggaagtagtataaatggttagaaagtttcaattgatcagcaattcttgtcaatgaaaataagatctactttttacataccaaattgactatttttctgattattataatacatagggttggtaaaatgcatttataccttaatagtagaaatataaatgtacatatttttggaggtcagttcagcaaagtctcataaaaattaaaatataaaagcttttaacccaatcatttcagtttttatcctaaggaaataaccatggttatgcccaaaaatgtgtctaaaggaaaagtttatttatggtagaaaaaaattggaaattacataaatggctaacattagttaatggataaaacaattatgctactttttttttttttttttcgagatggagttttgctctgtcgcccagcttggagtgcaatgatgcaatctccacccactgcaacctacacctcccatgttcaagtgattctcctgccttggcctccagagtagctgggattacaggcgcctgtcaccatgcccggctaatttttgtgtttctggtagagacaggatttcaccatgttggccaggctggtcttgaactcctgacctcaagtgatcctcccacctcagcctcccaaagtgctagaattacaggtgtgagccactgcgctcggccaattatgctccatttttcttatcagttatattttatgacactgaaaaatacacaatatattgttgacttaaacaaactataaattaccttatatagaacaatttccattgtattcctctcatcctgtcatttatatctgtgtgtcatatatggatttatatgcatagtaattaatctgtatataaaatgatatttataatgattatgtctgggttgaagaattatggggtttcttttctttctttattgttttctttactgttttcatatatactctgaatttgttacaagaaatatctttttttttttttttttttttgagacagagcctaactctgttgcccaggctggagtgcagtgatgcaatctcagctcactgcaacctccgcctcccatgctcaattgactctcccacctcagcctcccaagtagctgggactataggtgcatgccaccacacctagctaatttttgtatttttagtgtagatggggtttcaccatgttggccatgctggtcttgaactcctgacctcaagtgatccgcctgcctcggcctcccaaagtgttgggattacaggcatgagccaccacacccagcaataagaagtatctttggccatcccacaaaaagattgttttgtgaagaaagaaatttaaatacatttcagtggaatgtatagtaagctaatacatctataatgtgcatgattacaagattctgtaaaaaaaaatagattacactgtcgatccatgtgggcagaaatcctgtcaaactcaagatataaagcaaatcagcactaaaaactgaggtctctagatcttaaaggtaattatgatgttagtttttccagtaaatgtcccactgaagcctttcctgaactaaacccacagagctaggtctttcattagaagtcctataaggaacaaaatcatgtgatgtacagggccagtgcaccatttcctgcctaagatgatggatggcgttttttttttttttttttttttttttttatctcttgactgctgtgcaacaaaatgtactggtaagtattgttttaaagaaaactacaggaggaagttgactcatctctactgtggtgtatgcacagcatcttcaagtttcccccgaacctagaattaagcatctgtataaacgtttgcattggaggagataatcaagagggcatggatttcttcggtagctgaagtagtagtggcacagttaagagaatattctaaatttcagatagcctacttaattaattagttcacttttttgagaccaggtctcactctgttgctcaggctagagtgcagtggcacaagctcactgcagccttgatctccaggaatcaagtcattctccccttcttgagtaactggggactataggagcctgccactatgcccagctaatttttttttttttttaagtagagatgaagtcttgctgtgttgcccaggcttatctcaaactcatgagttcaaatgagcctcctgccttggcctcccaaactgctgggattacaggcatgaggcactgagctggcctttagatagactaatttagacatatgtttaccagctccttgtagcagagatctatttcaaggccaatgctttgtcatttgttctttcctgattgggagcaaaggaacacttaaggcctccttttcttgggcgaggcttgagttggaagagatttaaaccttcccttccatagtcccataatactcattagccctgtattttttttaaatagccatttgacctttttcagtcatatttaagtgttttgcaaacacagctgcagaacagatgccctagcttccttttgagtttaggtcattttgctttttccttccctggactgaggcagatagggtgagggtatcaacaatcctgtgtcttttgttatggagtgtggctcttggaggctaatgttagaagagaccttttgcagatgaatggtacggacataaatggttcatttgatttctgtattaattatggtaacagtagctgccataactgataaataatgaaattctagtcacttaccaggctagtagtttatttcatgttcacttaaaatccaaataggttttcccaagcagttgattatcttacagtgatttagagacccaggcagcttctcccaccttgtagctccattgtcttccttctgtggattctgtgttgctggcttggggaaagagcatggaaaatgtgcatgagtgcttttcctgtgggtcaggactaaaaataatctacaacttttctcttcacattttattggctagaactcagttaaatagtcacacttagctataagagaggctggaaatgtaatacagatgtggaccaaggaagaaaggaaccagagtttagtgattactttgtcaggctgtgtcacagttgccaatccagagaacaatagaaaattgaagaaatgaaatactgagaattgggagagaagatgatccagattttgaattctttttttgtttttttgtttttttcttgagatggagtctcactcttgcccaggctggagtgcagtggctcgatctcggctcactgcaacctccacctcccaggtttaagcgattcttctgcctcagcctcctgagtagctgggactacaggcatgtgccaccacgcccagctaatttttgtatttttagtagagatggggtttcaccacattggccaggcttgtctcgaacttctgacctcgtgatccacccacctcagcctctgaaagtgctgggattacaggcgtgaaccactgttcccggcccagatcttgaattctaaggaagtgacacaaatgagaggcctgtagtaattcttgagctagagctaagagttccaggaggcctttaatggaaccttctatcctgagtatgggtgtgggagggacacaattaaatcaggcaacattaagtagaaagatattttttaaatccattggtagaccacaaatacaagcaatgatgaactctctttaattatgcagaattattttgttttatgacaccaaaattaagctagagtatttatttttaaccatagttttagttcttgatattaaggtttgttacagcctatgttataaactttgaatttgtacaggcatgatttaaaaattatgtggtctgtatgttaggggataccaataattttaacccaataaaataacttcaaaatagttatttgaaatttgaaaataataacaatgacatgtatgtaatattccataatttgtacatttcacattttagttcacacagatattttatttgaaaagtttttaactaatagtcttggaactttaggatacagttgtgttacaaactgttgtttctatagatggaagttcatgaaaataattacttgtattattctgtatctgcttataaattgttctctcttatctaaaagtcatgtgatcggagaatccaatgtgtttcatggtgttttatttttcctccttctctccaggagaaaagttgaaattatgcacacccatagtcttttcactcttcttggagaaaggctgatgttgcatacaaacactgtgactgtcaccacatacaacacactttatgaggtaaaaataaaaaatgtgtgatgaaagttttaagtgtatacagtggaaaccctcttaatctatgcaattgagatgagtagttggtctgttaatctaaaagctaattaaaccagaaaatggtttaatggtaaaaaatgaatatataccttatatttttattttattttaaaacatatccatgtacaatttttgccaatttctttatgtcgatccaagagcttttcttcttgtatgggttggctgactggcttcacacaaagtctttctcacataaactacatccgttatgtagtattagttctgcttccccatccccacccctctgtttttatcctctcgttcctactctctctctttctgcttctattagctatccactgccagtattaagctggagttgctactgggataaatttcggtaagaattatttgtaaaaatgatatctggaagcatctttggatctcatcatttcaatttagaggttccttttttatcacttccaacaaatgggacagttttgggttcagtattttctaggaaataggtatactacctcacagggtggctactttcatttttaaatgctagtaaaatgttagtaatgtccccttacattaaccttaactctgctttcctataactgatcttcagtggtcccagttctttttctctagcacaagagctaactgccagcatccatttttgtatggctctaagttaaggaagctttttatatttctaaatggttgaaaataatcaaaaaaagaataatatatgagttgtaaaatgtataggattttcaaatttcagcgaacacagtcacactcatttgtttagctgttgcgtgtagctgcttttgtgccacgaccgcagagttaaagagttgtaacaagaatatttgttatgctctcctcaccttgcactgttgcttggcaaactagaaattacggtgatgtaatacctcaacagtgtttcatgtaccacttgtattgccaaacctaagttttctgcttttaaataccagtgcatacccatcatgtcaaaacaagaaaagaaaagtggatttttaatctcacactttgaaatacagcagagtgtagattattttgttatagatttagatggcaaggccttgcgtctgttatacaagggcattatagtcatgctaagagaagacttacaggtactactaaatatccataatattattcctaactcagaagagcagtggtcagaaaacattaaacagaatatctcatcattgtagatttctttataaaaatgttttaaaaataaaaatgagagacattgagaaagggagatgctaagcttctgaatggaattgtactataattttgaattaacctgtaatctcagctacttgcggggctgaggcaggaggactgcttgatcccaggaggtctgctagatcccaggaggtcaaggctgcactgagctgagatcgcgccactgcactccagcctgagtgacaaagtgagaccctgtccccttcaaaaaaaaaaacaaaaaaaaaaacaaaaacaaatttacacttctctaatactgtttcttttcatgtaagccatggaacagatcaagtcaattgcagattttgcacagtcctcaaacaggataggttttacatttttaaatgatgggggaaaaagtgtattttgggatgtgttcaattatatgaaattcaaatttcggtctctgcaaataaaagtttttgtttctttgggttcttttaaggaaaagtacagagagttattgcaaagagaaaagtacacactcaggaaaggggagtgtgggtatacttaagagagagttgcatgcaagggtttttggggctgctacctttatgaatttcttctaaccaagggatggatggaatattcataaagattacagtaaaagggtagatatttcccagaactgtgatgctatctagttttactccaaatatgggtgttcctggaaccattatggtgctggtgagtgtgtgatttagtatgtcagtgagtgtataatgaggtcctaggtgaacctccatcaaatccagtgccatactgggtgcagttagccttagctatcttggctctcatcctggcttttcagggtcttgtcaacccctagtttctgaagctatttcaacagtttccttttgctagtcatgcgaaactgctgcctggagttttttgttctcctgcaaccacccttattattcctgtttcatttccccttccccttcagagatgtccatctcttattcttatgggctgatgagggagaaggtcggtcttctttatctacttcctgctgattagagatgttggccctgcctggcaagggtatggaaatctttggctgcctggcctgagggttctaagggtgagtcatcaggagactctgaatccaaagcagggattggaatcattgcatgaccatcattttgacatggaactgttgtaatgtaaaagacacaaaatttacaaggaggttaaacaagtaaggacaaagattcatagtaataagagagctattaaaggtcgaaggaaggaggaaccatgtcacagttggtaggtatcctttgatggagtcccagatggtttgagcagtgggattatattgaaattatgtagccaggtagcctgttagtaaatcttttgaactttcagttcaactaatcctgaattgttaatataagaacaacaggtgtggtttattactgtgcaaacccctctttgttcagccagaacataaagcctcttgttgtttccttgaccattcaagtagttcatgctttggcacggttagagcttcatacagtagcttagcaatgagcctaaatcatgggatcaaaatcttgcaaattcctgtcatacccaggaaagttttgagttgcttcttcggttgtagaggcctgacctttaagatagcttccttttgttcgatggacatggtgtagtttcttgggcttaggatgtaccccagatattttacttccagtttagaagtctgggccctgggtggagagactggataccctttctcccaggaagtttagaacttgaataacattcttatctgaggcctctttagtgggtctgcatacaaggatgtcatccacatattggcgtgtggcttccctttctggctctagttcccttaattctcttgccaaggcatttctgaacaagtgatggctatccctaaagcccggaggcagtacagcccaggtatactgccaggaaatactattttcaggattagttcgctcaaaagcaaacaaatagtgacagtcaaggcataaagggatacaaaagaaagcatctttaagatctaatatcattaaccaattggtgtcttctgatatttgggtaaatgtggtagaaggatttggcactttaggatgtaagggaattacagcctcattaatggttcataagccttgaactagacaatattcttcattttgtttttggacagggaggacaggactattacaaagagactgacatggaactgggaggccatgttttaaaaacttcttaattacaggttagagtcctcacctggcttcttgtttgaggagatattgatgcttatgtgggaaattatttttgtcttttaaagagatgatcactagctgaccatgtattactttcccaggagtttcttggtctcatacttgtggttccatttccagatcttactttggaaggaatcttctgtttgtctgatactggtatcgaaaaaacaagcattgccaatacttgaaagaaatgtttcccagggcctgataaacataaagtgactccaactgtggccaggaaatcccattccaataaagaaatgggacatagagttttgtagcctgcagctcaggggtaaggtaaagcgttttgattttggagtgtcatcaacatccatgacaatgcagttattggaagataaggtccaagagtggcctttaggacagagtaacttgcccctgtatcaattaaggaattaatattatttcctgccatgtcgagttacccaaagctccttagttgtgaggaccatgcttttgtgggagccgccaggaacgttgggtcccttcagtcctcagttataaccattatggcctcaagtttccttctctccctttggagctgagggcattcccttttccagtggccctcctgcttgtagtgaggacagggtctggttgggctcccttggctgggacaggtattgcgcctgtgtcacagctccccacacttgaagcagcaaccattacctttaagttttctggtaggtctgcttggtccatgggtgaagcatccctctgggtgactctgaggttgcaggatgctgcttatagtgactgctatcatttgggcctgctgctgtctcattgtttgccatgctaggtcctttcagcatattcagccctatctctattattgaataccacaaaagccacatcaagcatttgattaataggcatttgggatcccaaagccaatttctgtggttttcttctgatgtcaggtgctgactggctgataaagtgtgtcccgagtaaagtttggcaagcatcagtatgggggtcaatgttagtatattttcttagggcctccacaaggcatctctggaacaaagctgggttttcatcctttctttatttcccttattttatcatagtccacaggcttggtgttacattttttcattcccttcactaaacaagtcaccatatgatttctttttcttagatcaacttggccctgttgatagttccagttagggtcattgttaggcacagatgtggccctcataccatattcttcagagtccccagatgacagattgttagcataagcctgggcctctgcccaaatatgctgcttttcttcaggggtgcaacacatggacaagatgttatgaatatctccccaagttaactcaaatgagagtgagaaagcccagaattccttcatgaatttagttgaaaatcaaaggtacatgcacctgatgaatgatcccagcatccccattggctacctccctaagtggacataacttagaatggtcccttaggagggtaggaaacaccactgcaggtgaccccagcagggctcagttcccttggtagggaaggttatataggatgttaaggaggcggactagtaggagtctgggtgctggagacagtggaactaggagaagactgaggacttaaaggtggagctgggtaagagggagaagctgtgggtgccagactgtgtctgggtcaggaggtgagggaaggctctggattagttatttgatatttcctaattccaactaattagttgtttgatattttccaaaaggggatcatttaggatatctggttccccatttggttcccttaaaggaaagggtgtgagtataacagaggcaggaattcctacaaagctcagggttttgataaagagctatgaaggcctgtacatacaatatttgagtccatttcttctgatgttcacaaaaaacgatctaattacaagatggtattaaaatttagggtcctgttctttggctgttgcaccccattttctgaaagagagttacccttggctttgacttgttcttgggacaaccaactgccagtgattctaaaatgaggctgatgatgctccaggctggctcatcataaagataatactggtgggctgggcgaggtttccaaacactggtgggaccttgaccccagctggtgttcgggctcttgataataggagttcaaggatgagtcacaaaatagtgatagcatggagatttcttgcaaagagaaaagtacaaactcaagaaaggggagtgtgggtgtactcaagagaaagagttgcatgcaagggggtttaaggctgcttcctttatgcacaaataaagttttatagaacataactcattaagtaaagtccattggtcacttgacactacagagttgagtagttgtaatggagattatatgatccacaaatcttaaaatactatctgatcttatctataaaaagtttgttgaccactgctctacagcagcacagagaaatttaactcccctctgttgttctttttattacaagctgtattatagtcttctgtcagaattaatattcatcattgcaaaaacttggaaaatgtagaaaagcaccaaaataaaatttagcaaatactgattaatacttaagaatatatatatatatttctcaactcatacacatatgcacacagaacttttataaaatgttatcctaaatatagttttcttgtccagctttttgcacttataattacaaatatatttatcacaaaatatttatctatagctgggaaggcaaacttttctggtaaagggacagatagtaatatttcaggctttgtgggctatacagtatctgtcacaactactcaaatctgttgtagctcagaagcagccatagacagtatgaaccagacaggctgtgtaccagtaaaactgtattacagaaacaggtggcaggctagatttagcccacaggccatagttttctgacccctgctctataatattacttttaactacttaattttttctctattttatcagtaaatttaagagtggctgctctttagattagtgaggaaatctactgactgctctgaattgtttgtttgtttgtttctgagcttaatattccgactttgtgtcaatcattccacaaatcacaagattagtagactatgcctttctgaacaatgcctttttgaattatagtagtgttttaatattgtttcaatatttggcatgcagaactgaataagtactaacacaatggcttttccctatgcagagtataatgaggtcattttctttctttattctgatattgtatttccctcatcatagtaactgttttttattgggcacttcttatgacaaacatggtaaattctttatgtacattgtttcagatcttataactaccctatgataatggtattttttttgcttgtgaaaacagacaaactaagactcacaggttaaataatttgctgtatgtcatgccactaataaataatcataaaataggtaggttccatgatatatatacataatgcaaaaatgtcagaatctctcctcagttgacagcattaaaatcctcctctgaatcaaaacctgctacaatatcagattaggcttctgaaggctagtgcctaatattcatgaacacgtgtttatgttttgattttttggacctactaactggtttggtcaatgatgcctatgtaagtttttaatcattgttttacctatgtgaatttttgagcatctgcttattttgacctcttatccataatagagagtctgagtagtcagtgcaactttatattgagtgtagcataataacataatatgttgaatttgaaaaaccattgtgtagtactaacctttaaataagaaaatttcatatacatgtatacacacatatatgtatttctattagtcttcctgaaaagtgactcaacacaagtacagcagcgtttttacccaccacctatactcctgtgtatacctagtatccagattttggtctctggtgatattctacacaaaacaaagccaactaattgctggtcctgtgtcttagatgaggaaaactcaagataagtttgaattctctgatactggatgtgggatgaggcagagctcctgaaatgatgaaggaaccaacttacagacctctgaccaattttagtaataatacttgtttttaaaatagaataatgtttatggttactttaaataattttttcaaggactttgagtttataatgaatgcatattctaaaaagaaaagttaatgtaagtgtacaaaatgccaaaagagagagatgataaatgattggttatcattgttaatcctacaaaatagcagaaagagtcttcaacataagctttaatactatggccaaaccaaattttattatcagaatgacagggcagtggattactgtttctggatcaccagagtttaaacatcacatcttttgctgtgtcgcatctagttgcaaaaagattaacttgtgtgatgggtatcaatttaatttttgttaacatagtaaaggaaatttaactgaaaaaggaaatcgcttccagactctctgcttaggtttaattcatcttgttagcatcaaccaggttgtgtactcttagcaagaattagttgtttgataatccagagtttgaaatgtttttttaatcttcattttcttttttctgtttggggaaatcaccttaatctcagcaatgcatcagaataaatattactacaactctacgaatgtgtaagattaagtgcagaaataataaagaaccaacttatggtgttgataatgatattttagagtagagtagagtagagtagagtagagtagagtaggaggccaggcacagtgactcatgcatgtaatcccagcactttggaaggctgaggtgggtggatcacttgagatcaggagtttaagaccagcctatccaacatggtgaaacccagtctctactaaaaatacaaaagatttagccaagtgtggtgctgtgcacctgtaattccagttactcgggaagctgaagtagaatagcttgaacctgggaggcagaggttgcagcgaactgagattgttctactgcactccagcctggtcgacaaacaagacactggctctaaaaaaaaaaaaaaaagaaaagaaatttgttattttaataatttttttgaagtcttattaggataaagactatgttatagtgacctttgaaacttttaagtttgataagatgcttgtaatataataaacaataaatttgaagtcacaggccgggctcggtggctcacgcctataatcccagcactttgggaggccgaggtgggtggatcaactgaggttgggagttcgagaccagcctgaccaacatggagaaaccccatcactactaaatatacaaaattagccaggcgtggtggcgcatgcctgtaattacagctactcaggaggcagaggcaggagaatcgcttgaacccgggaggtggaggttgcggtgagccgagattatgccattgcactccagcctgagcaagaagagcaaaactctgtctcaaaaaaaaaaaaaaaaaattaaggcacaaaatcagatttttagcaggacatgtcagacaacattgtataagttgtgaagatgtaaaaatctatcttgattattttgaaaaccaaaaaaaattaataaattatttatgtctatagttttctgaggtgaatttattctgtaggatatatactaagaagtgagttaactttaatggacctctttttgaaattactcaaaactattttatatacatattatttaggaattgtaatatttatgaaacttatcttttaaattctatttgtatctttagttttgctttgttactccatctctaaattatgagtaattatgttttccttttgttaatgatttgtagtactctctaatacacttaagaattgtttgattgtagaatatgttttctgcaggcaaaacaagtagatttttatgtttaatacacttgtaaatctcagcaataatatctgtttcattacttcattgtgatattatttttgctttatgggttctctttgcatactcttcccttaatttagttaaacatgtagtggtgacacaaggagccaaatgtaagatcttataacctaaatgagagctttgttccttatagtaataactaaccaatttaaaggaaaacatatattttttaaattaactgtttctataaggatataacaatttatgagtgcaatcattttacgagttagtcaactttaagcacttaataatcaaagtttttctcaaaattatagaatttcagaggtggacagtatgttagataccatcttattcaaactttctattcacagaaaaagaaagtcacaaagttaggtagcttgtccaaacctgtaaagattctctgacccaaatacagtggcagttagatgcaacagcagggttaatagtttgccttttttttaaccaccccatctcaaaaagttgagcctactaatactacaaaatttatgcatgatgaagctggggagcaggtgcatcagaaagatagcttcagtagcccctgcttcagcctaaagttctgtaacacatgaattgcaaaataattccatttataaaatgaaatttcaatgtgtaatgctgggctcaggtgtatctctgtaaatagcatgtaaagttacctccatgcttatgattcattgttgtttccctccctgtcgattacctgtattatagccactggggacatgtggctgttgaacacttaaaatgtggctggtatgaattgagatgtgctctaagtgttaaatacacattggttttcatgtccatatccagctctgaacctctgtacaattttgttttagtgggggtttggggttactatgcatatctcttaccaatccagtcaaacctttggggcccatcttgagtcctgctctttcattagaatgtttgggtctacattcatctctttttatttatatttcattattccctttctccctttttaaacttacataggttctttttttttttttttttttgagacagagtctcactctgtcgcccaggctgcagtggcgtgatctcggctcactgcaagctccacctcccaagttcacgccattctcctgcctcagcctcctgagtagctgggactacaggtgcctgccaccacacccgggtaattttttgtattttttagtagagacagggtttcaccgtgttagccaggatggtctcgatctcctgaccttgtgatccacccacctcggcctcccaaagtgctgggattacaggtgtgagccaccatgcctggccacataggttcttaatgatagtctatcatgttttgttactttattggggcatgcatttatgcctgcctccagaacaataattaaataaattgctactagaaatgaagttgcacctagcaatgtattttcagtctgcaaacatttagcagagggagggcacataactggttattaataaatacatgttgaattgagtttctgagtatatgtttgtcattttaaaaacctttatatttgaatatgttatagttttcaaagcactttcacatatggagctttatttaatcttcctagcagttttattagataggcaaggcagttattcttttcattgttagatgataaagtagggacttaaaaagacaatataaaaactggtgacacttttgtttcctgtgcaatgtgatttcttctcttttggttgaaaacactttaactatcacgggagagtaggtcctgatttcctttaagctcgtctgaagttattttgaatcctttatttataaccacaattttcttggatctcatccactgggctataggtacacaccagggtcttcggggcaagttgttgtgaaaactacttatacgtatataccaagcaataagtgattgttctttagtatatggttttcaaataaattttatctcgtgtcaactccgtttgattaggagtgcatgtttggggtcctttgtttagaaagttgtgaaatgctgtttagttttaacaagtaagtgtttagtttcatcagaggtatgagaatgaggggaacgggggtaattaaatgctatattctttaataaagtaggtcagtttttatttcaggtcaatatcttttttatgaacattcctaatatacttatgtaaatgtcctgtcttagtctgagcagaaggggaaggaaaatgaaacttctggatgtcgtggtccttttctaatcagaagagaccatccctctctctcaatttgctttttccatcttcagcttctacaatatagctatgttcaattgtcctttcaactaacgttggtggttttgcagcagtttttgtacttgacttaggtttaactgtttattcagaatttgccatgttaaagctaaacaggaaattaaatcacagatataaaatgatgtctgtattaaatataacctcatagggtttatgtaagagataaacacaaactcaagcctaaaatacagtgagcagttgtacatacattattgatatataattaggttaattattctttaatttaacaaatatttactgaatgctgttgtgtgtcaggcattagtgctgattactaggaatataacagtgaagatgatgttcaaaatcctgctcccacattttagtgggaaagttagtaaatgttttagaattttctctttcctttatttggtcaactgtttttttgtatttgaaaggaataatttaaaaaactcattagtaaatgacaatgagccacattgttaggaagaactttcccttgtcacacttactgaagtaggggccagatgtggtggctcatgcatttaatcccagcactttgagaagctgaagcaggaggatctcaggagcccaggagttcaagatgagcctgggcgataaagtggaccccatctttaccaaaaaatgagaaaaataattagctgtgtgtgttggcatgaacctgtagccccagctacttgggagacttaggcaggaggatcacttgagtccaggagttggaggctgcaatgagccatgattgtgccgctgcagtccagcctgggggtaccatagtgagattctgtctctaaaaaaaaaaaaaaaaaaaaaaaaagtagttcataaataattttaggaacactgaaaaggcatttcaaacaataaattcattaatttcctaatctttccttctatagatactggttctggttttgtatgtataaataataaataaaatttggtgaatacagagttaaagagtttagaagtatgtggaattcattaaaaagtctctttagggctgggcatggtggctcacacctgtaaccccagcactttgggaggctgaggcgggtggatcatctgaggtcaggagttcgagaccagcctgatcaatatggtgaaaccctgtctctactaaaaatacaaaaaattagccaggcgtggtggcacatgcctgtaatcccagctatttgggagactgagggaagagagtcacttgaacccatgaggtggaggttgaagccaagattgcaccattgcactccaacctgggcaacaagagtgaaactccgtcttgaaagaaagaaagaaaaaagtccctttagaagagatgtttcttttggtttggactgcattgacatttcttttgcaggttcattgtatatctatattttgcaattattatttaaattgttttctaaatgaagttcaaattcttcatttttcagatcttgacagaacaagtatgtactcaggtcgtacacaaaccacatccagagccagattctacagtgaaaattcagaatccaagtgagcaaatggcagttctttactgtattgtggtaggcgcatggcaacatatgagactaaatcaaaacttttcctaaccccttaaatcattatggtgtttacctagttcatgacagttttaactcaccttttatagtgttaagtatttatttgaaagttggtaatactttttgagttgaacataggatatggttacaaatctacaagttttttttctttgtttacagtgattcttaaagtggtggcaactttgttaaaaaactctacaccaagtgcagagctgatggaagttcgtcgtttatttttatctgatatgataaaacttttcagtaacagccgtgaaaatagaaggtaagcagtttggatactgtaacaacactttattccataattaatattttctctcttttagattttcaattcatttcaaatcttttccatattgctaaatacttttaatcatcagaaaaggcattttatgtttctttgacataatctgtattcggtattcttctatttatttttatattatttttattttgttacgtggatattatattttaattgtatatatgaatatacatataaacaaactcttatttagaatgtaatatcccttttagtggtacctatctatcaccaatggaactttcagttgtaattgtgttggatttccccattttcatctatgctttccaccccatatttcttatggccgaatgttgtgcatttttaagctagttagcttgaacatggggtaaagtctgaggccatgaactctggggtagtcattgcctgagtctataatttaacaaatattgattgagtgcctactgtgttcagtgtaagactttgtgctacacaagatagtcttagtacacagtctcagtacattccagtgggaaaccataaagcaatgattaatgtataatgtgttaagtacattgtgagtgctaaaggtggtgagaaagtagagaagcaataagtaaatctgactgtgaaagttaggaaaatgattttgaatgataattaggatttttcctggtagagaaataagagaaagtcattccaagtatagaatatataacgtgcagcatgactgtacaccttgctttactgaggtcagatcatattttcactattttatttatcaaagtttcaaaatagtaaattctaacttaatttggatatttttaatgagatcaaatttttttctccctagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtaacacgggatttaacattttaacatcatcagagttattgcagtggattaaatggctacaaacatgcatctggtgccatcttgtgggcatcttagattttgacagattcctgtatctcagttttgtatttttccctcattgttcatagactgttagaacttgaaagtggcttatagatgaattaattcaaaccccaaatttataaatcaggagttttatacccaaagctgacatacatctgttttatagcaaatctgggaactttaatctgagccacttgctctttcaactggttcttggaagaatattttatgaaatagtctctgaaatatactttttaagacttttttttaagaagtcagatttttttatttccaagtgaatcataaatacagtgtttaagtttagtggtattttaattgctttatcttttctttatttttaatcttaaaaatctgtatgtctattttaagtattatttgatctttggtaaaatgaaatagtgaattaaactgtacaagtatatacacattagattctggaaattcagagttatgggtttctcatcatgaagtgttatagaagaagcatgggtgtcagaagtatggcttttaatttagtctgtgccataattgagttttgtgattttaggagactcattaagtcttcttgaacacgagttagaaaaaaatgtttaaaaggatagatagtaaatattataggctgtgtgggctctatagcctctgatgcagctactcaactctgccgttcagtgtgaaagacaatacataatgtaaatgaatgatcatggctttgtttgaataaacctttattcacccaaagaggtgataagcagttttgtcccatgggccttatgttaccaacccccacttttgggacttgctttcttcttctgtaaaattaaggggatttttgtattatgagatattctttaaaggatggtccccccaatctaaaattctgttaacttatttaaatatacattaatagaacccatgtctgtaagagaaagtctgtgaactttaaaaaatattagaaaagcttttgtttcaattataaatttacattttgtgaagtattgacacctcagatttatcattgctttaacaaatttgaaaatagcaaagaaaaagacattgcaggtctttgtgcaaaaaaaaagtattctgattattaataaagaagcctaagtaaagtaacaaagccaaaacagcttatataaggataaaactgtgatattttaatagcttgtaaatttatatatttaatgatatgtgtgaattttttaacatcagttgttgggaagggtgcacatatgagcaatagatggtgaaaaccaacatagtaatagtactttggttattgtatattattagctgcttattctctgtttaagcttacataaatgtgtggaagttaactggcatatttggtttgggtaacattgaaatacttagcctaaaagaaaatagcttttaatattgctgagttatctgtgtgattttggcaatccttataataaatcatatatagctgtatttgttgattatttccagttacttaatgaaactaagcacttgctttaggactaacaaatgccagctttgaagtcttaaactttctggcattattttttctatttccacaatttaatttgtattatttagttttttctttttgatatgtacaaaatgccttaatgttttctttacttattcctaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagtaagctaccttatatgagttctagaaataaataaaaatgcattgaagagttgttagcaccaaaacagagtaatttcttatcagttacttcatgtttatattgaattatagtataatagtaatttatggaactaaatagtgcggtataatttcatgtatgtaagaaactaaaaatatctcaattatatttccaactctgccacattcttctgtgtaactttgctcaacctctctgggcctaagtttccttatctagtacaagaggttgtactaaaggatgacctttaaggtctctgccagttctaacattttataactctgtgactacatttacacattttgtactcaagatcttcattctgaatacttgattaattttaaccttttaagcttcaggcccaaccctgttctgtggattatagaaaagaggacttggagcccagattgaactgataaatgaaggggaagggaaaagggaactgttatttatccagtgcctactatgttccgggcactgtgctatatgttttcagatttaatcctcacaacaaccctgtgaggtaggtaatatggctgagaaaaattagaattgttagcagtgagaattttctgttcaaccacatgaatagaaatttgttataagacaattaaagactcttaggtctggttgttaggaaatgttagtgcttcagttttgacctcactggaataaagctaaaaacagatgatgttttctgatatggattttaattgttgagctctgagttatgactgtttctttattttctaggataaataataccttatggttaagagttgaagaaataagaatacatttaccgttaatgacttgggttttgttatcctctgggtgccccacttgccttttaatgtcattgaaaatacattgaatgtgtttccattaggtttatactatgaagagtaaaccatgcctgtcttgtgtctttgtactccagtaagaatccttcataatatatcgtgtgtggggaaagtatttttattttttctctaactgccaatttccatttttgtggcagttgcattgtagtgataattggcaggagatgagcatattgaattagatacagatgtaaaataaaggaaaacatcgtgcgttgtttattgaacaataggcttgcctgttgaacactaggcttgcctgtttttcatttggagtttatagacatttttctggtttgttttctaacttatcaaatgcatttgtgtttttgaattgaagtactgtaagtgaaacagacttcaaagttaacttgaaactgtcaagtaatattttttctaatcttgtgctttagttacaattagttgatgacatatatccagtatacttcactgtgtatatgctcacttcattaaggaagtaatgtggtctaatttaaagactcttaatggggtaaaggggtctggttttcagtgtgaactttggtgttaactttaggtatttgattatcttgcctagtttctgcaatagtaaaataaaagcaataatggagacttcagcccaaaaagtttcctgtgcaaggaattaccaggtgaataatatatgtgaaatatattaaactgctaaagtcatatgctaaagcattaaagcattattcactttactatactcacagtttcattttaaaatgaggcatttcttttgtattccacaaaagttcatcttttccttctttaggctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggaggtagaaatatttcttttttataaattaaaagcaaatatttaaaatatgccattgcctattctatttggttttgacaaaaccaaaaatctgccttgattaaaggaatttccacatttttcttgtatcttgtttaaattaataccatgtactaaatttattagtgataataatatatactgtttaagtttaaaatcaccctgtgacatgtgtattcagagcctgtagtatttaagcagttagtggatatcagttcaaagatgataacttagacaacaaatctacataaagtaaaccatggcctttctaaattttcaatttaattttttaatagtaaatgtgaaacaaattaattaagagagcacatcatttacataggcatgaatacaattaggaagtcgatggatataagtagcaagggcaacttaaatgatctagcacaacattcttagaaatgttggcttccatgcttctcctcattttccttttaggattcaaggtggctgcttcagctcccaacctcaattcataagaaacctgcccaaattaaaaggcagagatgactcttcttccttcctcttcttcctgtttttcctctgcctcctcttcttctctctcctctttcactttctctttttcttctcctcttttcttcttttttttaaaggaagcccgtcaagaaatttcccccttatatctcgtgagccagcaggatcacatcctctttcaaaatcaatcatcagaaaaagaaaatgggattataatgactggcttttagagactaatactggttaattaactagtaactagggttaggctagtctttcctatacccagtcaagctcaataataaaacaaaatataaaatgtgtgttagcagggaaaaagttatgactgttgtggaagaagtcaataaagtctgccatagaaagattttacttttgattttatttgatcaatttgttcttagactactcatatactttcattgctaattgttatatgataaattacctagagatggtaactgaggaaacctaaataccatgaaatacattgctattaacatgaagaccaatgtatggagataaattatgtaatttgataattataatatcagtagcctccaagtgagtgatactcagctttttttccaaccacctactctgtgtttttgttttctttaatgggctctcatgaaattacccaggtagaatttaatgtaatttaaattttttaaaggtaacactttatttttaggacagagagaaacatcttgaaatttaagatacacagtgatagataataattcacaactctaaaagggtgagaattattgactcaattttgaccatgaagtaatttcttttttttaatcttatttttttcccattaaaaaacagttcaggctaggtgtggtggctcacacctataatcccagcactttgggaggccaaggcgggaggatagctggagctcaggagttcgagaccagggcaagaccctgtttttacaaacattaactaggcgtggtggtgtccacctgtagtcccagctactcgggaatctcctgggcccagggaggttgaggatgcactaagccatgatcccaccactacactctagcctgggtgacagcagagatcctttctcaaaaaaaaaaaaaaaattatattcttgactgacaccaaacgaaagcagggtatttttttgacatctacattgtatgttttgtatgagaacactgtactaccaacttactttgagattttttccttttcttattaaataagttcttgaatttgtactgatttatttatactcccctatcatgtcacttctttagcagtatacatttcaatgtgactagtcaaaggtggggctgaagtcattggggatgtgacaaattgaaactgcctacaaaatagaactttcagttaaatttttaggttttcggtttcaaattttatttatggttatgaaaattttgaattggttatattttgagtttccatattatttttaacattagacatactttttatatttaaaaggttttgcctttcaacaaaaaacaatcagatttggcaaaataaatatttttagccaaatttgttgagtcagtcatatgtcttagaatctagtactgtatttttcaagcaaagtaataatataatgagttaatatacttggatacaacaaaatcctgtggagatgaatgcttagtttttggtaatatgatatctcaattataaattgctttattttataatttaattttaaatatagctagctcctacagttctataatttttcacttgttattctaattgtctaagcttttcatttaagtaagccaaaacatactcatttctgttttctgtattttagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactgtaagtactttgcctccatctagtggttatattttataaatacatgactttagcatttcagtggtggtctaggctataaacacattttaaccagacctgtactttttaggcaaatttttaaccatttaaatttctatttccaccacttttgtttatcagtgttgggttccagctgtgtgtgcttatgaaaatgtttctctggtaattctgatgaatacttcatcagaagagtattgcattcttcatcaaagatattgtatatctcttcaaatctgtagtataaataaactcttaaaatccttgttatttaacattttcatttatttactgattcaacatttattttacaaaatctagccttgtcttgatttgtttctatataaaacattgaaatgtgttaatataatacattttaaaggcatttaatgttaattgtgtatgtcatttaaaataaaataggtcaatgttaactttgtattttagttgtcattaaaaacaaattctttgattcagaccaaggcagactccatagctacttgctcagatgggaaagaatatagaattttgcttcccatattacccacgttcttgttgccgtattagaaactcatccttaagctcagaaagcatacctttgccagagggaaatatttcattttactaagatgtgctttagttggtgagacactgtttccaagttgatctctaagtgtatttcatcattaacaagctttttctacatgactctttttcttactgttcttttgttaatgccaccaccatcaccagagcagccttgaaacttcaacattagcagccataggctatatcctcacacactttccccaggccttactcttctgttttattcatgaatttgctcaagaagtccacaaagggaagcattccagttcagaaggaggaatgcaacagagcaagtcaccagtagggccttaatcaaattagcagctgaaccaaggaaatggagctaagaagaacagtataaattgttgatggtgtgtgaagagtgcaagtatacatacaccactccttttctttaatctctcttttcctctggtgatttataccaaattctggtaaattgagagttgtgtatgatttttaaaatgctttctaatagtgagacatagagggcatttttttcttctcttttcttttctttttttttttttttgacagagtatcattctgtgacccaggctggagcagagtagggcgatctcagctcactgcaacctccgcctcctgggttcaagcaattcctctgcctcagcctcccaagtagctgggattataggtgtgcaccaccacacccagctaatttttgtatttttagtagttatggggtttcactatgttggccaggctggtttcaaactcctgacctcaaatgatctgcctgtctcaacctcccaaagtgcagggattacaggcatgagccactgctcccggccaacgtgttttttgttttatatattgaagactgaataaatcaatattttctttgtgacatttttcttgatcatataaattgcattttgttttataaattatcatttgttatgaagaaatttttaaaaggttgtattgaaattcactttgaaatgtaatattgaatgtttttaaattttgcatggaacataaaatgcttcttatgtaaaaaaaacagtttagcaataagttatttcaatttgtataggtttaaaatattcacattactaaatagttttccaaattttaaaggcaaaagatctttaactattaagatagaatattaaagtaatgaagtaaactataacatacatactattgcaccagtcaaatttgcttatttgttttatgatgattgtacagtaaagatactgacgctttgaggttggcttccaaaattattacgattcaattttgaccactgtagtttggaatttaaaattatttattacctagactatctcaacagacttgggaattcattcaattatagaaacctttgtttattttctcaatttctatatttctgttattttggcccattaactgtttggacctatgcctggttgtacaacatagctgattttatgtttttagaatgaattgcttccttaagagaaatagccgaacctttctcccattttgtatctggtagaactatgattggtgctgactgctgaatgttgtttttctattatgaatgttgtttttgtattactgggttgtataatattcttgctagaagttgtaacatagcagagggaaaaagttgggaaagaggaggttgaataatgagggaaattaaaccgaatatttgggctttttatatttaaatttaaagtgtaaaaagccaaaagagaattttggaagggataagtgaaaaaaggaaacattggcaacgtgaagattactgaaaggaaacattgtcttgtaggtgcttttagaattttaatcctagatatatgaagagagatggaaacatttgaaactaaggtttgagtgagctggtaattttgtttatatatatatagtttttcagaatattcttgtgtgcattttatgaagaaataggaataataatggtttatggcagtagttcacaaacttttgtgtatggggccagatgggaaatagtttaggtttcattggcagtattgttatctgtcacagctagtcaactctgctgtgatagtacaaaagcagcaatagacaatacataaacaaatattttttgtctgctgtttctgtgagattgacatagaagtggtctcttttctgccctggaaatttagatgagtacagtaatttatactagagataacatttttgtattgctgttatagtatcatcatcatggaagaaaatttttgaactgtttaatcttagttggaaggtacatatcttaatggaaacttaagaaaaaaagaacatatatatattgtttataatgatagtttgagcaccttgaacttagtactcttgaagaagcagcactttatgggagtttcagttttgcccagattacttaaattcatatgtagcatagaaaataaattacaaaaatagtttcagatctccgagttagaccaatagttttaactgtactcagggaaaaaaaatagacctcttagtatgtagtttggccaatctttgctttgggaaagcagcattatttttgttgttgttgatttttttagttgatgtttctgtgactagttaattgaatcctctcatttattctctaatatattgtttaacttggtcataaatgaaagtgaaaaattggagaagaaaaagaaaagcaaagaacatggatcaaccacaaattgcacactttgtgattttaagttgaccactttagtcagccatccagaacactgaatattatggagcttaattcagggcttaattttctctgtcccagaaaaatagtagagactgacatttctagctctcctaatagtttcataattataagaaagaagagctgctttttctattctgtccaaaaataacaaagtcttaattttagtttatttttattatcagaatgtatcataaatagatttggaaaaattatgaataatgttgttggttttgctgttcttttgtttatgtcataggactgatcatactttactattctcaggatgcttttatatgttttcctatacaatgtaccatgaaaatagcatattttaagatttatactcacatgtacttgtcaaaaattagaaagaatagttgatgatttttattgtgaaaactaattctatctgatatttgaatataatgaatataattattaatgtaataagaatcttaaacttagtataatacctatttaattacctttattcatattcaggcctcatttagtatatcaagttattttctagcatggaaaagtggtttataagttataatctctcaaatattttgttattttattaacttctcagaattttcaactataggaagctttctgtatatttgagaatacaaattacattatttccttatagaaaattctagaggttggtataaatagttcatttccctgagtcatttctgcctaaaccagaattgaggtagggattttgcagaggcattatgttagcttatttattaaaatgttccattaattataggaaaagatacttgttttgtaaaatagagtatgcattatttctaatatatgaactatacttatatatattatttgggcagagttactacaataaaaataagttgaagtctaaatatttgatatttaaccttgatcatgtataatttataaaatgaaaatctcttctgagaattttgcttttaataaaataatcaaatataatttttaaatatattattttgtgtttcaattttacattgtattttcatttaatttaataatttccttttcttgtactttttggtctgttgtctgttttgtctaatgcatgtccagggttctaaggttagtattacttttgtagtaattttcagctttcagtttcaagttttatttttacttatttatgaaatttttgacttggttatattttgagttttcatatcatctttaacatgagacatatcttttgtatatttaaaagagtcattgaaaggattattttcccaatgcattgatgtattactattttattatgcacaataatccctagattaaactatcatattgaacacaatggtgttacagtcatatgtacaatcagattttaattggttctaaggaaagtaaattggatgaaatatattattttaagatttaataattgtatgagagtgatctttattttttagccctatcttttgatgcttacatacttcattttttaaattacttttatataaaatggaatacaaattctcttttagactgttgtgttgaaagtgccttctactctaaaatttaattttttcagtcaaaaaaacactttgatggattatatggacaccttaataattctatttataattcactcattttaaaatgaaagcatagtttgacaggtcaaaacactcaaaaccattaaataatgaatatagagagatagctatctgcaatttcagtgattcaaaatgatgaagaatttgtgaacacagatctagatattctaaattctaacatttgaaaaattatttatagtatttgatagacctaagaaatggccaagttcttcattcctttatagaacattttaaattgaaaacagatttaaaatgaattttttgctctttcttatgagctatgatgtcatggtcatagatttttaattgatattatgaagtgatgctgtatattcatgaagtgctaagaagtaaagaatctgcattttaaaatccaagtaatgaattaatcatttctttatgccatgtgtactgaattggcataatgttgtaacaactgaaaacacatttctgtctctttccaggctcattttagagagaatggttttaaccctattttgctgttaaatggaaggaggaatggttgttacattttatacatcatttaaaactgagcttagttatataatgcttgtagtagccacctatcctttttattacccactttgtgcacaagaaatgttttgagtattttgagttcttttttcagtgttttctgctcacgtttccatgttaatgctcctgcttcttccaagcaggaagaagtttaggtataatgatggctataaacagtgtcaaaatggaacattaaataggaatagatacctattacatatgctaaccttgtagttgaatttatcatttggttaagagttaatattgattggaatggctagtgtgtccattttcagaaaatttaaataatttttttttacttatgaagtattcccttccttggttccttgaggcactgataaaatgaggcctagtcctaaggaacaaaaataattaaaatgctgtatagtccatggtgcaaaacaaaataagaaatgttgacattgtttaaaaaaccataaagttgtgcattttaagaaacacaatgctttgtaatattccctctgaaatcagaaatgtagtgaaagtacagttttccaatctagaatgctatgattctttttattactagtgttttataagtcacgaattaaatatctatagatgagttagcgatcttgattatttttaccctagagttttatcgtacatgtaaagtacctagtagtttcagtttattctaaaatggataagaaattgttatgcattctaatttgacagccatctcattttgatactaagttaaattaccatgtattttccctattattcatcatacatctataggaaagaaaaatcaaagcatatatttttattaatgggaatgaagattttagaaaagaaatatcaatttaaaatctttataaattacaaaacaaaactagtataagtacatatatgtggttctgtctaaatatctttgtgaaatgatcttaagtttaggatgtcatttttataactaaagacatttaaaactaatgttgattttaaaatgggcttttcctttattcaaggataattgataggtaaagtaaccgaatttggtaaccagctctggtgatatatggaattagttgaacatttattttatttataaaatatggtaaatatactaaatttatgttcacttgtagtatgtatgtatatgtattatatttccaaatttccaaattttaaacaagacttaaatcttctacttttttaaagacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattaggtaagtctgttaaaacaatagtgcatgtcaaataattatctacagagcagctttataaagcactatggtacataaaatattaatgatataagttgatgattatataatatggagattatcttgagatacagagattatttttataattaatcagaattactaaattttaaaaaattatgccttcacattggagatttcacagaactgatcatctttaatggttcatagtttgaaatcaagagtgaaatatacttggaattctttcaaaatcagtaagactaacatttgtcattgaagtgatttttaatgcaaatccatttatgaatccaattttggtaaaccaatactgagggtagtgtcctggcctcacaaacatgtcagatacacataatgctagaaggttaaaataaactatcccaatcttactgtttcttggggtgaacaaatgtccctaataaatattgttatacccatgctgttcaccttttatctgtgtggcagtgaaactttagcactgaaacctcttagtaaatctgaatgaattctttagataagaaccatttctacctctcttaaaaggaacatttatttacactatttagactttcaaaaccagaaaactgctgtttttgtacttgccttagatcatgagcaggacataagaactgcaaggcatgaaataggaaggacgttcctgatatgtactgttttcacccataacttttaaagattatgtcaaaaattcctttctgattcaagaaaggaacaaagacttggtttaagaatggtgggatgaaacctttttttgtttgtttgtttcgtattatttatttaaagacaggcaagctgagaggaatcattttgtattcattataagagaaagattgaccacattaagatctttctggcaaccaagaggtgtgggttaactgacggtgggccattaaagacatttccattgacatataacaagagctgtcaaatgaactgtgtgagaaagagatatatatatatatttttaaaatggctcaatatcttgaaacctgcatttatttggttattctgtacttttatttttaaatatagtccaagactttactccctatttcatttttatcctaatactactagcacatttagttgtttaatcaaccacaggaaacttttataagtgaataataataaaacacttatattacctcctatgctatttactgttctaagcactttctatatattaattcagttaatcctcacaacagccctctaaggcagttactttgttcatcctcattttacatatgctaaaactgaggcacagatagtttaagcagctagcctaaaaccacacagctccaaactggaaaatacaggattcaaactcaggtcacggtctgatttcaaactctgtactacttgttacagtattctactgcttcttaaaataaatgaataaataaaaacatgtacatattgaatgcttattgacaaagcccagagactttcccaccatgaaggaaggtgaatttggggacctgtgagacttgagtatactgatgtactctattattgcccgaaatgggaagttgtgctcagtagagtcgacaagatagtcaaattaagggcagaagctttattaaatttttaaatcaaatatgaattttatgtttaaaatattttattgatccataaattcagaactgtgaaactcagagggtaacagaataaggaaggatacattgggggtttcagagcctctggtaatgttttatttcttcagctggctggtggtatatgggtattttgttttatttttaactatatgtatattttgtaggtactttcactactgtatttcataattttgaaaattattgatctagttgattttaagattaatagtttatgaagcaaggggaaagaaagggaagaagaaataaacttgcaactttttccaggatatcaaagtcaacaatttatattaacaatatgtttttgaatttttaaatagtttgttgtgttgctgtgagaaactgtttagaatgtcggcaaagacagagagacaggggaaataaatcttcccatggaagcagtaaacctcaggaagttcctcaaagtgtgactgctacagcagcttcgaaggtaagtaaactttttttcttggccaaatataatttacctgaaaaaaatcttttttaagttgatgagaacaaagtgccatggtattgctcagtgatagagagcaaggacattgtcattaggcagctctaggctgcttaacaattttgttaccaagattacttaacttctctgagatttgtgtgttttggttattaaatgaagttactaacaatttctacttaataaagttcttacaaatattataattagcactaaaaactgttatttctatttttaatagtcatatattttcacagaatttaatgtatgaataattctccttttaaatgggtaggcataatagtcaacaaaaactcactgaatgcccattcaatgaatggagtattttgaaatatactattagttttctttctaaattagctttctttatcatatgcttaactggcccttggcgtcacatccagtttcattaacatgctttttgaggttctgtgcctggtccttgcttacttctccagcagcagctctcagccctttacccttgcttgtgctgttttagtcataccatagacttcattctgttcatcaaaagaagctatttcccctaacttctcagacttttatatgatttcctttccataaagtattcatccttattttttatccagctaaaatctatgtaactactaggttaccttaaatgctacattttctcaggaaaatgttttttgacaccctcgctaccaccccagtcagtctagggttgttccttctgtttgttgttttcataaaattacataggtctgttatcactcattacacttgtaattacatgtttaatattgatacagtaactttttgctcaataagtgaaggtatgaaatagaagtttaattcatcttaaaagttctattgctttaaacttctgcagatggcaagcagactgaccacatatttatcctattcgttggttatttgcagtgttgtaacttttttctttttcactactgtcagagaacatttgtaatttgactatatattatttactgctcacaggactccatagtgctcttatttggtttgggaaattaaatacaaatggatcatcagtaatgcctgatatcatttgtgtaggcatagtagacagataggtacttgagggcagtgtctatgtgttatagatctttgtaacttcagagtaatttttttttttttttgagatggagtctcactctgttgccagggtggagtggagtggcatgatctcggctcactgcaacctccgcctcctggattcaagcgattctcctgcctcagcctcccaagtagctgggactacagatgtgtgccaccacgcccagctaatttttctatttttagtggagacggggtttcaccacattggccaggatggtctagatctcttgacctcatgatcactcaccttggcctcccaaagtgctgggattacaggcatgagccaccacgcccggccacttcagagtatttatagcactatgagtactttgtaaaaagaggacaactctagaatcagacagttctgagtttgtgttctggctttaccacttaactggttttgcgacctgagagaaatctcttaaatttctgtgcctccgttttctaatctttaaaatggatacaaatcttaatttacagagtgtttgtattaattagacaaaaagtgataatagactgacatgctttgatttctggcatgcagtgaacattcagttattactgatttgttcccctgtctagcagtttgacacttaatatattgtcgtgaaacgaataaatagtattttgaaggtgacacctttgagatgtaagcacttcaaaatagtaatgtatttagtaatttgtagatatactaaataaagtagataatagaaagtccttaaagatttttataactagtatttcactgattgtagaatatggacagaaaagcccagtgggaaggaaattggtagtaacttacttgagctaatcagtatttatctggcaagaactttggcagtgaaaaatgggtaagtagcgatgaatgtaaaaatactaggggaagatttgacatttcacaacaatgaatggatctgagtggtgtttctttttttttccttcctgtgttatgtgtttcttatgtgacattttaggaagtaaatcgagtaatttttgaatgcagtgggaaagtttcttgcaagtttcttgcatgaatcccataccttcatgtgacctcatttttatactgtgtgaaaaggaacaattacacaagcttctcctatcatgttgtctttataaggatcaaattagattaggggtagagaaatatagaaaagaaaatatttctaatcttaaaatctatgttataaattcatttatgctgtaaattatgtattattttctttaaccatcctgtagtaaatattattagtctgttattcagatgatgtagctgaagttcagagaggttaacttctcaccgatggtcatatagccagaagttttggaattgtaatggaaaccaaatactatcaacctttaaatactatgctctttttactatggcgtgctgccaaggaatcaaacattttaattttgggctagaatatcatgattgacattcattgagaaatagaaggtaccctgtttatttttcattgttagagtaacaacaagtgcatacctattatgggctggaattgtattttgcattatacatattatctaatttaatccatacaatttttaacacactgtataagtgagaaagtacttgattgagtttcagggaccctagttcacttagtagtctactatgtgactacattacctgaaatatgtagatgtttttcctccaactataaaatgttttgttggtaacaatctttaatgtctttcagctttaatgggctgtgactgattctttttaatcttaccgtttctaaccttggatagaccatgaaatggttacacatacaaaatctcatatactagtgtagtataataatctcatatattataaaagcatgatggataaatgaacccagaggctcaaagagatttgttaactagaggtagagaaatgaggctcaggaaatcttctgaagtccaagacgaatctttattctgctataactttacctgcctttatgagtctatagtggtagctgtgccaataaagaacaagaatgctagtatggaaaccatgacatgagtagagagcagaaaatatgcattgtaatagaggattatgatcaataaatgttaactcagagaggtggagatacatgatgtgaccagtttagcctgaattaagaagtgatacttctatatattatctgtaatatattatctattcacaattctttttattttcaaagactccattggaaaatgttccaggtaacctttctcctattaaggatccggatagacttcttcaggatgttgatatcaatcgccttcgtgctgttgtctttcgggatgtggtaagttatacctgattggtttccctgaaataaaccttctactgtcattcgtatgaaatacgttttataagaaagctgcttatgaaaacgacattccctagtatctgggattgttggtttattgcatacttctcattataaaatggttgaaccttagctttctctgaaagcttattgataatgttacttttaaaaaatggtctgaaattttgatgtaagttgcttgcatactaagaataggactagctctgaaaaattataattaactttatcttgtatcaactactcctctcttagtattccttgctccatttgcaggtactaaaaatttgttattattaatgttccttacattatggatgaaagggattaattcattaggtgttactgacaattacttttggaggaggggcaattaaagaataatctgcattttaaaaaatacaggtatctatgggaatttgagttagaaagatagcttaataaagctaaagggaaaagatgaagaggtttcatggaaccctccaatcttatgatcagttactccaggcaaataaaaataagattggccttttcaaaaattgcatagaaacatatatggtgtttcacatcagattcaatgctgacagcatctcttaacatggttattataaaccagccactttgaattctgtttttcttgttttagttgatgattcttatctagttgttgattgtatatgaaatgtagaagaaagtttatattttaaatttatatttaacagtaaattgaatggcatgctttgtactttagaacatgattaaaatatatttaggttatataacataatgctatatgttaggaatgtacaatagaaaaatcatcactctgtttaatatatattagttataaaatgctaggaaaattccaaacataccaacagaaaaataggcaatggacacaaggcaacaaacatgataaaaattcagtatccctagtagtcaacagaatgcagattaacacaggagtgagagatttttcactattaaataaactaaaaattttaaaatgataatacctagcattgtctgggtgcagtgaaagctgctctgtcaaatatcactggtgtttgagctttcgaatagctctttgccaatatggttaaaactcttacaaatcttgatgtcccaatgaaccactagaacccagtcgttctagtcagaatttgtttaacttaatgttttcatcagagatatctacaggaaatttggcagcattataaatatccagtaatagaattttggcctaaaaattcttggcgtagtcattcagcagtgacctattcagcctttaagcatatatttttgaaggaaatttaatgacaacggaaaatgatcatgatatattttaagagaaagcaacagcatgtagaagtacttacattaacaagtattacatatgtatactgattgtatgtacatacatacgtgcatctttatttttaaaaaaagactgaaaaaatataccagtattccaccaatgattatgtctaggtaaacagattttatttatccttttatgcttttttgtagttttaaattttttataataaacctatattgtttttataattaataaataatgaaggtttttttaaaaagggagactacattaaagtataaaaaccacaatgtaagaactcactgtaatctaaactctaacctagacttggaaagaagataccattcttactgacagtttaaccatttagaaatgggaatagtcatcctgaaaaaatgtgttgtgaaaaggattttttttaatgaatgaatgattaaaaacatggagctcatcttcatctccaaaggcacagtcagacgtaatatataacataccggaggagtttctattaagggtgacatagtgtttaaattgttagtaaattttgaattaggttatatggtaaatgatgatcatttcccttaaattcatggatattttataaatatgttggataacccagcagtggttgtatctgtgaaatatggtgatgaaaagagaatgctttggaaagatctgggtttgaattctgactctaccttataccagttgtgtggtctcagtgtttctgagtcttaactttttcttaacccttaactggaaacttaggataatatgtatttagtgcttgatacataatataaacccaattaacacaagttatattaccttgatgttgttcggaaggtacaccatggcaacacttaaagcagaccggagaaacattatatagctcatgtcttctcagtaataaaatacctgagcaagtcaattaatttgtataaaaatttagtcattccccagatgtttagcctctatgtatactgagcttcatttccaaagacagaactgggaataagaagcacaactgactaggagatctgggttaaaaaaaaataaaaaataaaaaataaaaaaaaaagctaactcttttcatgccatatataaaggaggttttcgtgtagctatgacagcagtttagtgtctgttatttacagcgctgccactgtgtagttggcattcattcattcattccacacatatttgttgaatgccttctgattgcctggtactgagtttctagtgttagaaatagaagtattatgggatattatggtctgtcacagcttgagcaatgtgtgaatctgttcttggttggtatcttttcttaatctgattgtgcttcattttcctttgtaataactgcttaggcatttgatttcttcacttctctctgtgtttattgtatcatcattgtagtgcaaggaatatgcattttaaacagtttgtaagacaaagtatctctagaaaagctataacccacaatgtatgaaatagtaaattaggaataattcagaacagattttgtgtattttggtcattttccccattagccagactgttttacaatattaaatcatcagtaaatatgtcttatttgctttttgcctgcaaatgcacataaattatgaatcttgtttgcattgtgcttagatgaagtaataaatataaagtgcctgttaatcgagttactagaatttattacttgcttgttttccttatttcttattctgcctcttatctgtgggccacagtaactgctttcagtttggtttgaaagtatcagttttacctagcttataaaagaagtttaataaagatttacattttattccttagatatactctagtatattagaggtcatataatttagacttgatacttattgtttccctgaaataagtttatctaggctttttgaatagagctctcaaggttacatgcagcttgttatatttttggaaagcatacttattttaaagttatctctctaccataccacagccgttgttttaactatcattgctttctgccttggccagtttttttcaaaccttttaccatttgctgttctcctctggaagaactccattttatctttgagtttggaaatgaggagcgtgaaatattggcagtgttttagaggtcatttttcctgtgcagaataatggactattatttcttttaaaaaatgttctatttccataggtttttgggaaatagtagtatttgaatacacgagtaagttctttagtggcgatttgtgagactttgatgcacccatcacctgatcaatatacactgaccccaatttgtagtcttttatctgtcacccacttcccacacttttcccttctagtccccaaagtccattgtatcattcttatgcctttgcatcatagcttagcttccacttatgagtgagaacatatgatggttttccattcctgagttacttacttcacttagaataatagtctccagtcccatccaggttgctgcgaatgccattattccattactttttgtggctgagtagcatgacatagtgtatatatataccacagtttctttatccactcattgattgatgggcatttgtgctggttccacatttttgcaattgaaaattgtgctgctataaacatgcatgtgcaagtatctttttcatatactgacttcttttcctctgggtaaatacccagtagtgggattccgggatcaaatgataattcttttagttctttaaggaatctgcacactgttttccacggtggttgtactagttttcattcccaccagcagtgtagaagtgtttccttttcaccccatctgtgctaataactattatttttttattatggccattcttgtgagagtaaggtggtatcacattgtggttttgatttgcatttccctgataattactgatgttgagcatttttcatatatttgttgttggctatttgtatatattcttttgagaattgtctgtttatgtctttagtccacttttggatgagttttttttttttgctaatttgtttgagttccttgtagattgtggctattagttctttgtcggatgaatagattgtgaagaatttctcccactctgtgagttgtctgtttattctgctaactgatctttttgctatgcagaagctctttagtttaattaagtcctgcctatttatctttgtttttgttgcatttgcttttgggttcttggtcatgaaatctttgcctaagccaatgtctagaagggtttgtcaaatgttacctgtttatacgatcaaagattgaattagctttttcttatgctgccataatcatacttctggctcatattgagcttatgtaaattcatgttttctgctcccccattgtttatttctcctctattttgtattcatatagtctcttgttccagttacactaggattttatatgtatttcagttggagttttatcctactaattttattcagttatagtatataaaacccttgatttttttaaaatccaggacattattcttttcaactttgtgccatctacatattttataagcacacatactatgttgttatgtaagtagtagataataatggacaaaaatggacaaagaataaaattttaatattctagtttttggaaattacattccaacctgtagatgatatattttaggagttttatatttatagttaaataatacttattaaataaatatatatatttagcaggttttcataaaagttacatatcatattttgcctccataaagataataaaatagcagtttctagtgctttaagaacttatacttcaaaaagtttgagtgttaaaactgtcttttcatttttcataggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacaggtacttaacattgtataattatttgaattttcaccatgatgtatctcctttttttcacctttacatctagatttaaactggacctcttcataatcacctcaaatatttatgaatggttggtatagaaatgctaatttagtattccttaattcaacaaaaatgtatgaatggtatttttatatagttgctacattctcattttatcagtatagctttggtttcagtgtttctcatttattaatacaaatcattaatttataccactatttaatatgcaagtaactcatatattgttaaatatattacttttttaacatttataaacatgaaagtagaaagtcattatagagttgttcaatgccaagggtaagccaaaatacaaatctttgtagccaagctcaaaagttggatttttttcttttttagctgtatacagttaattcagtatctaaatattctatcagtgatttataatcaaacatgtgttctaaactttataccaaagtggcctcaactaaaatcaaagacttgtggaaagttaacatggacaacaatgaaccaccttgggtcatgctgccttttttcatttgcaaaaaatgctcatgttgcagcagttcttgcattactagctttgcccactctacttgaacagcataaacacagtttctggcaactaacattttaatattggacaccttctatcattatcatttccttccaggtgtttatatcaaggttgtttctctattgtttgcagtgaaaccttgataacctaatggttatttcatgtaccactggattaatttgtagttgaaattttctttcctaaataaatgcatatgatttataaataaaatggatatttcaaaaagtgagtagaaattagtggtcaaatctctgcatcttgtttttcataagcatatcctatttcatataccttttattgatgtcatggagatatggattatgttttagctacagtattttgctgttgcatgatacatgtacttttaacacacaaacatgagaatatttcattataatatacttttgcttttaattttattattcaaattaaacatcatcctaccattccagttcatgttttttcaccatttaaaacactaagacttatcattttctttttcttcatttttaatgcttttatatccattatatgtacaaaaagtaatagtatagtgaaccttctagttctgagtttcttgtgtatttgtatgtctctgtgtatgttgctagaattactctacttaacaaatgtattattttctttctcttaatacataaactcttttcttcagagatgcattcgttattgctagtattgtttgcatgttgcagtaatacagaattgtcatggatcttcagtggaccatgtggcaggttgttacatgctggctcaaatttgattccatgattttctccacagttgtggtcataccatctatccctcatccaagtttgaaccatggattccttgccaagttaattcctgagcagagctttggccactcattttacaaaggtaatactgacctcatctcctgacctgtttgggtattcttatttcatgaattgttttaaaataaatattcatgatatacttgtttataaataagtatatacctcaggtttcatggagatatgatatgttgtatttatacctagctattgagagcgaagtatagcttttatatttgtattttattacatttctttaagtatcatctataaattaaggatacctaattatatgtatattaatatgcatagtggtagcactcaggagagatctcaggagagtcacagtttagtagtgggactaaatgagcctaatataaaggctactctagaataaaccttaaaaacatgccttgaaagcatcaaactgatctatacgttatttaacttccagttagaacaaagccccaacactgtaaaggaatgcgaaaagtccatatgaaaaaccataaaattaaatattagacatccaacaaaaattattaaacatgcaaagaaggagaaaaatgtgatgcataagcaaaagaaaaaaaatcagtgaatagaaacagattttgagacaacagaaatggcagaactatcagatacggacattatagaagccattacatgtatattcaagatgtttttcaatgtaatggaaaaagttaacatattgaagagagaaatggaagatataaagaaaaaaatgacaattttagagatgaaaaatacaatagccaaaatgataatatctctgtgtaggagtaacatgagattactgacttcagaacaaaggatttataagaggtagaattctgtgatagctccaagattttcctgtgtacgcactctgcaaaattcctgggatgataaatatgatggtgtttactcctgtgattaggttatgctgtatggcacattggcctttaagaaatggtgattatccaggtgggcttgacctaatcgcatgagctctgtaaaagaagagagtttcctcctctggtcacagaacaggaagtccgagagacttgaaatgtgagagaaatttgacatgaaggaggatctttattgcttagatggaggtgaccatcttattgcttagatggaggagcaaggacctgagaaaaccacatagctaatagcactcaccagctgacagccagcaagaaagtggggactttagtcctacagcaggaaggaactgaattctgccaataattgaatgagttttgaagaggaccctgtgctccaggtgatacaatacttcagtgtattccataactgcctaatcatatggaacagcacttttggaacaaataaagctagcaaaatatttttgttacaacttgatgaatgtacaaatattattttttataaatgtgcaacctttgaacagcatgatgaaatgaagggaaaaatatttttttcaacctcactgctggctgacaaacacatctagctctaaactgtgcaaaccaaaaaaaggatgagattgtcagcaaacatcacctggagtttgtctggtggagtgtgttccaaaggctctgctatgggaagtatccggttgtatctgcccagattaaggagcctatatcagaatagtaatgcacgttgtcaagaaagtcttgctatgaaaatagtgtcagttaaactgaaaatagtttcagttacactgaacagtggtgttagtagcataataaaattttgaattactttaaggccaatgtggtaaacttgctattattctttatattatgtgatactatggcagattatcataactgttattgcatgctgtagtgcagtggttattgggggaaaatgtctgtcaaatatttttcatgaactcaatgcttccaaacggggaaagatattttttcatgatagatatgatcaaagagcacaaacaaaagttaaaatcttagaggtacacaatttctgtgatatgtttcacaatttaataataattatcggcccagctcggtggtgcatgcctataatcccagcactttgggaggccgaggagagaggatagcttgagaccaggagtttgagaccagcctgggcaatgtagtgagaccccgtctatacaaaaaattaaaaaattaaccaggcatggtggcatgtgcctgtagtcccagctactcaggaggctgaggtgggaagattgcttaagcccaggaagtttaggttgctgtgagctgtgattgtgcctactgcactccagcctgagcaacagagcaagaccctttttcaaagaaaaaaattattaagtattctgatctttaggaatgatctgattttgttcatctttcaagttatcacctgtcattttatggattgggcagactattttatattttattttccagcaatagaagattcacaggtagcaaattaatggatctggaatccatttctgtcattgaaatataacttacatcttattttaactatacaaaatgtagaagagttttcattccatcaacatacctgtgtgacactactttctcctctttgagtgttattgacataaaacaaaaacaatttaagtatttattattcccgagttgctttattgccagttcaccttagattagataaattaacaagcaaaaagctcattgtcaacatcataaactttatttataatcgcagtatttgttcaaaatattcatataggcatttgggacgtgaggatcactctttacctaaaattttttgtttagttatgttgtgtaatgaagaaaagttacaagtgtaatagtagttgtctaaattaatcaccagttcactttcggtgaacaacacaggccatttttataattgtattctttttctttgtgctatttttgtctaattatatttattgatatgtaattttatgtctgcctaatcaaataacaaaaacagttgtgctgtttttgttttaaaaacaaaacaaagttttaaaagtttaaactttaacttaaactaaaactttaacaaagttttaaagtttaaaagtagttttaaaattttttattttttcagtaatttacaattggtaaataaaatttcatattttattttctaaatgtgtcagcgaatgatggatttaggacataaaagtaaattttcacaaatagtttgagaaacccttttctggactactcttcagctccttcacaccccactcccttctttcagctcctttttgagactttaagaaaactctgaattagctctctggtctctctctttaaattttgatgtaatcccttagttcagactcaaatcccttcttgaagtattgccatagtttcttcattggactcttagtttctaggctttctctcggtttattactgacaattttggaaataacactaatatataatacaacatagtaacagtaagtataatttatgtaccattttaatataataaatattttataatatataataactataataaagtaatttttcttcctaaaattctcaaaaggctccctgtaatttttgggacaaagttaaaatgccttaacatggcaaaactattctaattctgacttgactcaattacaataatcatctccaaagtgggttccttacttctcttactgatcgttattcttttatttttacagttttgctgcctatttcatggttttaaaagataaagcagattatgtcctttcttgacataaaatttctagtagtatttagagtaacatttcacaagggccctagataagatgactattgactacgtttccaactttatctcatgctattctttcttttgctcactatgaaaccatcagactaccttctagttttttaatcatgccaagcattttcatgcctcaggatgtttgtattttgttcctggcttttggctcttttccctgttttctgtgtgactggtacctactcattcttcaggtcacctcctccgagaggccttcccttactcctgtaactgagtagcttcctttccattattattctttctcatatcatcttgttttatttcctttcttctattcagtgctttgtttaatcgtttattagaatgtatgcttcaagagggtaatcataactaacttttttttagtttatgtatttatggtgtacaatgtgatatactgatatttgtatgcattagggaatgattaagtcaagctaattaatgtcttcatcacctcacgtatcattttttttttttttgtggtaagaatgtttaaagtttattctcagcagttttcaagtactgatacattattaactatagtcaccatgctggaaaatagatcaccagcattgattccgtctctgtaactgaaacattggtccttttggtgaacatcttcccagtccctagtaaccactattctactctttacttctgtgagttcaactttttaagattccctatataagtaaaattatacctatatttgtctttttatgtctgacttaatttaatgcagtattctccagattcatccatgttgtcataaatgacaggagtttctttttttatgggtgaatagtgttccattgtgtatatacattttatttattcattcatctcttcgtcaatagacacttgattccatattttgactattgtgaataatgctgcaatgaacattggggtgcacatacctctttcaaatactgatttcatatcacttggatatataccctgaagtggaattattgaatcgtatggtagttctgtttttaattgtttgaagaatctcaataccattttccataatagctgtcctaattttcattcctatcaacagtgtgcaagggttcccttttcttcacatcttctccaacacctatattttactttttgtttttttttttttttttggttgtttttttttgagatggagtctcactttgtcaccctggcttgagtgcagtggtgcgatcctggctcactgcaacctccacctcccgggttcaagtgattgtaccgctcagcttcctgagtagcttggattacaggcacgccccaccatgctgggctaatttttgtatttttagtagagacgaggtttcaccatcttggccaggctgggcttgaactccccaccccaagtgatccacctgcctgtgcctcccaaagtgctgtgattacagatgtgagccactgcacctggccacattttcaataatagccatcctgtgtgaggtgatatttctttgcagttttaatttgtattcctctaataattagcgaagttgagcattttttatatacctgttagctgtttgtcttcttttgagaaatgtctattcaagttatttgcctatgctttaattgggttatttgttttgttgctgttgagctgagttccttatatattttggatattaaacctttatcagatatataattatatatgttggcattttattattagtattattggttgcctctattccattataaaagtgcatgatacattttaataggatttatgagaagaaaaggaaaaagagtaaaaacaagctagggcaagagaaaagcaaaatacatatatatgaatatattgtaagctctagtcgataatttatttaaaatataaaaattataactacattaaaatttgagttctaaacattacttgtaagtggaacttcgggaagagcaaagtaagaacctccaaaatactgcttttctaaaagtagtattttcaaaatactactttttttatgttatttaaaataagaacactggcaaaaactgtcaaaatcaactttttcagttctttggaaagcaatcagaggtttacaacaacccagaggctgttaattcaagaaaaactctagacctttataagaacagcaagatttagagtgatttaactcaccctgttgccatctacctttcctcagctctgtggtagctttgaaaaccagaggccagacaccagtggtagttttgaaaaccagtagtctagcagccactgaggataggagtgggagtaggttaggtttagaatttcttagaaagtctcgaccttagagcattataactatttgaactgtatggaatcttcctggaaaactccattcacagggcttattattatttgacctaatctagagcttgtttagtgagaaaagcctgtctccaaggtatttgttgaaaataatcagcttttttctttaatgttgcaactgctcgaagtgacagtgccagttggggcaaacaagaaccttgcctaaaagcttaaacagatgtgagaatgagatatccatattcccagggctgtcctcaggcccagggaagacctgagaaggcctcagtctctcacctttggctgaccttgaggcccagcacaagaaggaagcgcaggctaagagagagttttaaaccatgagaacattgcaagcatacccaaacacacacacacagagcctgtggcaaagggtggaacatttattggttcaagacatttaagacaatgtctgtgcaatcattagctgaccactaggttaactgagcagagacttaagtggctgcagatgatggaaaacagattttacagaattagttcaggaaaatgaataaacagaacaagaacaaactgtaggtggggtcagattttcatgattgccacattatgttatttaaaatatccagtttacaacaaaaagaattatgagacaagcaaagaaataggaaagtatggtcaatacacagggggaacaaagcagttgatataaaatgcccctgaggaagcccagatacagaacttactagacggacactttaaaccagctattttacatatgctcaagtaattacaggaagcattttctaaagaactaaaggtataagagcgatatctcaccaaaaggaggataccaataaagatatatgtaataaagaaccaaatagaaattctggagttgaaaattgtaataactgaaatgaaaaattcacttagaggggttcagcagaagatctgagctggcaggaaaagaatcagcaacatgaagatagttcaattgtgtttatcctacgctggggaacagaacaaagaaagaatgaagaaaagtgaacagagcctcacagacctttgtgacactattaagttgaaccaacatatgtatactgggagtcccagaggaaagaagagaaaaagaaaggagcagaaagaaaatttgaagaaatattggcctgaaaactccctacagttgatgaaaatcattaatatatatgtctaaaaagctcaatgcactccaagtaggataaactcaagagagacccacatgttgacacagcgtagtcaaaacatcaattagaagattttcttggctcttaattttcattttgtctcttatgggcgtataagttagtaataatatttaattcctgaagttgtattcttttcatacacttagtgtagcaagcaaacaaaataaatcatatataaataatcgcaaataattcattgcagtatttttgtttaaaatgaactttaatgaggatttaaaatctttttgtgtattttttttcctctttggagttaagatatttaattaattttgcatttatggatttaatataaacaaaatgtgtaagttagttacatatagcttttttatgtttcattttaaattacagtgatttagtttgcttatattattatttgaagtgccaaagcttaatataatttttagtgctatactaacaaggtgctgtatgtttctttcatgatattccttatttagagagtttggaaaatggcaatttcagtaatttaatatgtaagacatattgaaattcttcataaatcatggtaaaacaggatttttggaggaaggaatgtgatatgtgaagtcaccgtgtaaatatcatgtcatttgctgaagttgtcctcatatttttctcaaaatgtattagatgaactcattatagtcaatgaaaaacagtaagaaaaagagacatctggcatccaaatgcctgtttctgacaaggttaagatcactctggctagtaatgtttctgctctgtgtactgacattgcctgttgctacagaaactgataagagctattgaaaacttacatgcctgtgattaatataacctacacagatgcaatcatttatagtttttctgcagttcatgcctaacttcctatttgaatcatggattaaatcctcaaagtactttagtgtcacaaagaggtattctggaaacacgagttatctaagttgaagtttatggtatcaactgagagcatgttctgttaaagatgtaaatgcatactgagaaatatgtaggttttttgactactgatctgtttttttattgctattataaaatatcctattggcatttagttttatttctatgtaatatcacagcgtgtatgctttacaaaacatatttatttgaataaaagtcattgaaatatcaaaattactacttcctttttgaaatcattcttttatcagcctcaataaaaataaaattgagatgtttttagtactatgtaaatattttgatgagctatttgaaaatattctaatatttgatttctagaaacttctaattgtgttttgtaatctagagatcaacatttatattgaagtttcaactatctagttagaaagttaaacattttaatatccattgtaagtcaaatagttgagcagaaaagcaaaatattatgtagttggtggcaaaagtcttttgatgtggtagcttgtgaacaccaaatcagattttatttccttaggtattttgtttgctagtgaaatgcttatattccagtctaatatagcttgagaagtttaaactttttgtatagctgttaatgtaacatgtcatatataacgatacttagacattatattaatggaaagtcaaaacactagaccatatctgtaaattagctaaattcacactaagtgttagatatgattgtatgacttctgataattaaactctataaaaattagcccatgctagtaaccatgacactgttttgtttttgttgttgttaaagtttttgtttctgcatttacattttctgtcctcttgtcgctataactatttaaactatttaattctctcctgatactttgctgcaattgttttctctcaaaaaatgtacaatccatagatacaaatgtatgttaaaatatattcagtggtatctctaatagtgaaaataactgcctcagtcatcttatcttctcattctagatttgtaggttattttatcaacttccaaaattttggctattgcctcagtttgaatgatcccaaaatgtacggctattcttcttttgacctacagatataaatatcttagagattctgtagactaaaagtgattcaaaatttagttaattattttcctgaagaaatctcattttcttcctttctcagttagtgacgtattaccactctttttcttaacctagatatttcagaaatacccttagtcttctcctccttctcatttatagggttactattctaatttaagtcttagtcttctctgacaagattttattaaaaatgccaaactattgtctttacttcttacctgtttccttctctagtcctttgcctactattattgacattgtcttgtcaaatgcagttattttaatttttaatcttggaagcagtaaagaatctaccctgattttcacattggtcatccaatatgaatgtttgaatattattatcatattccacagattaatctattctttcagtctatcatctttgaccaaactaacaaataaacaaacaaaatttaaatctattcaacaaatatgaggaaaactatgatataacattgcattgtgataaatgcatattttaagtcagtttaaattagtatttgatattaggaatattgaataatatgaggatgttatttattcctaatttaatgtatagatttgatataatttgactcaaaagaaaagggggagaaaaaaatgggagattttatttcaaaacctggcaacatttttctgatgcttatcctagaaaaagtattataaattcacaccctcaggaaatctgaatggtatgccattagtttaaattcaagcaattaaaaaaactgtctaatagacaacacccaagaattgagtctgttactgacaaaatcccttcatattgtttttaattttttagtatgtgtgtacaaaactttcagaagctgtgatcacacccaacaattctatcatcagaacaacacttctactagagatttcacaaaagattttgtgagatgtcttgctgacatcaaggtagcctattttcctgttgggcagtttcctggtttcttgtcctaacaacctttgaattcaaagaaacaagcaaataataacaaaatctaagagaagttatatagaatttactgattttcaatttttaggagatctttgaaataatttagtctgtgcttctcattttcaaagattatgaaactttcaaacttaaatgcaagtttaagcaatacaaatagctaacatttactgagcttctactttaaagtgagaactgcagtgaatttacatatagtagcttaatggtatcttactttattcaaaacgattaagttaaggactgttatctccattatacttagatgagatacacttttcaaggttatcgtttagaatttggtaacattttattatatggagaactttattacattaacctttgtatgatgaaatttgatagaaatttaacattttaaagatttttttatttcattacttttagttgttaatattatatgtgtatttcattatctgtgtagttatatgcacatatatgtttctgatttaattttcacaaattgaaatttatatttatttacaaagaatgagcatgagtattccaaaatataggccttgtccttgaggaacattattatattattaatgtatttattcttttgaactaatcatttgacttgctttgcattttgcaagtgtgtcagaattttacgtattgtaattttaaaatgatcttcgattatcttgaatatttcagatattattagttattgaagtaccaaagaaagtataaaaatgactttatatttttaaggaaactaatagagaaatataagaatttctcttctatgattggcagctaacaatcaaaggataagaggggaacatcatataattattatttataagctgctttaggaaattgttataggaactatttcctgatgcttttgaaggcatcagttttgaaatgccagatgatttaagaagcaagaggattattttgatgctccctgaacaaaatagtaggtgtattggatgatatctttttgtttttttttttgtttttttgagatggagttttgctcttgttgcccaggcaggagtgcagtggcatgatttcagttcactgcaacatccaccttccaggttcaagcaattctcctgcctcagcctcccgagtagctgggattagacgtatcccaccgtgcctagcttatttttgtgtttttagtagagacggggtttcgccatgttggccaggctggtctcgaactcctgacctcaggtgatccatctgcctcagcctcccaaagtgctggggttacaggcatgagccatcatgtctggctggatgatatctttcaactgagttgtgttactactatgcacatccgtttagcaattttttgtttctacaggttttgttttctttatttgaatatatgaaaacatttgattaataatacaagatttttactttcaaagcttttttctaacctagtttctttcattacagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggtaggtactgaacttattattcacagggctttatacataaaaggaaaattagactttgttaattttaaaatataaggaagatcttgaaaactttattaacgtagattcttattacaaagacaatcaaaatgatggctcaacctaatcttataataagacatcttaataatacatcttaaagaagaggtttcaatgtgatatgatggatagcacattgaattggaagtagggaaacatggattatggttatattccattatcaaaggactacagtacatcggggtgttatttttctctttggacttagtcgtttcatgtacataatggggaaggggatgggtcacatctgtccaaggtttatcctggctctgaaattccattataatattataaaatactataataattgttggagattatatgacatgctttaagtgataatatttaaatttgaaccttaaatggaagtatatggaaaaattttaaaattgtttgtggtcatcttctttatgagatttccaataccaatgtaaaagctgtattttgaagcatgtatttaaaagtaaatatttttgaaaggtattttggcattttaggtatcgaaactatttataacatggcccatatgtcatatatctacattcaaatgttaaatcatgcaaggaatttttttaaggaacaattaactttttattccagtatacattcaataaaaatgatagttcacagaagcagaataagatattttagaacctaataccctagtcatctaatatcttccactatttaaaaacatgtgcaagattagaagaatattttagtcactaattactaacagtagtacttaacattgatcactggggttaatgcctattccaaataatgtttgcgtgttaatgtattaactgaaaaatgtgatggcttaccttttaaagtaaatcattgttattgatgttttaaaacatcttttcataccaaaaatttatgtatatgtatgaggtgattgacaagcaagtgttttttttgttttagaaagacaagatcaaattaggaaataaaatgtttctaaatggaaatgtcaaagtatatagtcaaaaaataatatctattccatattgctttctctaaagtagccagactgctcttgttctaagtaacattttagtttaggggtagaggatgtggcggtatagtcatttcagtttggatgaatacccttttttttttgtttttgagatggagtctcactctgtcacccaggctagagtgcagtggtgcgatcttggctcactgcaacctccacctcctgggttcaagcaattctctcctcagcctcctgagtagcacctgccaccacgcctggctaatttttgtatttttagtagagacggggtttcaacatcttggccaggctggtcttgaactctgacctcatgatccacccgcctttgcctcccaaagtgctaggattacaggcgtgcgccaccgcacctggccgaattacccttttaatacacaatataatttaaactttgcctgtaaacacttttgccagtgttttacaaatacgtcttgaaaatctgttgtggaaaatgttaagtggcactggttatcatgcagaatataaagatgaataaaattagttttatcttctatgaatttagagagtagtaagaagatgtttgcaaataattgctataatagataaaatgtgtggtgtcagaagttttaaaaagtaaaaaatggtaggactataaaatgtaagaaatatttttctttttttggtattttggtattaatattgtgtttggatgttcattcatatagtgatgttccctgggtgttccttatgatgtttcacatttatttcacctttttcacatatttggtttatgttttcacgatatgcctatatgtgtgtttataagtttgtataaacatatgcatgtaagtatatgtacttgtgtatttctataagcctataaggtaatatatagtaatttaagttttgtattctagttaattttaaattatatctttaaatgttggtaaaatacaaaccaataaatacagatgattattgtgatttacatatgaaaatccaatgaaataaacattaagtaaaattttttgttttaatttggattattgttagaatgagttttttaattaaaactttaaaaagcagtcacctgagtgctaatattcttagctactcaaaatttattatacttttgagaatattgctttaagaaaaatacagctttttatgttcctatagcatttgtacaaaatgcagtaggagtggaatcattattctaaattgcataagtacaaatgaaatggaagagcacaaagcatatttcagttctttttaggaaaagagtctctagtgtagttaatatatgcaatagctcaagtactatcaaatgtaaatgatgaggtgatattgatgaaaggaggggattgaggtctcgggggcgctgatgacggattgaacagaagcggccttgcactgcacgtaactcaagtctgtcgtcttcactactcaaagccataatgggaggtggcagtttgaaatgagttgccacggcaaagagtattatttttgaaatgctttcacacaaatcactaggccctgcatacaacttagtttcatgctttaatgtcatcaggaggcacaaattggtgtgtctaattgtttgccacctgccagcaaaatgagctgccagccagccagacgggtttgattgtctgtcagccattcaatagattgagagtgacaacatcaaaaatttaacttcaaactctgaagctttgagcagcttttcagagacatcatccccacaagtgcttctggaccagtgcatttttcaattatacttccagggtattgctaccatttgccttatctgtcttaaggtagctataattacattatgaggtatataaacatgtttctgaagcactaatgtctgaaatccaagttatgacatgtcttttaacatcagattgaattcgttgaaaatgagatccaggatgacaggctttagaatgaaagtcctgaatgctaccggtttcaaacacagaatctatcatgggtcttactttaccaataacgtgtttttcattttaatctttagttgaaaagtagatataaactcagttggtcgcttctttgtaactaaatcacactcctaataatattgtacagtctcaatagaattcatgtaggattttacttttgttaaccagttgtttattgattatattgcagacatgctaacaatgatttccttatacttatcctggattttaaatttggaaataatttcctagaacaactgggataatttgagttatgttaacttgtgttctacgtcgagtgtatctcaccccttaggatggagcattggtgaatttcagtgttttgaagtttataataaaaaattgcaacatcaaattcttagaaacatttagacttaattaaaataaaccttttttctttactattacatatttcatcagattatgaaatattacataaatgttctgtacatataaggaaagtactgattctttttctatttccttcagtcatctgtgcagattaagtatatatctttgattatactcagtgatccgaacagatgtgtactcatgaagtattaaaatgctagagatcctctagtactgttctataatgagcaaacactgtatgtaaagaggaaatacaatcataaaactataacaattttttcaaagttctgttactgtgaggcagagagaaatatttatgatggttttatttttaacagaaaagcttaataatctcattttagaattcttaaatcaagttgccaagttctctaacaatactatctctttagatagattgctatatttatcgatggtttataaaatgttttaattgagctattatttttcatgtactgtgtaacttttactttggagtaatgcttttatctaaagccaccaattaaccttttacttaccttttaaactaaaaatttaatcttatatatctgcatgctttttatcttttgagtgtttggtatatatatatatctatgttttggtttagttttaacttcctaggatttccagagattcccacttagtttgaacaaaagacaaaaaaaaaaaaaaatagagggcaatgtgcttctcatacatttttaactgttagtatgtttttaaaaattgttttaagtgtgtgatatcacacaaagcttatagttgtgttgcttctttggctaacagacctcaaacttacacttcactttttcagattttgcaaacctcctgtattcaaattactgggtttgatatattcagggaaactagtaggtattttttcctcaaaattttaatatccttgcttcccagtgtttaattatctgaaaaagaaaaatctattttgtaaataatatagggccaaaaaagcaacttagatagacttcatattattaaccatgaagtataagcttgagctaggtattttctctttagtttcattagtattctaatattgatattagtggtaaggatgaaatttcagggtaaatatttttaaaaatattgagtagagttaatgaggtcttatgttgatttatttaaagttagaattaagtaactatgaaaaattataattacttctgaagacttcaatttgttcttattactatttttttaaaaaagtattttgaccctatcacttaaaagatgaacaaataaacgtaagccaaattgattattcatcttccagcctttacaattgaaattttctacatctagccactgtaatttctgcttttattatgctgcaagtgccctgagtatatattttaaggtcaattgctggaagattcagttttgactgagcatgtttgtgtcctcatttccccaatgttgttgactttgtgtctcctggcatttatagagagctgaataaagttcagtgagctgaataaagtatctctcattaataggtgatttaatgagattctttattgtttcttaaacatatttttttatattgcaattctcaaatattttacaaaataaggaagcatgatagataacatcatgagagcattcaccttgcgatttctgatgaactgaagtaaattgtcatgttatcctagaatcagtaacaaattatttttctcttttaagtttcaacgttttctttcaagatacatatttaacatccacatcctagttagagagtgataatctggaaattaggggaactggatattaatagttggtctctcttcaatttgttccaggaccttgatccattctttttggctctctggaactcagtttcccaacccatataatatgatataaagctacatgatttctaaaaagtctcataaatttccaaaatcctatttaaatgaaatgggcttattattagtcccccaaagcaacagatagatattttcgagcttggctaaaagatttgaatcccagaaaaggtgcatctccattctcaaactacattagcccctcagcgtctctaaggtggattctttctgttacctcctaactgccctcactatttccatgtttcctctctcaccccaaatttatcttttacatttatgccatagacatttttctaaagtgtgaagctgatgaaaattctgaaataattcttgttatttatataataaaggaggattattttagtttggaatagaaagtccacacctttcaccagccagaagtatctaaagcaattcctttaacctaccttgttttttcatgtctctttgccttgctaggtttttactattaaatttttgtatgcacttttccctacttggttaatttctattgatccttttcatttcagcccactcttccttgattgtgcacagcctgtgttcctgaaaggtcctgggcataactctgaccaggtcaattattgaaatatattgcatggtcagtttgtgtgtcatattccttaaagtatctaaggaatatgccccagggcatggggcatgtattatttgtcttgtgtctcccaaacttagtgtaatcccctgttagtgctcaaacagtagaagggaacagaaagaacgggattcttatagtgtgccatgaataattataaaactcacttgccttaatgagtcactgtttaaaagctctttcttatcttcagtatctccgtttgtacctaggataaaccatgatgtacacagataagatagtatccctgtttttacaaaatttaccgaactgtttaatggagactgccaataccctatccttataccacttttcctgtccctttgcattcacttctttggccatctcatccactctcctggcattaaatagcatctgtatgctgatgactcttatatttatatcttagtttgaacctcttttctaaactagagacttatctatccaattgcttattcaacattgctatttggatgattaaaaagaggtataaaaaattagtataagaaagctgctccaaccatattcttccctatcttagttaatggcaacttgtcctttctgttacttaaggcaaatttttttgcataatccttgactttactctcatgttcacctccagttcttatttaaatcttatttgctctgccttcttaatattgccaaaatttgaatcacttctcaccaggttttactttgctattccactccaaaccaccatcatttcttgtttgtagtattgtagtctcctagccattctccacagtaaccattgtccctcctaagactatctgtgacatagcagccagagtagtcctattataacataaggttatatccttctgtgcataagccttcatggtttctcatccctctctgaataaaagccagcatctatacaatggactacaaggccctgtgaactcagccctcttacttatctcatctcttacagctctccatgtcacccagtattctcttgtcacactagcctttgtactgttacctctgcctgtgatgctcttctctagatagcctcctggcttattctttcacccccttcagtgttctctcaaatactaccattttttgtcaatcttctctgagccgccctttcaacattattccttcttcttatctatgctttatttttcttacagcacttaacatctgatatactatatttactcatttatgttactgtatttgctatatctctgtattgaaatgtcagttccatgagagcagggattttattctatatattgctatatctccagaacttacgtcagttccacacacattgcaatgctcaataaatatttgttgaatgaatgagtgaatgtatcacctctagctttgagataggataaattcaatgatggaagaattcacacttacatgtattacttattagtcaatttattaaaatcatataatcaattaatgaaatattttatcaagtgaattagattgaaatatgtcctggcttataccactttgatgataacttttacaaccttggagtgtgtatagattctatgtagtataaaagaattatccactttcttgtagttaagagtcttaaagatgtgtgatagaagtttgaaattgtgtggaaagcatagtattgagattttttaaaaaattccattggtaaggaatatgtagaatagagcaggggtccccacccctgggccatggactggtaccggtctgtggcctgtcaggaaccagacagcaggaggtaagcagtgggcaagtaaacaaagcttcatctgcatttacagctgctcctcattgctcgcattactgcctgagctctgtttcctgtcagatcagtggtggcattggattcttctaggagtacaaaccctactgtgaactgtgcatgtgagggatcaaggttaagtactccttatgataatctaatgcctgatgatctgtgactgtattagtttgttttcacactgctgataaagacataccgaagcctgggaaggaataaaaggtttaattggacttacagttccacatggctggggaggcctcagaatcatggcaggagtgaaaggcgcttcttatatggtggtagcaagagaaaatgaagaagcagcagaagtggaaacccctgataaacccatcagatctcatgagacttattcactatcacgagaataacacaggaaagaccggccctcgtgattcaattacctgcctgcccctaggtccctcccacaacatgtgggaagtctgggagatacaattaaagttgagatttgggtggggacacagccaaaccatatcagtcactggtgccaaaagctttggggaccactggagtagaggattcaaggtatccgtcaggatgaatagcagatctaaaagaagagcataatacctgaatagtttagttcaatggctcttaacctttttgtggctatgtatgtttttgaaattcattaaaaactatatgttcactctaaaaaaatgtttttaccaccaaaatttgtatatattttagtgtatttatctaccctaaataggttacccacagtaggtacctagacttctaggtaagatttttttggtgtagatggaatagatagccagtgtgaaacgttgtgtaacaatctgatagaagattttataagagttgaaaatttttactctcatatatgaatagttgctaataccaagtaacattttaaaagataattaatttgttatcaacacatactggttagtgtggactttcaaattaattgtaagattgattgctaagaaagagaatggtttgagataaaagggaaggggtaatgttggtgaagaaacaatattaaggacaagaacgtgcagtcctttagtcctagataaacagtttggccatctgaatcaaaggggaaatagttcttacaaactcataatgtaggtgcagaaaaagatcggagaaatcggtcaaatacaggttcctgcttctctcaactaaacccttgtaacttggtcatctcagccatttgaacacataagtgattagaaactggaattcataaaaattatcagagatttttttcttcttgttggtcctaatttggtattctgaagtacatggaagtttcattttgttttcttatcagactttcagattttttaaaaatgctgtaactttttctcacccttttactgtaattttctgtcctttcagcctttcctcatatgacttgttttccagatcaactgtcatcctaactgttctcttagggacatgattctgtttgtcattatccttgaaatatagtgcctaaaactacacgtatgagatatgacaatagcagagtatatgaggattattgcttctttcagtctgggtatttttgctgatatagacccagactatatcagcacttttgggagccatagcaatactcgtaatagctaaaatgtattggctgcttagaatattccatggactgtgctaagtactttatatgtgttacctccttttatctttataacaatcttattgcacccttttataacaatctttatagcaatcttaagtttatgatgatattaccattatgcatctcattttaatggggaggagaatgaagcttagagagatctatgtgcccaataccacgtagtaactgctgaaggtagaattctaacccgggtctgtagggttagaattctgtgccatactgtcaaactctgctgagtttgcaagcaatgaaatatctggaggctttcacatcaattgctattaattcagtgctttgagatttttagtaggcatttaacctgtctatattttacttataagtcataattatgggatttagagattttttttctctcggtctcataacttatttttcctaatataacttatttctcatagcttccacattagacaagataccagtctgttacagagagcttttgctcaaagttagtaatgatcaacagatcagaaatttatagtaatagtttttctaccttctgcaaattcatctcatagcactgttaattagctcatgattctttatccataaataaacatctttgtgtctgctgttctaaaaaaatcatgagagatgcagaaaaaagagcattatactttcactaatgacttatcttcaaatcgacagttgatggttttgttttcttgctggagagtcaatgaaatagtacatctcacattattttataagtttagaggagaattttgataacaaactccaaatattggcaagttccttttttctgttgatttttatgtagatcattataagtagatgccttatatctcatagacaaaaatatatttcactttagacagtggtaatgattattaacatttataatacacttcataattgacaaagtccatttaaatatgatctcatttaatctccccaattgtatgcgaaggaggtagcattagtcttacgattttacactcaaaaaaatgtaagatcatacagtttgagagtggtccagttttcaagccttagttttgaaatatagtccacatcttatattcttttctgcaatgtcacactacctctcaatgaaataaacgaaggcattagatgaggacttgccaatatagggaatgaaggcataatgtgtgctttaggtaattagatagatagttgagaattaaaggttgagtctaaagaatttgacaccaacatgcttaaagagaaaagaagaaagtacctagaaggagatagtgaagaaattttttggcatgagtaaaactatttaagattataataccttaattatattaaggtattatacaaaatgttttaagtatttctaaaattaagaataataattattacaaatatagattattaacattaaagaagtcactgaagatattaacaaaaccacttatttgtggaaaaaaaagtgttgatattaaggaagtttaagcaacaaacttatttgagaaaggaccattgatgtagttttctttaggtagatttttttcattgagtaagtatgaaatagagatgcattaaaaagatgtaaatcaagttggatattttagtactgtcagttaccagtttccaagcattacatttgattaaaatagatcataaatctatttgtagatgaataaattctgtgatggttgagtaaggtttggaagatatttgctaaatgaagtttgcagtgctataaactttgagaagaatgaacctttactgcaagaaaatttagatatttattaagttagagaagtagtttctttatacatttttaaaaactgactaatatccatatttatttgtcatttaaccttaacacaatgtcaaattcagaaatttttaaatgaaatacatttaaaatacgctaaagaaacctggggaaatgttgaactcctctgttaaagaaaccaaggctcaaaagtgaaataaacttctaaccaaatgtctctctatcatctctgttctctttcattctaataatattcctactataaaagcaactcaattttgttcagaaaaataaagcataactttattgtgctcttagaagtttatttattattccttggtttaattttcagctttactatgaagaagctttagaatttggcatttaaagtctgggcacggtggctcacgcctgtaatcccagcactttgggaggccaagtggatggatcacctgaggtcaggagtttgagaccagcctgaccaacatagtgaaaccccgtctctactaaaaatacaaaaattacctgagtgtggtggcacgtagctgtaatcccagctacttgggaggctgacacgggagaatcacttgaacccaggaggcagagattgtagtgagccgagatggcaccactgtgctctgcctgggtgaccgagtgaaattctgtctcaaaaaaacaaacaaacaaaaaatcaaaaaacaaaaaaagaatttggcattcaaatgttttatgtttttacatatttatgaatattttaaacatggagaatgtgatatgggtaagatggacattttttatgtatattttgccaaaaattctatgtgcaaaggcaaaatctcctaactttagcacaaatttcttaatattcccagatttatgatcacagtccatttgccatcttaagaaaggtttgcagactcctaagtcttcaaaaatgttggccaaatcaattaggcaacacactttataatatatccttaatgtccatatcctttccactgacaaagctggactaaggagtttaaaatttttttttaattaaaagaagagagggagaaattcgatgttgactatgtatatctgttgcagcaggattataattcatcttcaacctcatgtttgttattttcaatccttcatttctttgcaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtattgtacttacatatttttgtgatactcatctttttatgttttctgtatcatttttctgcttatttgatcttaaaaattaaaataccctaatcatttaagattatcttaatttttaagaaggttatattttatgttatgacttttagaatttgtctgtagttgtagagtgcattttttagtggtcattttagaggacagtattggttttgagtcttctcaaaacagtgctgtttattttcagagtgaaatcagattactgaaagatatttggggagcagaagcaaaggataatttgaacactgaagtttgatatgtaaaaatcagtaaaatgtatcaagaatatcaagatgtactaaaaatgttagtgacagaaagtagatttggggacatgattggttgagttctaatatatattctttgctaaatcccctaagggaggcagagctcccctaagaaccttgacgatatgcaagcgcctcaacttgataaaaagtgcatgtgaataagaaccattgtttgacgttgaattaattcatatacatagattataacttgatccaattcattgcccaacaaattcctaatgaatctaggaacaaaaaatttcaaatcaattacaaatattaaaagtctgcctaaaataaccttttttttttgtaaatttccagaaatgttcctgttgattattagctaaataaatccttacccaaatctttgtgattccattttaggtatttatacagcgcaagatgatccctgacttttcttccctgactatagtagtcttctcttctccaaactgtatagccttgaacttttccatttattatcattacttagattcttcccatttttattaatttcatagctcttttttgtgctttctgtatctatcttgtttatcataccacctgagtctgacatatcatgaacaacacatttatggggttgtagtaagtagaatgtactctattaagaatatttatattggcaaatgaatgtcattaatggcattgtgtcaaagaatagaccatctattgtttacctgtattataaatagatatttctatctggcttgtctgaagactttaaagtctttccagtattagagtttcattctttatactcattcagctttctagaaataggagtaaaactgtttttcttttactaaagtatatacgttaaaagtgtaaaggttttaaaaatatgaataaagtccttattcttgttaggagttaggcaaatgcaaaatgaaatcaccttttttatttttatatgagacaagtcatgatgttttctttttaatttctattttaagaattaataatatggaaagtgatggtagcaagagttttgatgataatataaagtatataatattataatgagaaaaatgtaagtgataaacttcttaaaagtgtgtgtgtgtgtgtgtatgtgtgtgtgtataaattgtgagccaacagctaaagactgggcatactgttcatttcaaatattggcacataggtgctataaaatgttatagtggaaatcccagtaagcaattcagttttatgggaattagtataagataataatatttaggaacactagatgtccctcaactccacagctacttaatatacttacgtggcatatgatagaaaaatctttactaaaatggcatctttatatcattgagggaagactcattattttaagaccaggtactaatgtaactcattatagcccttcttaagcagtgatcttatcaaaaggagcattagatgcttcagtgccacaaatttacgctcagatagttcactccaaactatgtcttaaatgatgaaaaccaaaaatattacaatgtagctataaaaagataagtttttcacccctaagtttgcattgttttatcagcatcattttatcgaaaaattttttcatttcttgatgttttttatttataccccatttgtagtatgtagttttgttagattaatgtaagtaaatcaattagatttcaatgcaacatctgttatataaaattatgttcattagcatacttactaatggccaaatgattaattgtcaaattcggttttgaaaatctgatgagtaattctttcaaaatcagatagtaatggtgtaattaaaatttttttaaataaatttatgtttaaggctaaaaattattattttgggaacaggtgccgtggattcagggtcctcctcctcttcctcctcttctagttttgtgaatggtgctactagcaaaaaccttccagctgtacaaactgttgctccaatgccagaagattcagctgaaaatatgaggtatgcatgactactttttattcattttaactctttttaaatgtagtgaaacagtacacaaaaatacaaaaatatagaaagagttcttgagaatgaaggttaattattttgtgattacatttcacaattctgatatttttggctagttattatgtaaaaatctatgatatatttcgatctaagcagagatcttcagtgattttaaaatgttcactgtcgtatagtgtatagtaattcactgtcatttagtgcatgttactatttccggtaaaggttaaaacatgtacaaatggtaacatgataaaattgggcatctttggggggtgataaaaagtttaaaatataaactttcaggctaggtgtggtggctcacgcctgtaatcccagcactttggaaggccgaggagggcagatcacttgaggccagaagttggagaccagcctggaaaacatggtgaaaccttgtctttactaaaaatacaaaacttagcagggtgtggtggtgcacgcctgtaatcccagccactcgggagggaggctagggcaggagaatcacttgaacccgggaggcagaggttgcagtgagcctagatcacaccactgcactccagcctgggttgacagagtgagactgcatctcaaataaataaataaataaacaaataaacaaacaaactaagtaactttcaaaataaatctacaatgttatatataacatcattggaacttgaataagcaaacattaccttatctgtcatgattaaagaccattcctagaagagactggccctcattcttggagtaagattgtgtatacgtgtacacacacacacacacacacacacacgtatgtattcacagtttttatagaagtataacacaaatatagaatataaaagcttattgaaagaatgaacacactcatcatcaacaaagtcaacaaatagactgtacaccaggaacgcctactttgcacttttttcccagtcactgttcttgcttttcttccaattccttaccctgacttttaatactaagctagttttgtcctttttgaattttatgtaaatgtaagtacatcctatgtatttctttgtctctggcttcttttgttcaacattatttttatgagattcatctactattgttgcatataacgagtttattcatttattctccttttatttatttatgtgtctataccataatttattaattcattttactgatgatgggcatttggaattttccatttcttagttattacaaataatactgctatatagataaggccacttataattactatgagtatactactattacatgtgtgtactgcacattaatatgcatatttgttagataatttggagtgtaattgctgattcgtagtgtttgtatatgttcagttttactagataatgcaaaatggtttgcaaaagtggttgtactagtttactaactcagcagctgattatgagaggtcttgttgcttcatatctttgataggacttagtatttagtctctgtcattttagccattttggcagaagtatagtggcattccattgtatttttagtttgcattctcctgataataaatgaggttgaatactttttaaatacattggtcttttgttttcttcttttgatttgcctgttgaagtctctagtccatttttttaaattgtgggcttttttttgtctttttctaattaattttttgaaaatgagccctttgtagattatatgccatacatatatcttcttccattttctggcttttcttatcattatcaatatggtctattttgatcaacagaagttgtaaattttaattaaattcactttataattttttggtttataagtgcttttggtgttgtaaatgctttgtctacattttccctgtcttgccttctggctgctttattctttgctttttatatttagatgtgtaatccatttagaattttttgtgactaaaatgaggtaggagtaataggtatacgaagatgacccagcaccatttatttgaaagacacttcttttccctgtgttctgtcacttttgtcacaaattagtttttcatatacacttgattatggttcagcaagcagctctgcctcatctctttgtctgtctttaagtcataccatcttaattagccttaggtttaataaatattgagttgagtaagatcttctcaccctgttatttttcctcaagaaagtctgaggtattcttgatgctttgcatttacatttatatttagaattagtttgtcagtatccattttaaaaacaacttgctggggttttcataagtaatggagtatttggatctattgcaagtggggctatataggtctctttcaatctgtgactaacaaactgtgattatcatatattcctaccatttccttaggtgttcttattttttttagtaatgatttttagttttctatgtggaagtcttagatgtttctaaattgatttattcttaggaattgaatattttgtatgtttctattttcctgaagttttcagataaacttcactgaaactatttgtttatattgttcaaactcaataaaaaacactcattttgagcatacattttaatgagttttgattagtttatgcatccacataaccaccaccacaatcaagatgtagaatatacccatcaccccgaaagttctgtgtgccctgtttgttattcactcctatctctgctccagggaaacactgaagtgctttttaacattgtgaattagatttgccttttcaaggttttcacatagatagaatcgacagtacatactatttttggtgtctgtcttctttcattcatcctaatgatctgtgatttatcgatatctttttgtttatgagtagtctattcctttttattggtaggtattatcccattatatggctattaataatctactcttcttttcacctgttgatagccatctgggttttcccattttgttgtagttataaataatgattctatagatatttgaaaacacgtcttggtgtggacataaattttcatttcttatggctgaacactaggagaaaaattgtggttggatagtaagtgtatgcttaaccatttgagaaactgctgagctgttgtgcaaagtagtagtatcattttatattactgtcagcaatgtgtagttctattttttccatattcttgtcagcacttggtattgtcagtctttttaagactttataatgggtgggtaaccatatctcatttggttttatgttttctttcctattgattaatgatggtgagtattcttttttgcatatgcttatgggccattgaaatcccttgctatcttttaaaatttttcttgagatatgagttctttatatattcttcatatatgtcctttgtgagaaacatgcagtctagaattttttgttccattttgttgtatatatttttattttcttaaaattgttaataacaaaagtttctaatttgacagagttcattgtctcaaatagtttcgtcttttatgatttgtgccatttgtaaatcataagaaatctttacctaccacaaagtcatgtagatattctactatattttcttctaaaataaaagttttgtagttttatctttattaggtttctgatctgttttgacttagtttttgtgtctgtggtgaggtaaaggttgggatttggctctgtctttatgtatattaatgttttagtaccattcaattaccttggaattgatttaaaatcaattgaccacctatgtgtagatctatttctagactccattctgtcccatgaactatatgtcactactgcactatcttcctgtatcgtagctttatattaagttttgaaagagatgatgtaatgtaagtcctgtaactattttttttttacttttctgggttaattcgcattttcatgtaaattttagaagtgacttgtcaattctaaagcaacaaaaaaagaaattctgctgaaattttaattacaactctgttgaaccttttaatttgaggagactcttcatcataatactgagtattcaaacttttgaaattgtcattcattgggatctttaatttttttcagcaacttattgtagttttcattgtaaaactcttgtacttatttttatgtctttttaaatttttatgtttttctaaattttcatgtgtttgatgatattatattagattttttgctgtaaatttccaattgggagttagaagccagaccaaaaagagtacatagtgtatgattccatttttatgaaattataggaaatgcaaattaatttatcttaaaaaatagcaaatcagtgattgcctgtgtcaattttacctcaataaaactgaaaaaaggggataattttgtattagtacattgatttttatatattgattttatattttataatcttgccacttacttttagtaaacgtggtaagttgtttagaactttctaaactcacataatcgatctaacactttctgtagtttccttattattttctatgcatgagataatgtcacttgtagctttagtattatttatcctaaaatgtttgagaattcaccagtacagccatttctgcctggaattttctttctgggaaaatttaaattatagatttagtttttttaattgataaatgagtatccagatagtatatttatttttgtatctgttttgttatttttgtcttcaatgaatttacccatcttatctaagttgttggatttattgccataaattctttgtaattttaaaaattttattattaatattttaaaatataagcatgatccctaatgatgttccctctttcatttcagattttgttattttgttttttctcattttttcattatcagaatagctattgcttttcaatattatgatttccccccaaaaatgatactgtgttcattaatatttttagagtgttttttttctattatgtgaattctgctcttattactcctttctatttacatcacgtttgcttgcttttttcttcccatatcttagagtggaaactgagattgagtgtctataaactgtggaccatgggccaaatcattctgccaccagctttgtacataaagttattggaatacagccacactcatttgcttatgtattgcctatcactgctgtcacattactgtgactgagttaaatagttggaacagagacgatatggcctaaagcttaaaatatttactgtcttatcctttacagatgtttcccagcccctctcttggatctttgattttagaactttcttgtttaatgatatggtatatgagcatttaaagccataacttttcctccaagcacagttttacctgtattgtacaaatgtagtattttttatattcaattcaatatttttttctaattttccctatttcttcttggattcatacactttacagaggtgcattttgacatttatcttccttcactaaaaatactgccatgcaatccattcaaattgttgcatgaattaatagtatgttccttttttatttctcagtcatattctatggtacggatgacagtttgtttaaacatacacctactaaaggacatttaagtttttttccagtttggggctattaaaaataaagttacagtggacatctgtttttatgtgaacatacatttttgtttctctgggataagtacccaagagtgagattacttgctctatggtaagtatatgattagttttataagaaactgcaaaactgtcttctagagtggcttaaccactttatgtttccactggcaatgtgtgagtggtccagtttctcctcattgttaccagcatttttttaagcattctgatagtatgtagtgatatcttactgtggtctgaatttgcattttcctaatggataaatatgcagaacatcttttcttgtgtttattttccatcaatatgtctccttcatgaattgtctgttcatgtcttttgcctattttttaattggatcactgtttaacttttgaactctgagagtttttgttatattcaaatacaagtccttttttagaaatttagtttgcaaatattttatcttagacgtgctccctgtttcatccttttaatgggttttttagcagagaaaaatttaaattttttttaatctggcttgtcagatttacctttttatagttaagcttttggtgtcatgtctaagagctcttcacctacctctactttcccaaaatttatattgtattttctataaagttttgtggtttaaaagttgttttacttttaagtctgtgatctattttgagctgatgtctgtgtaaggtgtgaggtttaggttgaggtacacatttttgcctatgaatgttcatttgttccagcaccatttgttgaaaaggctatccttgcccatgaggcatgtttttaagaccttttaaggcaaatttagagaggcctctcttcttggattgcttttgccacacttagaaagggtagacttgctagaatttctcctgaatgctcagtgtatttaatgagatctctcctttctggctggagggaatacagactattcccagcactatgcactctcagtgatgtttgtgttgcagctccttcataattattcttttcaaaaaattattctattctagcccttggagctttcaggcttcacataagtagattgctattcagcctaagactcaggttttgggaaatttttttcttcatagcttcctcctctcagggactctgttctgcaaattctattcaccttggccgttttgaactacagtctcagtcgtgtcaactcaaaaacattgcaggactcagtatttgccataatataggaaatacctccataaaggaaacatggatgatgggggagctcacctcattggtttccctgtccttagggttcatagtcctgtactccctgtattgcctgaaaatagttgttccctgtatttgtctaatatttttaactgttagcatggaaggtaattttagaccatcttactttttcaaggctacaaatgaattttatattcttatcatgttgtcaatgatttcttttataaattttaattcttttaattgtttccctttcagtatgttgacagaatatcctgaaatgttaactcacttattattcctaattatttttctatagattgtttcaaaatgtatatgtatatacataattctgtcatccacgaataatgggggagttttttctcccattaaaatccttgcaccttttaatttctttttctgaacttacagtgccacccagtacctctaatgcaatttattatagtcatggttatagcaggcattctttttaaattcttcatctcagatgaaaaacattgaacatttatcattaactatgatgcttcttacctattaattatatataattttcaataaatgttatacatctcttatatttgtaattaacaaaaacttgctatcatgacgtatgttgaagtttatcttatgctttttaaatatacactaagatgatcatgtggtttttctccttctgttaacatggtatactatattgatttaatttttaaatgctaaaagaattctcaatttctgtaagaaatccaatttcattgtaatgtgaaatagatttatctcttgaaagcttctataagattatttttttattttttcccctgaaatatttagtaaacttcacaagcaaagacacctaatcctggatctcttcttttaggaaagtttcttaattaaaatttcaatttaattagttacagatctcccaaaattttctatttttttctggtgtcagctttgttaggtttttgctggcataaagcttttcataatattattgtgttattcttttaacattcatataatctgtagtaatgtcccttctttttaatcttgatattctttatttaagctagccagcttgtctgccttcctgccttcctgccttgccttccttgccttccttgccttccttccttttcttgataagctctggcagtgattaatcagttttattcatattgccaaaaaaatgtctagagagaaataacaagaaacggttaagttgaaagttgtacattgtttgtttccttagtgcagtagttttctaacatcagcatgcatcagaataacatagagggcttgttaacatacagattgctggatacctaattcagtaggactccagtagggcatgagaatttagggcacctctaacaagtttttaggtgtgttagtcaagcttatttagagaaacagattaaataggatgtttacattcatatgaatatacatgcatatacacatgatttattataaaaatttggctcacatgattatggaaactgaaaattcccagtatctgcagttagtatgctaaagacccaggagaaccaatgtgtagttctaatcaaagtaccaaggtcggagaaccaagagagccagtgatacaagttcctatccaaaagctggctggctcaagactgaagaagagccgatgtttccgtctgagtccaaaggccaagaagagaccagtactcctagctcaaacattcaggcagaaggagtttgctcaacttttttgttctattcatatcttcaactgactagatgaagccttcttccatgaaggagggcagtctacctattcaaatgttaatcttatcaatagataccctcacagtcatacccagagtgctgtttaatcaaatatctggacacccagtaaaattgacccataaaattaaccacgatgctagatcatgctgatgctgctggtccagaatacacactttgagaaacagtgtgtaattgataatcctccacatcgcaggagttatccttgatttatcgaggtcctattcccagacaatgcatggcccttccttactctagtttaacttaatttaccccaaattttgcagacatacatgtacatatgtatgcatgtgtgcatgttcatcttaaattcacaccctgcaagaaagtatacttattttattggtcaacatctgttttgatttagccaaatgactatcattttttgttgctcatcattcttttctgaatgtctgacctccacctagtatcatatttcttcttctgaaagaacgcttcttagtatttgatttagtgcaggtttgcctgtcatgaatttttagttcctatttctctaaacatcttggaaatccacctcgatgtttgaaaggatattttgaaccaatagaattctaggttggcaattattttcttatagtgctttgaaaatatcattttattgtcttttggcttttttcattctgtgttttatttatttattttataggttaattcctagtcatattgtttctgttctccactccaacccacctgatgtctgttttaaaggtgttctgtattttgggagttgataagttttactatgatgttttcaggcgctgtggattttctttgtatttatcctgcttaagatttgtagagtttttcaaatctgaagttttatcactttcattcaattttgaaacttcctagccattacctcttcaggtattgcttctgacccattttatccttctgttagagcttatcttacataaaaattagactttttaaaaatacatttcttacctatctatatcctttccccctatgcctatttctctctcagtgattttgagtattttcttttaacctatagtctactttactaattatctctttagctgtgtccagtcttctcagttcttaatttcaagttttataagtactcaaatttccatttgacttttgtggtttaatattatcttccagctgggcgtgatggctcacgactgtaatcccagcattttgggaggccgaggtgggcagatcacaaggtcaggagttcgagaccagcctgaccttcatagtgaaaccccatctctgctaaaaatacaaaaattagctgggcatggtggtgagtgcctgtaatcccagctacttgggaggctgaggcagaagaattgtttgaacccaggaggccaaggttgcagtgagctgagattgtgccattgcactccagcctggcgacagagtgagacactatttcaaaaaaaaaaacaaaaaactaaaaaaacttccaattgtctatcttatccagttgtttatcttgatctttaatttccttgaatgtaaatatagttaccctaaagtctttgattatttatcagagctacctctgtcatcttgtgttacttttggtattcaataatatcttcctgtctacttatatttcttttcttgttattattatgtgaaaaacctatgtagtatctgaaagattataaacataatatgaaagtacaaagtggtgttttcttccagaaaaaaatgtatttttttctagtaagcattagcaatcctaaaggaccttaatgaagtcaaggttagagggccagtcttttttcgattcaccacttctttaaagtgtagttctataggatctcaacctatagaatcataaatcagataaacctatagaaccttacatcataagggtttttctaagctttttttcctctttagtaggctctgagctccaaaaattttgttgaatttcaatcattcagttgcttctaccaaaacatgtccatgggagaagagcggtccagaaaccaaaatcatcttagagtttcttcttcaggatcatggtcaaataattgacttctgtcttaactctccatttccctcagagaagtgtttttgattttgtccagcttttttagttgttctcagcaggagaatttgcctattactaaaggtagaaatccacattatttttatatagttattgtgtttatgatcatatattagatggagtgtaaatgttaaaatggcttggttttttttaatcactgatttcagctggattatgtcagatccattccttctgatccttaattatataatagaaaaatgtgtaactttttggtaatttttaagttgtataaagttcatccaattaaacattttcaactccttacatgactttctttattttagtgaagggttttgatggtaattttttcctttctttaaacttgtctatatttttatacttaaagcagttctgctttttaaaaaaatcaaactgacaatttttatattttaattggtatttctacatcatttgcattcagtataatcactgacatgattgtattgatatctaccaatttggtaattgttttagaataaattgttactttccatctgtactttattttctttttcttcttttatgccctctgttgggttaatggagtattttttttattatttcattttctctccaatattgtcttattgtagacaatatttcaaacatttttaaaatgcttaaaataaaagacaactttttaaacattttaggggcttctctacgacttacaatataaatctttaaattatcagactcagtttttaatattattacaaagtttcatgtgttaataaagatgcttgtaacagtttactcctaattcctctttcacatccttagtgttaatgttgtcatacgttttacttttatatatcttaacgaagaaacagtaggccgggcatggtggctcacacctgtaattccagcacttggggaggctgaggcgggtgaatcacctgaggtcaggaatttgagagtactagcctggccaacatgctgaaaccgcatctctaataaaaatacagaattatctgggtgtggtggcatgtgcctgtaatcccagctactccggagtctgaggcaggagaatcacttagaacccgggaggcagaggttacagtgagctgagactgtgccactgcactctagcctgggcgacagagtgcgactctgtcttgaaaaagaaaaagaaaataaacagtacactgctattttgctctagacagtgaattttattttagagcaattaaaaataaatgcattttatagatttatttatcttttctagcactcttgtttgtataaatctgtttttgtctggtatattccttatacttgaactacatttaaaagtattcgtagtacaaagtcagctacatgaattacctccgtttttgttgtctaaaaggtctttattttaccatctttttctaaagaattttttggctacatataaaattgtggacttatgtaattttaaaatggctttgaaagggatttcatctcatttcttctggcttgcacagattctaatgagaatgtcattcttatctttgttcctctttatggaatgtgtctttattctctgaatgccttcttcagattttctctttatatttgaatttcagcagtgtattatgttacatatttttttacttatttactaaaattctagttggtgttttctgggcttcttgtatctgtagttttatgacttcattgtttttggaaaattctcactcaatatctcttaacatatttcttctgctctggtatgtctctgtgttagttttctattgctagaataacacgttgccacaaatttggcagcttaaatcagcactgatttattaattatatcacagttctgtaggttaagagtccaacactcaggtcacactgggctaaaatgcagatgttggcagggctgcatttcttattggagactctgttagaaaatgagcttccaggctcactcaggttattagcataattcggttctgtatggctgtagaacacatggacctgtttatttgcctgctgtcagaggcttcccttatctcctagaattcgccttgcgcatggcctcctacattcggcattagtaataatgcatccagtttttctcaaacttgggatctgtctgttttcctcttatacgtatcttttctgccttcctcttttgctgtacttctctagccagagagttttctgctttttagaacacatgtagactgaacctacctacgtaatctaggataatctattttaatgcccataaccttaatttcacttgcaaaattctttttgccatgtaatatagtttattcaaagattccagggattatggtttaggtatctttgtggagccattatttggcataccagcatactgcacttctctttctgtgactccaatcacatttatataaaattatttgatactgtttaatagcttttgaatgcaccaatgtgcacactccgtttgagtgtgtatatattcttttttctttttgttttaatatgtctatattttattggcctatcttcaaattcactgagtctttccttggcttcattgagtcttttgataagtccattgaaggcatatcatttcttttactgtattttttatttctaccattgtttcttctttacagtttcttacttttgctgaaaatttccatctgtttatgtatgttgtctgccttttcagctattaactcttgacatgttaatcacagttattttaaattattttatagttccaacatagggttcatctgtgattttgattctatcggtttttctctggctttttttgtttgtttgtttcttcatgtgtaaggtaatttttagttgaaaactggacatcatgtataggatagtagttcctgacagtcgtatttgtgctctaaatgggtctgcctctccttatgctaaggcttttgtgagaggggttgagtcattttagtctggaattgagcagggtttatgttttcttgttgtttttgttactctctgtgtaccacggactttaaatttctctacttttactttgtgtttagttaggtgctagtttttcagagtgtcttactcactatttctgttctaccctgttctgattcagagaggttctctacactatgtagtcccttctgcaatagtagactactgttatctgttactgggtgcttgcaagcctggtgttcaagggttctcttttgtcctggtctagactccattttagtcaagtgctgtcctggatcttgaaggtagggctttttcagtgattttatgtatttctacatgattggggatctgtaaatttcaggactcagaacgtttcccttcccctccctcagagtagagggttttttatgttcctttcctccagctgcaacaggcctcctactgtgccccaaaagtgacaggatttgttgtctttctctcaaatgcataaggcttccattctgtagaggagataggaagaaggatctaggcagaactttgtatcttttctgcagcaattaattctccctcctttaacctggagcaatgaaggaagttttctgcagtcttccatgctgcctccaatttttctcctgaatactggttaggtttgaatggaagaggctgggcatcgttgcaaacgccccttgtgtctatagctctgggggttttattctcttatagttcacacatggacttcagaaatttatttaaaaaatttagctgatttttttcttgccagcttaatgtggtgcccagtgctgctgcttcctgttctctgcctcaggttagcaagttcatgcatcctaagtcttcttggagttcctatcctcagatttcaagctgtttggttacctagcaacctcagctctctgatgaggcctaacaaagttataattctttagattatctggctttttcttgtgatttttgtgggaatgactctagttttctacatctgaaatagaagtcctctatttaattttaaaagttcaaattcttagttgatttttcaatttatatattcaaaaatattatattttactaaatactacactacaaaatgctcattaactgctattccagaaaacaaattctttcggtgctttactggggaatattcttgataacaccacctgtaaataagtggcagtggaagattggtctgaaggaaaagtaatgcaattgtaagagatattccaggccactccatgggaaagctctgaaattggaatggctccagaggtgtcctcaattgggtcaaaggagctggggtttttcatttttcttctaattgaccattgtttgaattcacactgctcctaatgagggggcttaaccttgggtgaagcagctcccttctagggagggattcagctgtgagccatcaccccacagttctcctcagaactctccagggaaagaatgtctctatcctaaaagaggatcttggatcttggtgagacaccacagctcctactacattaaaatatttttttaaatatacgaaatattgtatttaggagcataaatgttattattacaattttcctgtcaaatatttaagatacaattagccttaccctttttatcactagatttgttgtttggttttagttagacttacattcttgagtttatatttttatttcactatagttaaattttgtgtcatttaatttaagtgattgactggaaacaaggaattgttctacatcttttttttttttttttttactttcgtaattagcacactccaaaaaacttttctaagttggggatgtctaagggcatccccaaaaaagcattacataatgtctattcacagatgcgatcatggcacacaacagctctgaattcctgggctcaagtgattttcctgcctcagcttcctaagttgttgggactagaggtttgcatcatcatgctcacgtaggcattacacatcttaaaacttgaaaaatgtttacttggaattttgtttacgatataaagcagtaaactttttacttataaaaatattctatttagcttcaatttcttagtcttctatagctttatctacttttttaaccttttcatcatgcacttgaaaataattctgtttaggagtaataaagacaaaatgccagttttaaatttataagatcacagggaagtaaaataagtaagcattttttttttcaatatcatgttttccgtagcggccacaaccttagaaagctgtaacttaataaaattgtcagtaggtaattatgtcacaggtttgcagatctaggatacatttactcatcagctattttagtatgttaaattatatttaatattagaaatttagtgacaacagacacagtatttgagttgtgtcaattcctagtcataatatatagctgataagaatttaactttacaatgtgtgtttattctatcattaatactctcttaatcttgtcttttcatctgtgtttacctaaacccaatcagttcacttaccgatgcctacatttcctcatttacataggagcattcaattaataaaaatctactatagaattcactagtataataatttcttttatgtctgagtaaatcttttaggtacaatacttaagggtatgtaattatttctttttgttctatgttttcttattataaactacctattttatatgatttaagaaatgaattaggaaatttaagcactctaatctttcaaatcgaattgttgtttattatatttgtgacattgtgctaagtacctaggagaatacaaaaagtaaataaaatcaaaaataagtaaaaatgactttatgaagtagcacaaacataagggtgtttgttaaaatagaatacacaatgtatgtagggccctaaataagaatagaattattatatttttctagaattctaaaacatataacattaagaaaagatcactttgttatgaactatgtttataaggggattcatttagatgacaggagagaaaaatcttcttttttttttttactgatttgtgtacttaaaattaccatggctttggatatttcttgaggccagttacatttggcaagatttgataataattaagccgtgggttttcatacattatttttcccatggattaattgtatttttattcatacgaatttcttagaattaagtgtgaatgagacttccttaatacaggtaaaagccaatacatgattgcagtttttaaaaaccataattgtaagcttttgtgttttaagtcatattgttttaatccaatcattggagctatagaatttcatctaaagccttattatttcctttgaatattttgttttgagttggtaattttgttagagtggtttataatttctcaagtttcagcaagaattttcttcatggaaataagtaattctctttttttttttttatttgtgtaaatttaagggatacaagtgcaattttgttttgtggatatattgcgtagttgtgaagtctgggcttttagtgtattcatcacctgaataatgtacatgatacccattaagtaatttcttacctctcgctcccaccttccaccctccagcctttccaagtcaccagcctccagtgtctatcattccatattctatgtccatgtgtatacatcatttagcgcccacttataagtgagaacatgtggtattcgcctttctgtttgagtcacttaagataatggcctcctgttccagtaatttaattctttttcttaagagtttacacttactattaagaaaaatagccaaattcaaaatagtcatcaatcaagcatcttaaacacatcattagtgtgacttaaggggaaaaaatagactggggagaatagaatgagtggcttgaaattgtatgcttttcaaaccacacttgataaagtctgtggttagagcccaagaacttaaccaaatattaagttattagagtataagattataaaactcactcagactgtgcagggcagattcccctacatagggaaatacacctttgtattacttctgtgcataaaatgtcttagactaaatgaatagtttttgtttttgttttctgtggcaaaataggggtcttgctctgttacccaggctagagtgtagtggcatgatcatagctcactgcagccttgacctcctgggctcaagctatcctcttgcctcaaccttttgagtagctaggatcacaggcacccgccaccacacctggctaattttttaattttttggtagagacagggtctcaccatgttgctcaggctggtcttgaactcctgggctcaagccattctccttcttcagtcttccaaagcgctggaattataggtatgagccaccatgcccagcctaaatgaatgtttttgaataaatgaaagtaaactttcagagaaaactcaaaaatcactctttagaattttcccctaaagtcagtatattatgccagtttttcttacaaaaataatttgctgaagaatacctggttttattctggtggctatatgttctttgtatttttattttaaggagaaaattttatttatttttataggacttaagggcatgggcttttctcacattaacatagcttttaatttatttttttacatattaacagatagctgtctcatgtgtcttggaattggggaaaaggagttttacattgtgtgtttctttgagatgagaatggaaataacaaaatgacaatatagccacaatatgtcttttttggtattttttgtaattaatccttattttcaggcgataaaggaggttcttaggctgaagtttatgtttgtaccattttctttcagaatttaaattgtgtaacaatgaagctaatttatacagcatttacaaccttctttggaatacattgtggggaatctgtaaaaagcaacaacaacaaaagctttcttcactatgaaaaatgaggatgaagtttttccatttagaatattttgctgttgtaattccagcagaattatttgataatggtttatatacataaaacttctaatctcttgctgagtaaaatattatattctttgccccctattagaaaattaaaattctcattgcaggatgatacgtaagagcaacatttactattctaataaattttataagaaaatatttgcaaaaaaatcttaatagggattcactttctgagaaatatctgtttttatctattaccctttagtcaagataatcgataataatgtatatttatacatacttacagaagtaatcagttgctcggattaattgaagttctattttgtatttaacttaatcaccagtaacagtatttttgtaattctgaagcctctaaatcacaccgaaatctgtaaaataggggagaaagttctcaacctaggataaaaaatgttcctggctttaactcaataatagtacattaaatccaatagctatgatgcaaccctccattaatcaataatttttataattttactctcacttattaatcttaaataaaaataatcatacttcatttataattgagcatcagaaactattatatctagatttttctccttttaataaactcactcttaccattcttaccatttcttagtagagggaattagtttagctgggaagagctgtaggacatgattctagagatttgaaggaattaatgaaattgtagattcaaaaaagaatctctttgtattcactaacaggtaacttactgtgattatgcttattcggtgacttcaggtagcctttcttttgcttgcttctttgttaattctttctaatagtaaatactctcattaaaacagtcattctcaaagtgtgtttcctggatcagcagcatcaacaccactgactgagaatttgtacttctaacaaatgcttgccgtacacacagacctgctgaatcagagactagggtggggctcagcagtctggttatacagactctccagataattctgatccacattaaagcttgagaaccagtgtcttcaggaggtccttgctttaggaattacagagtaggggagactattgaaatctcttaatttcagtaagtctgccaaatccccttcaaatccctttttcttacgggaaaatgttcctccagaattttctaaatatatgtggcagtgatcaaacttgagttttctccatggtttctcctttctctagagctgttgacacgggtaagaggagacagagttaaacagaagtgctgatggtgatacttagagtgctcaaagatttgaaacttggctgtttccaatttaggaaagaagtcatccgatattattctctaatagctatttaattgcttaaaaaatttaaaaagaggccatagtttagttttaaaccttagtaatatattgcaaattattttatggttaattacctttttttcatttataaatttttgcctcatgtgtaacaaaatgttacctggcattgtggcagaccttgtattattttgtaacattgtttaattgctaactgtacatatcgtctgtgtagaagaatgtgtactcatctaatatattgactttggtttgtttaatgtatcagaatcacattttgtgagtgtaaatatgggtgtgttcaaagtagagcaaaaaagtgaacattattgacctctcactgtgtgctgggtgcttttctgtgcactttatatcccttagcttgtttaatcctcactgggtaggtactgcaatcatcttcattttgcagacatagaaagcctaatgtgcctaaggtcacctagctagtatatgatagagccaggattctagtctaagcagtcttactccaaagcacttttatctaagacagataaatctgttactatgttattcatttgtctaagcagaaatattttcctcctccccattttttacttttacatgtaccaaagtatttttaagaatgtcaagtagtgcttatgtatggctattaacttaaaattcaacagtgaactatataataatacagcagtttgtaaagaaaagtaaataggcttatgaaatggaaaatgcctactttggcaaagcattcaactgtattacaacgaatttcagttattcccttatttgtccagatttcaggtaatacctccttgagagcaagaattaaattatttgtaactggcacagggacccacattgtcagtgttccagatcattttctttgatggatagatacatagagaaggcatacaaaaactcatttacatgacgctcatagagcggtggacagtctttggccctttcgggtggcataaccccaattctttttcatagtatagtcattgcaatttagctgaaacctttcagtagccttatgactgtttgtgaaactgtacagggtatcccttatacatgaagcttgttattattccatgggctagaaaggacatttatgatttttaaatattttaatttagaagtaaagtttatttgacattttatattgaattatatttattagtttttatgtcttaatttcaacagcatcactgcaaaacttgaaagagcgttagaaaaagttgctcctcttcttcgtgaaatttttgtagactttgccccattcctatctcgtacacttcttggcagtcatggacaagagctattgatagaaggtatgatttctctattataattattttagtttcctataatgtatgtattaatcatggcataatttgtgcttctggaggaatatatatttccaaaagaatgtaaaggcattacttcacaaattctaataagatattcaatatgttttctcttcactcattttttttaaataacatgtttgcatggtcaatgccagtaagaaaactttgaagatgaagaacgttgaaaaggtgtcagaatgggaggctttggctctttaatccatctatcagggctgatgtatatcctgtcattaagataacctgtttattaagcagtgatctctgaaatttccttctgactctgagagccatgcacctttaagtgatttttcttattcacataacatttgtagtgtgggaatccttaactaagaagacattaaaaatctagagaaatacttaacaaagaattgatgaacccattgtctcctcaacagcagcttacatacagtaaggaggcaaaggagaaaaatttacaaggagagtggctttgaaaaatatggttaatcaaaatcgtatttctttttaaaaagttttgttttatgaatatttctgagcttcagaaagaattagataatatcaagatgatctgtaggtgaataatggctttagatgctgtttcaggtagtcctgggatttagcatccttgtatatcttttttgcttttcacttcctgtttactgtagaagaaagagagttttcctgtgcctgttctgttattgtcccaactgcttctacacagtgtttctattaggaagactgtgatagttaatgactcggcatctgggagctgactttgaatcctagttcaactactttcttagctttgtggcctttgtgaattacttagccactttgtatcttagtttcctttctataaattggagtcagtgatacagcactttagggttcttgtgaagattaaattatgcaaggcatttgaagctcttagaatattgtcacataatgagcttctcaggtttccaaaagtactgagttccttctgggctaggtactatgttacatagttttgatatattagtaaacagacaaagacgcttttcttcagatggagcatatattctaacaaggacacaaaatcaataagcattaaacaaaatgaataattaaattacatagcatgctagaagatagtgaatgttatgtaaaaggataaatacaacacagagaattgggattacagaatgacaaggttaggctgaagtttaaagagagtggtcaattttaaataggcctcatggtaaaagttacatttgagcaaaaccttacataataagtaataaaacttacttaataagtgccatacagcttattagatgaggagtgttctatgcagagagaatagtcagtacattggccctaaaatgatagaaagatgttcttggtatgatctaccaacagcaaaaatgccagtctcatgtgaaccagaaggacagtagtcgaatattagggccagagaggtaatgggttctttggctttaactagtgtgttgtagggaggctgctgatgttttaagtagggctgtcaccctggatgctactattgtcattattatactcccacctacaaagtgaagtataaaatgctctgaagaattggattctgagaagaaccatgctaattcaaagcagccgcaaaatgaactttaaaagttcttggaagcttaaaaactattgcttggccgcagattgtgtgtgtaatttaaatagctttgttctagatgtgtatgattgactacacaaaatcatgtattcattgattcattcaaaacagaagaaatattcctcatggagtttgcagtctaatgagcaaagagacataaaaaccaataattaaaattaaataggatatgtgctataatgaaagtatatacaaaggtacagtgggaaatgagactagatggcctactgaccacttgcagggcacatattcttctaactgggtcagtgaggtagttgtgtatacctggtcttactcctgctgccataaagccacttcctcatctttatgaggacacaggtttgaaagggttatgttccctgcttctacctaactcctgtaacagctcaacccagtcttctgaattccagacatagttgaagttacctagcatagacatctaaagccatatactccagggatacctcaaactctgtttatccaaaatttgttttccctcaatttacttttccttctaaatgtatttattttgtcattagcattactattaatgcaaacatttgaggtgaaaatttgatttttctttagctcttttctccttcaactttaatatttacaattacttcatgagaatgaataatttccgaaaacaatatttagaggatagttcttcaaatattattaacattacaaatattatatcaagccatgtataaaaaccttccaaagtagcctaaatattatgttagctaaaagtggtggcatcatagttacggattctaaaaggtactaggttatcagttggtccttcttgagttcctttttttgcttttaattcttttgatttcctgtagttagatgctattgaggagcaagaatgctggttattgatatttttattttcatgcttttctgtaacatgtgttactttattaaaataaagaagttcagtaaacatcattgaaaaaacaaatcttaaatgtttcctcattccctacaagataaaagccttttattttttctgttgctatctatcttttcctaaaatgatttgataggttttacagaaatgtataaatactgaccaaagacataataaaataaaacagggaataaagttagtcttgtaataataatgttagtagtgagtcctgcaatgttattaaaactaagacaaattctgtgcaagttttctagccgccagagcaaaggcacaattatgttgttataagactcacgttactggctcctaagtgatagtctgtggcaattttatgttaactgctctgtattggaaaatcaggaacccctgtgtgtagttatttcccagaatcttccatgaccacacattcacattgtttcttacttatttcttctcatcaatgcacagagaaaaatgattgagtaattgagagttattttttttagcttctctgtttacctcacatattctgaattgagtggaaagaccattaagaacatgccttcattgttatcagtgcatccaggtgaacctggatttttttttaatgtaactatgctagaaatgaaatactggaacgggttagatattaaaaagttcattttgtgttcccctggcagtatacaattatatcttgtaactttctacattcaaagaattttaatacatcctactttttaaactatatggatgtaatatttatgtctttctttgctgatgtttaaaatgacttctctttataaaatgatgacagcaaatggtagatttttaggttttgagttttgctttttaaatgccagtgacttggcagtataaaaagctgacaaccctaaaatatgatcctttaaatttttgctagttcatacaacccagaactctggaaactatagttgtttaaaagaatgactttcagtatccctcacaatttggtcataaccctcccttccagacccaactagtctttatcttcttgctataaaaaaacatttcttaaacatgtaaagaagttacatactatcacatttccttgtttttgtacagctcttctttctgcatttaatcctttttgttttgttttgttttgttttgttttgttttgttttgttttgttttgttttgtttgagacggagtcttgctctgtcgcccaggctggagtgtagtggcactatcttggctcactgcaagctccgccttctgggttcacgccattctcctgcctcagcctcccaagtagctgggactgcaggtgcctgccaccacgcccagatatatatttttttttttttgtatttttagtagagatggggtttcactgtgttagccaggatggtctcaatctcctgacctcatgatccgcccgcctcggcctcccagagtgctgggattacagccatgagccaccccgcccggcctaaaccctttttttttttaaatctccccaaattatactcatcctttgagtccattttcaggctcattaagcaaattaatgtcatgacttatgtgctcctacagtattttacttacataatattaataaaattattttacacttattgaaataggaaatatcttattgtttatattgtcattacctaacttagactctggtacatcataaatattcagtgtttttcccttgtgtttgcataggatattatttttctttcttgggaggcgaaagcagatgtattgcttgaggccaggagtttaagaccagcctgggaaacatagttagaccctgtccctagaaaaaataaaaaattactcaggcctggtgacatgtgcctatagtcccagctactctggaggctgaggtgggaggattgcttgagtgggagattgaggctgcagtgagccacgatcgtaccactgcactccagcctgggcaccggagaccctgtcgctaaaaagaaaataaggaaggattggtaagattttatgttctgtggtaagaactcctggtattgatcagttcttcagacctaggagtttgctgctgcactcatccaaggtccatacttgctctccaccccagcctgtagaaatgtatgtccttttattttctcattcttgagcatgtactcttactcattctttgttcttcgctctccttctgtttcccttctttctctaatttgatatgcttttcctttcccttgagaagaaaatgtatcaaagcattatgaagaactcaggacatttacatgataaaaacatatttaccctagctttgaatatttccatttaagaaatagtgcttatgatgaataaatctcactgcatttcaatttaccatataaatatgtgtgtgtgtggtaggaacaaaactgaatttaggtaactgaagatactttaatgtctatgaaaagaaaaagcaattactcttttaacttcaaatagccataaagtatatttgaattgcctctttattttatgttttatattccatttttcttaaggcacacatttatttttgtttaaattatttcttatgggataattaatccttggcagtttttattgtcggtgtcctttcattttcttaattatctattactttgattagttagcttgtgattgtatcattctagaacaatgtagttcaccttttaagaccattcattaacagtagctatttttaggtagcttttgatgtgtgttttctcttagcaataattaaggatttttgaagacagtaatttgaagcttactgaattttaagaaaattatgggttttcaatttataaactaatgcataaaaactacttagaataggtatgtatgcaagtatcaaaacctaccagccaaagataacaaagctgcctaagaatccagtttatgttctgtgagcattgtttatgttctattgggagctcacagaaatattcagagtaacttagttatgatgcggatatagcagaaagtctcatatgtgtccaaggacaggaaataaaatatagttgatcttcaggcagcctggaaatgggagagaaaagtcagtaacaaagactactccctttgattcgcaaagcaactttatagcctcctgtcttttattctctctgtgtatctactcagtgtttttactttcctcccagaccaacttctcttgcttagtcatcagaacatctcttagcatagcaccttagccctgaatcttaatgcatttttaatgtaaatatcctgcatcatctaactatagtcacttaacttatcaacagagaatctgaatggcttagccaggcctattactttgttcctcctgggttaggtgtctgaccctgtcataatcagctaagcctgaggtgggatagaggtgtctgagatacatgaggctctcccttttaggctctatatacaagttgaaacattttagaaagagatgttagcagtgcaggaaatttcactgaagggtccactctacttttggtggcatcaataaatattttattaaaatcatataatactcaagaatatttatggtttccacgactagcattttttaaaagtatataaatatagcatgaaatttctaccttcaccaaagaggatatcactgacatattctaaaatgaatgagcctagtcaagaagctccatatcattcacagatcatttgtagtagcattataggcacataatcagaaaaacttgccgtatttttatttaaaaattatagactaaaatataatttcagaattattgtttttaaattacaataatacaaaaaaatgtacacaagaaaattgggtaaatggaaaatgctggcataatttttaaatattcctgatttcctccataaaaaatggatggaagaatagataatgaaacaataactacaagaacaatgaatggacatttacaacaaaactaggtgacaggtatctcattggaccccaaaatatgcctaggtggggaccatctagcttatagctacatgatatacatgatatcagcttatttgtggcaaggactcatggtggccatcaaatatagatctatttggagaattaactaaatgagggttatataggagaaattaaaggatatgactgcttattctgaaaaatttgaaaaatggggcagtaattatgttggtagtaatattatcgatattacaaaactgttatgtaatgttggataaagctgcttggtaattattaatattctaattattttatcccgtgttcttgaaaatcaggattctggctgaagaaaggcgatccagatataaaataggagagtttaagtaaaagcttttaatttggaatttgaattggacattttcatgtaaacttatgcatacatatgcatgtacatgcacacatacacgcatacccatattctataggtatatgtatactatactagtagccctgtctgttgttttgcctggacacaaaaaccaagtcagtagcagtgagtacacttagggtccatatttactattaaaatatcatttgccaatgaaagaaactgggactttatcatagagaaataagtgatgtcaaggctggggcaggaaatattaatcatttacctgcaacattttgtgataccacaaagcaaggaaggtatcaaatgttgtcagaagagctcaggagctaacttaaagaaattcctgttgtcccaagatggagcagtttgagcatccataaatctattaggttggtgcaaaagtaattgcgattttattagcaattggcaaaaatcgcaattacttttgcaccaaccaataataactgcaatgcattgaaacacctggatatgtttaaatctatgtattcgtaatgataatttagaaaatgattttgtcaaatttagagaatgatagagaacttactttgaaaactgataagaaaattaaaagaataaagtatttcttatgtcctttctttgtgaacggatcattgtattatgaagttattgaggggggatgttttgtttttacaaaaatatatcatctgataaatagtggtgggatatgtgagttagattatcgtttagcaccctttaagaatttaatagatctaagcttcaatggctgctaaactcacaaatagagagacagctagacaattagataggaaaaataccatcacctatcaagacggtatgtatgaatgaatgaataaaataaaagcacacctgattaaatctgtatattcaacgtgttgaattataccatgggaactcaataatcaaaattaatactggaggaaattctgcaatacaaattgagttggtctcttcaaaataaattacatggggaaaagagatataggaagaacctgtagcttaaaagagatttttttttaatttcaaaaatcaccaaaactaagttgtttgtagaaataactctatgatttaggtattaaaaactataatcaaaggcaaagtgattatcataaaaatcagaataatggtttgttataagtagggagagggttagaatgggaaacatggagtactcctgggatacgtggtaataatttatttctttagctatttagtggttgcaaggatgttcacttcataatagtttattaactgatgttttctgcagtttacttattaatattttgtaataaaatattttaatgttctctggagaagatataaaaattcttgaatgacgttaaagacctaaataatggtgaactatatcatattcatggtaggaaaactcatcacaaaaaagttatttcagtccatgttaatatatcaattttaataaaaatttgatttaaaataatttttaaattattttcatggaatttaataagctttatcttaaatttctgagcagaataaagggatgaaaaaatcgagtaattttggaaattaacaagctattatagttaaaacagcatagcagtagcacagagatagatcagtgtgtcagaataaatctccaagaacagatcccacatacatatggtaacattatgagacagagctccattgtagactggggagaaatacgtgaacagtggatctagatcaattggattcccttttgttaatttaaaagacaaaacaaagtggatctcttcctccctgaacaaacaaaagacactaccactgtggttgaaaatcaaatatcaaatgtttcaggagaaaaaaacataggaaaatatctgtaataccaaaggtattatgtaaactagatacaaaagcgtaaagtgtagagggtaaaaaaatcaccatattaaaactgttttgttttatcaaaacaacattaaaaagtgaaaagattgagagtaacatgagcaatatagtgactacaaaccttgaagtcctcattctcccaaagaaaaaatgaatgtacaaaaatacatggaccaaattagtgttgttagaaagctaataaatcaattaagattcattagatcagataagatgttgcagcaatgaagtaaacacctagctaagacagagctactcaaaacgttaggaaatccattgctattttgtttgcccttatcccacaccctcctcaacacagtgcagcatacatgataatgaggaaattgctcagttcccaattactcctttggggtggaagggaaagaatggaacttgcttgcaacattctcactaaagactgagaagtgactatattttttaaaagcccgaattttaacaaaaatagtacaacgcactcaaagaaagagagaaacatagttcatgcaaaggaacaaaacaacttccagaaaccacgtttaaagaaatgtcggcctctgacttcttttaaaaataatttaaaacaactgtctttaatatgcctatgagccaaaaggtagcagggactgtcaactaaacaaaattaggaaaaggttttatgaacacaaggagaatatgaacctaaagaaattatttaaaagcaaaaactaatttgaagctgaaaaccacaaaggaattaaaaaattcattattagggttcaagagtagactcaattagacagaagaaagaatcagcaaacttgaagacaggtcatatgaaattactgagctagaggaccaagacaaacagaatgaagaagagtgaacagagcctaaaggaccacatcttcagacagactaacataggtattatggtagttgcataaggaaaagaaagagaaaagggcagagagcgtatttgaaggaataatggctaaaaaacttctcaaattttaggaatcagacatacgaactgaagctcaacaagctcccatgggataaattcagacacatacagagacacattttaatccaactactgaaagtcaaagataatctcaaaagaagcaagagaaaattgtacatgtacaatgagcctctataagttatcaccaggtttctcagtagaatccatgcatgctggaaggcagtgggatgatatatttaaagtgcatgaagtaaaaagcaaaacaaaacaaaaagaaactatcaaccaataatactacctccagcaaaactgtcctttaaaaatggaggagaaattaagaattttccagataaacaagagctgagagcatttattactactagatctaacctacgagaaatgctaaagggagtccttcaacttggaaagagggattctacacagtaactcaaagccatatgaaaattaaaagttctacaatagacatattacaaatatgaaaactttattattataattttggttctactattcttttaaaagattaaaatccaaaaatgtaaaaacaaacctatgaatctatgctaatgggtaagcaatatataaagatatgacttgtgacataagtaacataacttgtgcagatgactgagctgtaaaggaataaagtttttatatgcgattgaagttaagttgttcagtttaaaatgaactgttataattttaagatgttttatgtaatccacatgataaccacaaagaaaatttctatagaaattacacgaaagaacaagagaaaaagcaaatcacaacaaaattcaactacacacaaaggagggaagtacgggaagaaataagagacaaaaatacaatgacatacagaaaacaacaaattaaaatagttcttcctctttcagtaattattcaggatgtaaatggataaaaactcctcaatcaaaagacatagattagctgaatggataaaaaatcaggaaccaactatgtgctgtctttaagagacactcactgtaaatctaaggacacatagaagtttaaagtgaaagagtagaaaatgatattctgtccaaatagtaaccaaaacagaacagggatgtttaatataagacaaaataagcttttgaaactgttaaatgagacaaggaaaacaatatataaggataaaagggttatacaaagaaaatgtaacaactataaatttatatgtaccaaacatgagagttcctaagtgtaagaagcaaatattgacagacttgaagggcaaaaaagttctgcaataatcgtgggagacattcatatcccaatttcagtaatggataaagcaaccaggtaaaaggtgaataaggaaatggatgacttgaacaacactatagatcaattggacttaacagaccaaagaatacttcacccaataacatcagaatatacatttttctaaaatgcatatggagcatcctctaggttagaccatatgttaggtcattaaacaagtcttaatacattaagaccatatgttaggtcattaaacaagtcttaatacatttaaaactattaaaatcttacaaagtatcttttctaatcacagtggaatgaaactagaaataaaaactagaaggaaatgtagaaactccataaacacttaaaaataaaacaacatattttgaataatagaaataaaaagtagaaggaaatttagaaactccataaacacttagaaataaaacaacatattttgaatatgccactcaccttataaaaaaatcaatatttttttataaggtgagagatgaggatcaagttttattctcctacatgtgaatagccaattatcccagcaccatttgttgaaagagtatcctttccccactttatgtttttatttgctttgttgaagatcagttggctgtaagtatttggcttcctttctgggttctctattctgttccattggtctatgtgcctatttttataccagtaccatgctgttttcgtgactatggccttatggtatcatttgaagtcaggtaatgtgatgtctccagattgttccttttcgattagtcttgctttggctatgtgggctcttttttggttccatataaatttgaggattgttttttctagttccgtgaagaatgatgattgtatttcgatgggaattgcattgaatttgtagattgcttttggaagtatggtcatggtcattttcacaatattgattctacccatgcatgagcatgggatgtgtttttgtttgtttgtgtttatgatttccttcagcagtgttttgtagtttttcttgtagagtactttcaccttttggtattttattttattttttgcagctattgtaaaggggttgagttcttgattagattctcggcctggtcactgttggtgtatagcagagctactgattcgtctacattaactttatatactgaaactttgctgaattcatttatcagttctaggggctttttggaggagtctttaggtttttctttagggttttcagcaaacagcgacagtttgactttaccaatttagatgccctttatttctttctcttgtttggtctgatataagaatacctactcctgctcacttttggtgtccatttgcatggaatgtccttttccacccttttaccttaattttatgtgaatccttatgtgtcaggtgagtcttttaaaggcagcagatacttgtttggtgaattcttatctattctgtaattctgttttttaagtggagcatttagaccatttacattcaatgttaatattgagatgtgaggtagtattccatttattgtgctatttgttgatgaatccttttttttgtaattttgttttataggttatgtgagattcatgctttaaagagtttctgttttgatgtgtttccaggatttgtcaagatttagagctccttttagcggttcttgttttgctgtcttggtagtagagaattctctcagcatttgtttgtctgaaaaagagtgtatctttcattcatttatgaagattagtttctctggatacaaaattcttggctgataattgttttgtttaaggaggctgaagataggtttccaatcccttctagcttgtagggtttctgctgagaaatctgctgttaatctgatatgttttcctttataggttacctgatgcttttgcccaacagctcttcaaattctttcctttgccttgactttaggtaacctgatgacagtgtgcctaggtgatgatatttttgcaatgaatttcccaggtattctttgagtttcttgtatttggatgtctagatctgtaccgaagctggagaagtttcccccaattattcccctaaatatgttttccaaacttttagatttctcttcttcctcaggaatgccggtcattcctaggtttggtcatttaacataattccaaacttcttggaggctttgttcatttttaaattcttttttctttgtctttgctggtttgggttatttcaaaaaccttatcttcaagctctaaatttgtttcttctgcattttcaattctgttgctaagagtttccagtacattttgcatttatctaagtgtgtcctttgttttctgaagttgtgattgttttttatatatgctgtgtatttcactgaagatttctcttgtcatatcttatatcactttttcaatttccttaaggtagacttcacctttctctggtgcctccttgattagcttaataatcaacctgaattctttttctggcaattcagggatttcttcttggtttggatcttttggtagtaagctactgtgattttttgggggatgttaaagacccttgttttgtcatattacgcaaattatttttatggttccttcccatttgggtaggctttgtcagagggaagatctggggctcaaggctgctgttcagattcttttgttccacgcggtgctcccttgatgtcatattcttccccttttcctagggatgtggcttcctgctagccaaactgtagtgactcttttttccctctggatccagccacccatcagggcttccaggctccaggctggtactgaggtttgtttgcacagagtcctgtcatgtgaaccatcttcagttctctcagtcgtggataccagcacctgctccaatgaaggtggcaggggagtgaaatgtactctctgaaggtcctcagttgtagttgtttaatgcactagttttgtactggctggcaggaggtggtgctttcaagagagcatcagctgtgatagtatagggaggatcaggtggtagtatagggaggatgggcagggccctagatctccaaagagaatatgatctttgtcttcagctaccagggtgggtaaggaaggaccatcaggtgggggcagggttaggcatttctgagctcagactctccttgagctgggcttgctatggctgcaatgggggtgtgtggttcccagctcaatggtgttatgttcccaggaggattatggctgcctctcctgtgtcaagcaggttgtcagggaagtgcaggaaagccagcagttacaggactcacccagttcccactcaacccagatggccggtctcattccaaccatgcctctcccaacagcatcaagtttgtttccaggcagtgggtgagcagggctgagaacttaccccaggctaccggcctcctggcccagaaagcaagcagggcttctgcgtctcctgcctgtcatgtcttcacactgaattcttgccttcccccaagttctgccaggaaacttcacattcatttggaattgttacaaaattcagctggaggtttccttctccctgtagtcttttcccagttcctctggcagccctccccaaagaccccagtgagacacattaggaatggcttccctggggacccagagaacccacagggcttttccctgctgtttcctctaccctgtattttgcttggctctctaaattgtctcagtttcaggtaaggttagaatcttttccagtgatctagaccctcacgttccccagtgagggtgtgcattcaggggcagatgatccccttttcccactttcacagtttggacactcacagtgtttgggctgtctcccaggtcctgcaggagcaatccacttccttcaaagggtctgtggattctctcggctttcttggcatattcatcttgaagcaaaagttgataatgtgagtctccacattctgctctgtctatccaagtagaagctgcaatttagtcttgcctcctatctgccattttttcatctcccccaaaatagtttattttattaaaaagatcaacaaaattgaaaaacctttagcttgatttagggaaaaaaaaagaagattcaaataaagtaaaaaatgaaagagtaggcattataaccaatgccacagaaatataaaaggattgattataagagaatactatgaataactttatgccaacaaattagatacatagaggaagtgagtaagttcctggaaccacacaacctacccagatgaagaaacaaaccatcaacagacctacaacaggatagaatatttgcaaactcataatataaggtcagcattgccctgatattgaaactagatgcagtactaaaagacaactataaaaccaatatccattgtgaatattaatgcaaaaatcttcaacaaaatactataaactgaatttggcaacatattaaaaggattatataccataaccaagtaaattttattactgaaatgcaaggatggttcagcatataaaaattgatcaatgtaatacatcacacagaatgaagaaaagaattacatagatcatcttatttaattagtttactgtgtggggaaaaaaagccctcttaaaattcatatggaatctcaagagacccagaataaccaatacaatcttaagaaagaacaaagctgggggactcacaggaccgattttaaaacttctacttacatagctccacaagtcaaaacaatgtggcactggcataaagacatagtagaccaacggaatagaatctctagccaaaaacaaagcaaaacaaacaagcaaacaaataaacaaacaaaaaaagccagcccttacttatatggtcaaatgattttcaacatgggtgccaagaccatttaataatgaaaggacagtcttgtcaacaaatcatgttaagaaaacttaatatccacatgtaaaggaatgttgttgggcccttacctttctccatataccaaaattaactcaaaatgcattaaaaacctaaatgtaacacccaaaactgtaaaacgcttggaagaaaacaggataaaagcttcatgatggccgagcgtggtagctcatgcctctaatcccagcactttgggaggccgaggcaggcagatcacctgaggtcgggagttcgagaccaccctgaccaacatggagaagccccatctgtactaaaaatgcaaaattagccgggcatgttggcatattgctgtaatcccagctactcaggaggctgaggtaggggaattgcttgaacctgggaggcggaggttgcagtgagcagagattgtgccattgtactccagcctggacaaaaaaagtgaaactccatcttacaaaaaaaaaaaaaaaaaaaaagcttcatgacattgatgacattggatttggatttggcaatgatttctttctaaaatcagaaatataggcaacaagtaaaaatagatatattggactacatcaaaattttaaacttctgtgcatcaaaagacacaatcaacagagtgaaaggcaaaggcaacctatggaaagggagaaaatattgcacattatatatctgttaagagcttattattcagaatgtataagaactcttagagttgaacaataaaactacaaataacccagtttaaaaatgatatagtcaaaagcacaagaagaaaccttacactcattaagcacaagaagaaaccttatacccattaagcacaagaagaaaccttacacctattaggatggctgctatcaaaaaaacagaaaataataaatgttgacaaggatatggagaagttgaaaactgtgtactctttgtgggaatgtaaaattgtgcagccagtatggaaaacagtatggcattttgtcagaaaataaaaaatagaattaacatatgatctagaaattccagttctgggtttatagccaaaacaacttaaagcaaggtttcaaggaaatattatttgcgacctacatttatagcagcagtattaacaaatggtcaagtcgtggaagcaacccaagtttctatcaacatatagatgcatttcaaaaaatgtagtatatacatacaatggaatggtattcacttaataaaaaggaagttctgacacatgttgccacatgaattcaaccttaaggaaattatactaagtaaaataagcaagtcacaaaaacacaatactgtatgattcacttacacaagttatctagagtagtcaaattcaaagaaatagaaagtagaatgttatttgccagtgactgggggtgatgggaaataggagttgtttaatggggtatagagtttcagttttgcaagatgaaaaacctctggagatgtgaatatatttaacactactgaactgtgtgctttaaaatggttaagactaatttttatattatgtgtattttactacaattttaattaaagtgaaaagtttacccatagactggaaaggtatatgtctaacaatgataatcaacaaatgttgatatctagattacacaaagaaactcctaccaatgaataagaaaagcacaattctatagaaaaaatgggcaaaagaataaaaatctgttaatttgtggatgggttaaatacaagcagtcagtaaacatgtaaaaaaaagtcaacctcatttgcaatctcataaatggttaataaagccaaaatgaaacaatttcactcccatccaataagtataaaatttatacttaaaatccatttattaggaaaggtgtagagttttctagtgggagtctaaattgatgaaaccactttgaggaataattttgcattatcatgtaaagttgaatttgtaaatgtacattgactcagcaatttcattcttgggaatataccatggaataatttttgcatgtgtacacaagaagatacagatgtaaaatgcttattaaaaacagtgactttacccaagacatactgagaacaacctaaatgtatattaaaagaaaattgtataattaaatggtatactatgcagtagtgaaatgggatttcacaaaaatgatatttaccataaaagcttaacacatggataaggatactgtatcttctttagggacacattcataagtgataaaaatataaatgccaatcaagatgataaatttacagtagttattacatctaggggaatggtatcagtgctgtaactctaacgttcatgggggatgcatgtggacatcagaatggaagcaggtgtaagggttccacagaagaaaacatggctgccaaagctcagcctggccttagccattgcacgaggcatggtgaactctgccttctataatgtggatgctgggcacagagctgttttctttgactgattctgtggagtgtgggacattgtggtaggggaggggactcactttctcatcccatgggtacagaaaccaatggcattccactgctgctgtcaaccatgcagtatgccagtcgtcgctggtagcagattcatagtatgccagcatccctgtgcatccgcttccagcctgtcactgccagcttcctcacatcctcaccagccttggagaggactccaatgactgtgtgctggtgttctgccatctgtcactacagagatcctcgtcagtggtggctcactttgatgctggagaacttatcactcagagagagctgttccccaagccaggtgagtgatgaccttgtggagtgagcagcggccacctctgggctcatcctggacgtcatgtccttgatgcatgtgaccttcaggaaggcgttcacagaagcagtggaagccaaacaggtagctcagcgggaagcagagatggccagatttgaggtggaaaaggatgagcagcagaaagaggcggctatcatctctgcctatgatatggctccagagcaactcactggtgcccggggatgactacccgatggagctgtacatgctcaaagccaccaagagcgttgcttaccagctcttgtgctctcagaatgttacccacctgcccacggggcagtccatgctcctccacctgctctagtgctacctgcacctccgcgggccaactgggccacagctctgatgattgttaacaccagccttccttctgctcccaccccagaaatcactgtgaaattttgtgattggtttcaagtgaaggaaataaaagtaaaatcactccagatctctaaatactctatcaaatgaagcactttcatttttctcacatccatctacttttttatccacttctgtattagtccattttcatactgctataaagaactgcccaagactgggtagttcataaaggaaagaggtttaattgattcacagttccaaatggctggggaggcctcaggaaacttaacaatcatggtggaagggaaagcaaggtaccttcttcacaaagctgcaggaaggaggatcgccaagcaaagggggaagaaccccttatgaaaccatcagatctcatgagaagtcactgtcccgtgaacagcatgggagaaatcacccccatgattcagtcagctctgccaggtccctctcttgacacttggggattatgaggattacaattcaaaatgagatttgggtggaaacacaaagcctaaccatatcaactcccctgccaaaaattccaaagtatatatgcagactggctttaagccccaattcggggcctgctggagctctggcctaggcactggcaattgtcataacaaaggtagggcagtgtgtgatcgactggggagcacagttgtcagcctgagtaatgtgtagcctctatcctgtccttgatggttgattaaagatttgaggatgatggatatgtagctgaaccgagaaggcaggcctcagttttactagctgtccctgcacagatgcagctgaagagaggtgctaaccaaggtcagagaggaagtggtctgtggtctgtctcttaccctaagagtggttctctctaacagtgtgaccagccaaagcaggtgtttgtaaagtgggcatggactgaagaatctgttcctgttgagctggatgggcctgaatgttgccccccaggtccctaaaacttgggatggacttgagagaggaggcctggaccaagatgtgagtcccattgaagacatcctctctactccccaccttggtctctctcaaatacccaacagaattccaacttgaaggattgcatcctgacagggctgaacatgcctgccgaggaagtatgcatcctgtgttcctggctcactcattcacagactgctcttctcaaaggctctgtgcctgtgctttgaaggaaacaaccatgggaagaaaacaaatgtgtgtaaactgctgtcaataaatgacacccagaccctcaaaaaaacccgaaaattggaaataaaatatatacccaggaatacttctttttattgtgcttcacttattatgctttacagatactatgttaacaaattgaaggtttgtggcaaccttgcatggagcaagtctactggcaccacttttccaaaaacgtgctcacttcgtgtctctttgttggcattttttagcaatggtatatttttaaattaaggtatgtactttgtgattgttagccatagtgatatcacacacttagtagattatagtatagtgtaacataatttttatatacactgggaaacgagaattgtgtggcttgctttatcgtgatacttgcttcattacagtggtcttgaactggaccttcagtatctctgaggatgcctgtatttttaaaactgtgtgttgatcatcattatattatggtgtataccaggtttcagccaactatgacctagcagtcaaatctgcttttgtaaatggagttttattgaaatacaggcaggccattcttttatgtattatctagattgtctttgtactacatgggagagttgattggtttcagcagagaccatgtagttcacaaagcctaaaatatttactatctgaccctttaaaaaattgcttacccttgatctatacttctatacgtttttgtaagtaagaagtattaagaaaaaaaaaagaacagaagaatggtatattggtattgtcattgtcatctgatatccttacacttttgatgaagttatgaagttctttcgtgatccaagttgaataaagttgatgattgctgggtatttagtcagggacattttgttggaaattagtcaactacattttttgtttctcctccaaactatagcagtatcatttatttcctaaattttataacatatttttgtacctacatccttatctaattttcagctgaaaaaataacatgatcttatttctcccacctttttggggaaactattataataatatatataagaactttgccccttgatgaaagcatttgattaatatttggtccaattttagccagaatcttcaggggtaatattcttactataaaatgcttaaaaaattaaaattatattgtaaaacttaaaacttttaactaagtttctaacatttttattttttacttttttttttttttttttgagacagggtcttactctgttaacaggctggagtgcagtggcatgatcacagatcactgcagccctgaactccttcgctaagttgatcatccagcctcagcctagcctgggacaacaggtgtgcaccaccacactcagctaattttttaaaaaattttttgtggagatggggtctccctatgttatcaaagctggtcttgaattcctgggctcaagcagtccttccacctcagcctcccaaactgttgaaattacaagcatgagccaccgtgccaggcctatttcttacttttgatagcagtattagtatatacaatactttaattttgttcctattttaaaaattttttttcaagataaagacagtttaattaactatataataacttctggaatactatttttagttcaaattccgttatctaaatttaaaagcacttaaagttgatacagcaaatatacctcattgttatatccaaaatttcaaattggtaagaataaatctatgaactggattcttagaaatattctcctttttattgttacattaaaataatatttttttaatataaaattattttgaagattatttctccatagggaagtattatataaataacaatttaatgggaataatacaataagattagtttctgttactaaagttttacctgttgcttgtgaaaactaaaaaataaaatgcgattttgtttcacagtaatattaggttatcaaatttattatttaatgaatcgacctcatgttgcttggctatcagggataaaaggtatagagtaccattaccaaactctaaaacattacttatttttttccccactgaatggttatacttagtcactaattttggaataaatagggactgttgcgaagcatcactttcattctttccatattgaattataacgtgatattgtcatgggatccttggggtgtcactttgccagccagaaacctctgtggctagtggcacttttccctgagttttgctcaggcatgctgggctcattccgcccacttggcctgacatgctgcactcagctcatgctgctggcctagatcccatgcgagccaggcacagagcagcagtgggtgcatgagcgggcaagcgcaggttccggccactgtgcacaaccaggcacactgactgctgcagtggggtaaaaagctctaggcactggcacaggcgctagcttcatgcaggcctgcagctagatcaggtgcatcatacgcagcttccactgcaggcacccatgtctggatgagggcaagatgatagcacctggaagcttggagacgccagaaattacagagccccagaaagggtgtcacagcccaggcttggggagcccctaggtctgggctccctgagtcctgcagctgttctctcctcatcacccacagtgtggtgagcgggggtgggaggattgtttcagccctgtttgtgttacagcttttcagtcccaccatttggtgagtcccaagttcttgacccatgttcaggaagaatgagatatgtggacaactagagggtgagcaaggtggagaggagcttcactgagtgacagaacaactcttgggagacccaaagtgggtagctcctttccgcaggcaggtcatcccagtgagtgtccagctgtcagtggaaaggatacctggagtgagtagctcctttccacaggcaagtagtcctgacaaatgcagccctcagcagagaggagacccagagtgggtagctcctatctgcaggcaggttgtcccgataagtgtcccagctctcagcagagaggagacctgcaatgggtaactcctatgcacaggcaggttgtccctatgaatgtccagctctgatcggagaggagacccatagtagaaagctcctttctgcaggcaggtcatcctgacaagtcaaggagacccaaagtggatagtttctttctgcagctggtagtcatgatgtctgtgtaagtctggctggttctggggtctttatgggctcagaagggaggaagctcatgctgactggtctttgggaggccatagacaggcctgaaaaaatcaccataagttctcactctggactgcagactatacccagaactgagagcctggttcccaggcttcaggccattcctggcttgaaggtggagcttcaccagggtcccacccctttctgcccaggagcctttcttcctcctacgccgtcaacatgatatccatggcacccaggctgttcatgccgaggggcgcctgcaggctcacgctaagccatcctcagtaccctctcagcctccctcctgtgctctttggcacccaatgtctggagggggccaaggtgataaggctggcatgtcagcaccacccaagcatgtgcacgcccagctaggtcgtgacaatgcctgggtgtggccacaactttgctctgcccaggagtgggtgccaggagtagggggagcccaggcagcgggagcaaacactttcaagcctgtgggggcaagggcttcctgcacccccaagagtgcaggtatgccagggtctggagccatggctgggcagctgcagttgcacccgggagcctgggactcctgccctgccaactcaatagtggagggagctcccacctgttccagcccccacctagtccatgcagcccacagccctggccatgcctcccccactgcagttggtgtctttgtagtggccactccagatgggccactgctgccatcaatgtcactttttaaaagtgtgtgagagaaaggaagtggatagagtattacagagaaaaattatagataggcaaaatctgttaaagagcatggcagcttgatagaattatagtagtaaagtggataagtttaacttgttagcatttttatatgaggcatgtacaggtcaaattgtcattaaatactgtttgtggaaaaatatgtttttggatgctaactgttctgaattttcctttctagttttgctaattctattggtattttgaaatctgtttaaaatattttatatatgattaatttctgtactactcctgggaggtaacataaaatagtcacctaactttgatcacaaaatttattaaaatttgcattaattaagagcagcaatgtaaatgactactatggttatgtttactatttgagatatttaaaaaatacttcatgtggttacagtttccatttttacacaaatttgagcttataatatatacaacatgatggtatgacatgaagaaaatggaaaggaaacttagctatgttcaataatctaatgaaaaaaatattttggaaaaagttgtatataagtggtaaactatttgaaaatcattcttaaaaaaatttatttcctgctttttaaaatgtgacagactccacctttctatatcctgttgggccatttgtccctgtgcaaacaaaaattggtaattttcatatagatctgattaacaaaaataaatttaatgaagtctgacatatgaaaggaaaatgctccagtttttttcttacttgagtgaacagttttttcacaatctaaaatgagttaactcatacaggaaatttgaaagactcttcatgttttatgtctctccaaaatggaattttgactcacttttacaaaagattttaatatttattatttttatttgtaatgaactttacatataatacaaattttcattttatagatttttacattttattttgttttcctaatgtttcatgaattggaagtactgtaaaataaggttttgcaaactttttctttgaaggtttgggattgttagccacacagtctttgtcatttttttttttttttttaaacaacatctcgctctgtcaccaggctggagtgcagtggcgcgatctccactctctgcaacctccacctcctgtgttcaagcgattctcctgcctcagcctcctgagtagctgggattacaggcatgcgccaccacacttggctaatttttgtatttttagtagagatggtttcatcatgttggtcaggctggtctcgatctcctgacctcatgatccgcctgcctcagcgtccctaagtgctgggattacaggcatgagccaccatgcccggccatattttctggtttttgtgttctcttatttttatgatccttaaaaaccataaaatctgttcttaatttactggccataaaaaaaaaacagtggcagaataggtttagcccatccatagactacagtttgtcaaccccattcctagaataagaagtaataacatcatcaacagaaaaattaaatttagatactgttgataatgttggtgtttatttttcatttaattggctgtgactattatactacatgatgatgtaacttgtaaatctcatatgatatctgtacaggcagtccttgacttacaatgatttaatatgattttttaaattttaatgatggtgcaaaaacggtatgtattcagtggaaactgtacttcagtacagcattcaataaattacatgagaaattcaacatgttaccataaagtaggatttgtgttagatgattttgcccccaaatagggtaatataagtgttctgagcatgtttgaggtaggctaggctaagctatgacattcagtaggttagctatattaaataaattttttacttaagatgcgttcaacttacagtgggcttatcagtacataaccccattttaagtcaagcagcatttgtggttcctttccatgctaagcacttacaagcttttccttaataaatggttatgggaagttagttttctccattttgtttattatctggtgtcctgaatacctgttcttgaaacctttgttttgaaataaatttcattttatttttagctcggcaccagactcaactggtaaaatttcctggccatctaaatttattactatgttgtttaataatgaactacattgactgcagaaagcatttatcttcctatttttgataactagttttcatcaattttgttaacaggtatcattttcagttatttgcataatttctgcctaactagcagtgagcagctgtagttcctagagttgttattagttatcttgtttaaagaaaatggtcactaacactttaaaaatattttacagacatacaccagtgatgttttgtgtaacatttcaagtttttgtaaatgatagattctattttcacattaggggaaaaataattcacttattttgctaaatctcacaaaaacttatcaatctaaaatcaatcatttttaccctaaaaataaaacattttattagcaattttaaaaaatatattataattattctttagagatacctattggcatatgaacagataatcatttgaatttttacaaatatagttaaatgatatttcatcaaaagatctcataactttcaaaaagccactgaaattttttaggtatgtaagttatttgggttctcaaatggtcaagattttgtgttacaacataacttcaatcaaagaaatgttatttcaggaatgatatttaaaatatagaatatttggatagtcatcaagatggaaaaagatggccagttgattagttgcatcagcttactcaacattgacaatcagtgctttaacaattgatggctacattgccttcacatagaaattataatccaatatgaagatatggttatctttaatatctgtaacatagtattttgtatacaatcaaggattttacttcaaacacgtaagatcatgtccacacttcttcgtgctttcagagatggggaaatcaaactaaaacccatgaaataacaaagtcagtctttagccaaggttaaagcttctttagtattgattgaatataaggccctacacaggatattgacaggaacagggaaaaagaggcagtgacatagtgttttgaaagaaaattctaaaagacatactttgatttcttctttttctcatgatggcataacaagaagtagccttattaataatttccaattataatcactagaaaattggacaaaatatatgaataagcagtttttatacattgaacagtaggcctcagataactgtgaaccatgagagaacagaaataattgagttgggctctttaatttctctgatttgcctggaggcactttctggattgtagtacaagaaagggaatttccagtaaatcacagcactcttgctgagttgaggagacagtgatcagagttcaggaagttatggagcagaattttgtggaagaggaagcatcacagtaaaatagcttgagaaatctgcctataagccccttgaatcttgaattttttgagatgcatatgtaaagggcaaaattccacaagactgggtaaaatatgaccgtggacctttagagcaagaaatttctagagctcacagagctgaaagtgtttttctatctctaatcagccagagtggctaatcctaattgatttcctgggacagagagtagacagtccagaagagtggcacattagtagtagagttaaattatttctagagtaaagggttttctagaaccattcaagtctaaatctgatctaaaagtatcttcaaaataggcctcaaatgaccaaattgtttcgccagtaactcaattatgagaacaaagcccaacacattttaaaggaatacagcaaaatgcaaacacttaatgtaatactcataatacccagcatccaaacataattactagacatgagataaagcagtaaaatgaagcacattactgaaaggaaagtcagttgtaaaactttctgggaaatgacagggataaggggtttaaaagacaaggattgtcagctactataaagatgtttaaatatttaaagtaaaatatgggccaagtgccatggctcatgcctataattccagcactttggcaggctgaggcgggtggatcacctaggtaaggagttcgagaccagcctggccaacatgatgaaaccctgtctctactaaaaatacaaaaattagctggacatggtagagcatatccgtagtccagctgctagggatgctgaggcaggagaatcactggaacctgggaggtggaggttgcagtgagccaagattgtaccactgcactccagcctgggcaacagagcgagactccatctcaaaataataataataataaagtaaaatatgaatgtgaagtgaattggacaatgtaaaaaagaaagaaatggaactctggaaaatgaaaaataaaggcctaaaatgaaaattcatttgatgacttgagccgaatattttatactgattaagaaatagcagtgaactcggagatgtagaatagtatgtttccaaactgaagcagagaaaagacgaaaaaagaaatggagaccagagccatagaaacctattacataaatcaagcagtttaatatacatggaattggagttcaaggaaaaggggttgagagtggaaaataatacccaaatattttgaagactataaatcctaatatccaagaaattcagctaaccatgagcaggattaacacaaataaaaattaccacgtaacataagtaaagtgtttaaaagcagtgttaaacagcaaaatttcaaaaaactcttattagcaagagacaaatagctagttcacttaacagtgacttgaaaagacacttcaccagtgattatattaaatgccagatgagcacatagaaagatggccaacatcgttagcgatcaggtaaatgcaaattaaaaccaaaattaaatacctctacaaatatatgagaattgctaaaataaaattactgacaattccaagtgctgccaagaatatgcagcagctggcatctcatccatggttgtcatccatggctttgagaatgcaaaatagtagccatagaggaaaatagtttggaagtttcttatttagttaaacaaactcttaattatatgaccgagtaatcccatttctgagtattttccctgaagaaatgaaacttatgttcacacaaaaacctataaatcaatgttcacatcagttattggtgtaatagtcaagagatggaaaaacacaaatgtccttcatgaataaacaaaccatgatttaaacacaggaatgctactgaacagaaacaaagggccacacttataaacctgactatgtagatgaactcaaagacattattacaatgagttttcttgtgagtaagaaaactcatttcaaaaagttacatattgtgtatttccttttttgggggaaattctcaaaataacaaaatcatactgatgaaaatggattagtggtggccaggagttatgggtgaggttaagacttccaaggattccttcaggcagtggagctattgtgtgttgattgtggtggcaaaacacagtgcatgtgacaacactcataaaactacacaaatactgataaaagacttgtacaatgaaaggtacaaaccactgctgaaagacattaaaggcagaaataattagcaagctattccatgttcatgggttggaagagtttacgtcagtcctacccaaagcaatttatagattaattgcaatttctataaaagtcccaataatgtgttctgcagaaatagaaaaatcaatcctaaaattcatttgcaaacttaaggaaccctgaataaccaaaataatcctgaaaaagaagagcaaagctgagaggcacacacatcctaatttcaaaacttgcaacaaaggtacagtaatcaaaacagtgaagtactggaatgaaacagacatataaaccaatggaatacaatctctagcccataaataaagtctcctatatacagtcaaattatttttgacaagagtgccatgatcattccctgggaaaaggcagtcttttcaacagatgggaaaagtggatatccacatgcaaaagaatgtagctggacccttcactaacaacacagacagaaaagatagactgcaatccaataattgtagcagactttatcagctgacttttagcaatggagagatcatccagacagaaaatcaataaggaaacattggacttaaactgtactctcgaccaaaaggacctaaccgacatattgaaacattctatccagtagctacagaatacccattcttccccaatccacatggagcattctccagaatagaacatgtatcacaaaacaagtcttaacatatttaggaagactgaaattgtatcaggtatcttttctgaccataaaggaataaaagtagaaattgaaaacaggaggaacaacttcagaaaaatcacaaatacatggaaattaaacagcatgcttctaaacaactaatgggtcaaagaagatattaaaagaaaaactttaatatttcttggacaaacaaaaatggaaacaacataccaacacctatgagatacagcaaaaggagatctcagagggaattttacagtaataaatgcctacatcaaaaaagaagaaagatctcacacaacctacagtgtacctcaaagaattagaaaaacgagaaaactaagcacaaaggtagtagtagcaggaaggaaataataaagatccgagcagaaatagatgaaatagagactagaacaataggaaagattgacaacacaaagagttgttttttttttaaagaaaaactttacaaaccattagctagactaagaaaaaagagaagactcaaataaaatcagaaatgaaaaaggagatattacaactgataacacagaaatacgaaggacaacaagagactattatgaataactatatgccaacaaatcggataccctagaagaaatgaaaaaaaaaatctagatacatacaatctaccaagattgaatcatgaagaaatagaaaatctgaacagatcaataatgagtagggatcaaattagtaataaaacatctcctatcaaagaaaagcccaggatctgatggcttttctgatgagttctattaaacaactaaagtgtttatactcatctcaaacccttttaaaaaattgaagaggaggtaatatttccaaacacatattacaaacccagcatttccttgataccaaagccaaagacattatgaaaaaagaaaactgtaatacgatatccctgatggacatggatgcaaaaatctgcaacaaaatactagcaaacccaatttaacagcacgtttaaaagatcagtcaccatgatcaagtgagattcatcctagggatgcagggatagttcaacatacattaatcaataaatggtgatacatcacaataacagattgaaagacaaaaaccatatgatcatttgaatagatgaagaaaaagcatctgaccaaattcattgtttttgcatgatagaaagtctctacaacttcagaaggaatatacctcaacacaataatgggcattctgacaaacacgactagcatcatattcagtggagacaatttgaaactttttcctctaagatctgagagagaacaagtaaactcactctcttcacttctgttcaacgtagtagaagtcctggacagaacagccaggcaagagaaagaaataaaatgcatccaaatgagaaaaaaaaaatgttaaattgtctctttgcagatgacatgatcttatatgtagaaaaccctaaagaatcctccaaaaactattagaactaataaatacatttagttaagttgcagaacgcaaatcaatatacaaaaaatcaatagtgtttctatacattgacagcaaattatttgtgaaagaaatcaagaaatcaataatatttgcaattgcaatgtttcctaagtaaaatgcttaggaatgtgtttaaacaaggaagctctctacctgaaaattataaaacatagatgaaagaaatggcggaagacacaaataatgaaaacccatatggatcatgggctgaaaagttaatagtattcaaactacacaaagtgatctataaattcaatgcagtccctatcaaaataccaatgacattcttcacaaaagtagaaaaatcatttctaaaatatgtatggaaccacagaagaccccaaatagccaaagtaatcttgagtaaaaaaaatttgaggcatcacattagctgactgcaaaacatactacaaagctatagtaacccaaacaacatggtactgacataaaaatagacatacataccaataggatagaaagatagcccagaaataaatccacacatttacaactaactgatttttgacaacggtgcctaaaaacagtggaggtagggagactcttcaataaatagtgttgggaaaattggctatccatgtttagaaaataaaatgagaccctcattttacatcacacacaaaaatcaactgaaaatgaattaaaaacttaaatgtaagacctacaactatgaaactactagaagaaaatatagtgagaaatctccatgacattggtccaagcaaggatttttggatgtgactctaaaaacacagacaacaaaagcaaagacaaatgggattgcatcaaactaaaaatcttcggcacagcaaagaaaacaaacaacagttaagaagtaatctacagagtaggagaaaatatttgcaaactatacatctaacaagtggctaatatccaaaatatataagtaacttaactaagccagaaaacaaataacttgatttaaaaatgggtaggagaactgagtagatatttctcaaaagaagaaatacaagtggccaagaggtatataaaagtaatgttcaacatcactaatcagaaaaatgcaaattaaaaccacaataagatatcaccttcctttttaaatataaatattaccaaaaagataataagtgttggcaaggatatggagaaaagggaacacttgctcactgttggcgggaatgtgaattaggatagccattgtggaaaacagaatggaggttcttcaaaaacctaaaaacagaactaccatatgatctagcagtttttctactgggtatgtatccaaaggaaattgaattagtatgtcaaagagatatctacactctcatgtttattgtagcattttttcacagtagccgagatgtgtactcagtttaagtgtccattaacagattaatggataaagaaaatacgctatatatacacagtggaatactattcagcataaagaaggaaatattttcctttgcaacagcatggaagaacctgggagacattatgttaaatgaagtaagccaggcagagaaagacaaatattgcatcatctcactcacgtgtggaatataaaaagttagactcataggtatagagagtggaatgttggttaccagggcctagggtagttggttatgggagttggggagatactgatcaatggatacaaaatttcaattagataagaggaataatttcaagaaatctatagtacaacctggtgactattgttaacaataaacagttatcccatgaacaactcagtgttcggggtgctgaccacgtgtgcagttgacaataccatataacttttcaactccccaaaacttaactactactagccttctattgacaggaagccttattgataacataaagtaaattaacacattttatatgttaatatgtactgtattgttaagaataagctagagaaaaggaaatgttattaagaagattataaggaagagaaaatatatttactatccattaagtggaagtggatcactataaaggtcttcaacctcattgcctttacattgagtaggctgtggaggagaagaaagaagaggggtttgtcttgctgtctcttgggtggcaaagacggaataaaatccatatataagtggacacaggcagttcaaagctgtgtctttcaagggtcaactgtattatatttttgaaaaatgctatgagggtgaatgtaaagtgttcttaccacaaaaataactgtgcgaggcaatgcatatgctaattagctagatttagtctttccacaatgtgtatatacttccaaaaatgatatttacaaaatatacaattttatctgtacattttttaatgaacaaaaatactccaaggagaaaagcattagggcattggatttggcaattatatcttggatatgacaccaatggcacagaaaacaaaagcaaaactagacaaattagatgtcataataattttagacttttgttgatcaaaatacattatcaacagagtaaaaaggcactccacagaaagagatacatatttgcaaatcttttatctaataagggatttatatccagaatatataaaaatctcctaaaactcaaccacaaaaaaaaactcaaaaaagcacaaaagacttgagtagacattttttcaaaaaagtacatacaaatggtgaataagcacatgaaaagatattcagcatcactagtcattagggaaatgcaaaacaaatccagaatgagatgtcacctcacaccattaggatgggtactatttaaaaaaaaaaaaagaagaagaaaaaacaataacaaatgttggtaaggttgtggaataacttaaacactgaactgttggtgggattttaaatggtacagctgatgtgcaaaccagtgtggtcgttcctaaaaaattaaaaatataattaccatgtcacctagcaatttgacttctgggtacatacccaaaggaattgaaagcctggtctcaaagagacatttgtatacacacgtgttcattgcagcattattcaaaacagctaaaacattgaaataacctgggtgtccactgatggaagaatgagtaagaaaaatgtggtacacatgcaggggaatattattcgcttttaaagagaattcgggcatataatgcaacatgaatgacccttgaggacattaagctaaatgaaataaacctgtcacagaaaggcaaatgatgtgtgattttatttatatgagggacatagagtagtcaaaaatcacagagacagaaaatagaatggtggtggccaggggctgcagggagtggggaatggggagttactgtttaatgggtgtaaagtttcagttttacaaaataagagttatggagatggatgatggtgatagttgtacattatgactgaacttaatacctctgccttgtacacttaaacatgattaatatggtaaattttatgttttatgtcctgtaccacagtaaaatattggaaaaaatatacaaacttagaattaaacaaattctattaaaaataacacaaacacgccaacaacaacaaaaaaccatgcagccctgttgcaaaaaatcttgaaaactgacccaaattttatctgtaatcttgcctctgaacattatcattttgtatattcatttccagtctttttttagtaaatatatttttatgtaggagaacaagtaaaaaggtccattttaatgtatgatcatttaaattttaagttttaaaaaatctgtcagaagaaaaatcacatcacttgcaaaaatagacagaaattatgcaagccagaagataatggaacatctttaaagtgctaaaatgatagactgccaacctgttattcttaattcagtgaaaatattcttcaaaaatgaaggtgagataaagactttttcagacaacaaaagctgaggaaatttattgccagcagatctgtattgtaacactgttaagaaaatggttttcaagcagagggttaaagataccagatggaaacatggacacatacaaatgaaaaaaggagtacaagaaatggtttctgtgtgaatattcaggtgctcctcaacttatgatggggttacatacccataaactctttttatgtaaaaaataacataagttgaaccatcacaagttggaggtcatctgtatattaaacattgttttctcatttttagtcgatgcagaaaatgcatctgttaatattcaatacctagtcataataaaatctcagaaaaataggacctgaagtgaaaaaaagctgaactaattggtatctaggaaaaaacaacttatgacatatttgacagtaaaagaccaagtaagattgggcaagagttttatgtctcattactttaacattttactgaatattctaactagtacagtaaatatgggggatgcatattccctcttactacatggaagtggtcaatattatagagaagtcaacagaaggaagattaggaacagaccacatgatgtcatcgttagaatctttgatttggagacagacctcagaagagtagtggaaacgaatatagaactgtagggtgtaaaatgtttgaataacaaactgagtaaacagaccattcgttggagaaatttgacaatgaaacaaaagaggaaaattggtggaggtttgtgtaactgttgaagattttattcatggaagggaaagctatgtttgtttggatatagaggaaaaagaaccattggagatgtaaaaatgaagattgacagagataagagaaataatgcagaaaagctgtcatgagttaagaaaggacttagaagaaatagagaagtttgctctggaggggagcaaggacaacttctaaacttagaaggataaattataggctaggaatagacatgggttgagggaaatgtaaatggaattttctctgtccattttatttattcaatttaccattcaggatattctaattcagttattacttgattttgtgtccaaaggatacctctttttgacttgacctgatgttctgagaacttctccaaattatttttttcttacaaataaatagaaattaagtagcccccaaagtaatccaaatgtttactaaatgtagaagttgacaaagatttttttcattacagttaaattctaccaataaaacaacctccacatagagaaattatactcttttgtcataaacaaacatttaaaactgcacagtttagtatttcaatatggaaatttccttttatgtaataaagatggttaatccaaagaagacatgatttgtcaagaagaatggttacagaccactttcaagatggctgagtgggaaaagctttggtctacaggtcccagcaagatttacgcagaagatggtgatttctgcatttctaagtgaggtacctcgttcatctcactgggactggttggacagtgggtgcagcccatggagggcgagctgaaccagggcagggtgtcgcctcacctgggaagtacaagaggtctggggatttccctttcctagccaagggaagccatgagtgactgtacctggaggaatggtacacgcctgcccaaatactgtgcttttccaatagtcttcacaaccagcagaccaggagactccccccgtgcctggcttggtggatcccacacccacagatccttgctagctgctagcacagcagtgtgagattgacctgggatgctggagcttggcagggggaggggcatctgccactgctgaggctttagtaggcaggtatatgctcacagtgtaaacaaagcagcagggaagcttgaactgggcagagcccaccacagcccagcaaggcctactgcctctctagattccacctcttggggcagagcatacctgaacaaaaggcagcagacagctactgcagacttaaacgtccctgcctgacagcaccgaagagagcagtggttccccccagcatggcatttgagctccgataacggacagactgcctcctcaagtgggtccctgacccccatgtagcctgactgggaggcatctcccagtaggggcctacagacacctcatacaggtggatgcccctctgggacgaagcttccagaggaaggatcaggcagcagtatttgctgttctgcagcttccactggtgatacccaggcaaacagggtctaaagtggacgtccagcgaattccaacagacctgcagctgagggacctgactgttagaaggaaaactaacaaacagaaaggaataacatcaacgtaaacaaaaaggacatccacaccaaaatcccatccataggtcaccaacatcaaagaccaaaggtagataaaaccacaaagatggggagaaaccagagcagaagggctgaaaattccaaaaatcagaatgcctctgctcctccaaaggaacacaactccacgccagtaagggaacaaaactggatggagaatgactttgacgagttgacagaagtaggcttcagaaggttagtaataaacttctccgagctaaaagagcatgttctaacccattgcaaggaagctaaaaatcttgaaaaaaggttagactaatggctaactagaataaccagtgtagagaagagcttaagtgacctgatggacctgaaaattgcagtacgagaacttggtgaagcatacacaagtatcaatagctgaatagatcaagttgaagaaaggatagcagcaattgaacatcaaattaatgaagtaaagcatgaagacaagattagagaaaaaagagtgaaaagaaatgaacaaagcttccaagaaatatgggactatgtgaaaagaccaactctacgcttgattggtgtatgtgaaagtgacagaaagaatggaaccaagttagaaaacattcttcaggatattatccaggagaatttccccaacctagcaagacaggccaacattcaaattcaggaaatacagagaacaccacaaagatactcctcgagacgagccaccccaagacacataattgacagaatcaccaaggttgaaatgaaggaaaaaatgttaacggcagccagagagaaaggttgggttacccacaaagggaagcccatcagactaacagtggatatctctgcagaaaccctacaagccagaagagagtggggccaatattcaacattcttgaagaaaataattttcaacccagaatcccatatccagccaaactaaccttcgtaagtgaaggagaaataaaatcctttacagacaaacatatgctgagagattttgtcatcaccaggcccatcctacaagagctcctgaaagaagcactaaacttggaaaggaacaaccggtaccagccactgcgaaaacatgccaaattgtaaagaccctcaacgctatgaagaaactgcatcaactaacaggcaaagtaaccagctaggatcataatgacaggatcaaattcacacataacaatattaacctaaaatgtaaacgggctaaatgccccaattaaaagacacagactggcaaattggataaagagtcaagacccatcagtgtgccgtattcaggagacccatctcacgtgcaaagacacacataggctcaaaataaagggatggaagaagatctaccaagcaaatggaaagcaaaaaaaagcaggggttgcaatcctagtctctgataaaacagacttttaaaccaacaaagatcaaaagaaacaaagaaggccattatataatggtaaagggatcaattcaacaagagctaactatcctaaatatatacgtgcccaatataggagcacccagattcataaaacaagttcttagagacctgcaaagagacttagactcccacacaataataatggaagacttaacacccaactgtcaatattagacagatcaatgagaccaaaggttaacaaggatatccagaacttgaactcagctctgcaccaagcagacctaatagacagctacagaactctccaccccaaatcaacagaatatacagtcttctcagtaccacattgcacttattctaaaattgaccacataattggaagtaaaacacccctcagcaaatgaaaaagaacagaaatcacaacaaactttctctcagaccacagtgcaatcaaattagaattcaggattaagaaactcactcaaaaccacacgactacatggaaactgaagaccctgcacctaaatgtctactgggtaaataacgaaatgaaggcagaaataaagatgttctttgaaaccaatgagaacaaagactcaatgtactagaatctctgggacacatttaaaggagtgtgtagagggaaatttatagcactaaatgcccacaagagaaagcggaaagcagaaaagatctaaaatcgacaccctaacatcacaattaaaagaactagagaagcaagagcaaacaagttcaaaaactagcagaagacaagaaataactaagataaagagcagaactgaaggagatagagacacaaaaaacccttcaaaaaaagtcagtgaatccaggagctggttttttgaaaagatcaacaaaatagatagactgctagcaagactaataaagaagaaaagagagaagaatcaaatagatgcaataaaaaatgataaaggggatatcaccaccgttcctgcagaaatacaaactaccatcagagactactataaacacctctactcaaataaactagaaaatctaaaagaaatggataaattcctggacacatacaccctcccaagactaaaacaggaagaagttgaatctctgaacaggacaataataggttctgaaattgaggcaataattaatagcctaccaaccaaaaaaaagtccaggaccagacagattcacagccgaattctaccagatatacaaagaagagctggtacctttccttctgaaactattccaatcaatagaaaaagagggaatcctccttaactcattttatgaagccagcatcaacctgataccaaagcctggcagagacacaacaaaaaaagaattttagaccaatatcctgatgaacatcaacgcaaaaaattctcaataaaatactggcctactgaatccagcagcatatcaaaaagcttttccaccatggtcaattcagctccacccctgggttgcaagactggttcaacatatgtaaatcaataaacataatccatgacataaacagaaccaatgacaaaaaccacatggttatctcaatagatgcagaaaaggccgttaacaaaattcaacagcgtttcatgctaaaaactctcaataaactaagtattgatggaatgtatctcaaaataataagagctatttatgacaaaccgatagctaatatcatactgaatgggcaaaaactggaagcattccctttgacaactggcacaagacaaggatgccctctctcaccactcctattcaacatagtattcaaagttctggccagggcaatcaggcaagagaaagaaataaagcatattcagttatgaaaagaggaagtcaaattgtctctgtttgcagatgacataattgtatacttagaaaaccccatcatctcagccccaaatctccttaagctgataagcaacttcagcaaagactcaggtacaaaatcaatgtgcaaaaatcacaagcattcctatacaccagtaatagagagccaaattatgagtgaattcccattcacaattactacaaagagaataaaatacctagaaatacaacttataaaggatgtgaaggacctcttcaaggagaactacaaaccactgctcaatgaaataaaagaggacacaatcaaatggaagaacattccatgctcatggacatgaagaatcaatatcatgaaaatggccatactgcctaaggcaatttatagattcaatgctattaccatcaaactaccactgactttcttcaaagaattggaaaaaaagtactttaagtttcatatggaaccaaaaaagatcctgcatagccaagacaatcctaagcaaaaaggacaaaggtggaggcatcatgctacctgacttcaaactatgctacaaggctacagtaaccaaaacagcatggtacttgtaccaaaacagacatatagaccaaaggaatggaacagaggcctcagaaataacaccacacatgtacaaccatctgatctttgacaaacctgacaaaaacaagcaatggggaaaggattccctatttaataaatggtgctgggaaaactagccatatgtagaaagctgaaactgaatcccttccttacaccttatatctaaattaactcaagatggattgaagacttaaaatgtaagacctaacaccataaaaaccctggaagaaaacataggcaataccattcaggacataggcatgggcaaggacttcatgactaaaacaccaaaagcaatggcaacaaaagccaaaatagacaaatgggatctaattaaactaaagagcttctgcacagcaaaggaaactatcatcagagtgaacaggcaacctacagaatgggagaaaatttttgcaatctactcatctgacaaagggctaatatccagaatctacaaagaacttaaacaaatttacaagaaaaaaacaaacaaccccatcaaaaagtggccaaaggatatcaacagacatttctcaaaagaagacatttatgcagccaacggacacatgaaaaaatgctcatcatcactggccatcagagatatgcaaatcaaaaccacaatgagataccatctcatgccagttagaatggcgatcattagaaagttaggaaagaacagatcctggggggagggatagccttaggagaaatacctaatgtaaatgacgggttgatgggtgcagcaaaccaacatggcacgtatatacctatgtaacaaacctgcacgttgtgtacctgtaccctagaacttaaagtataataatttaaaaaaagaagagatgagcacccaaaagttgtagatggcatatctgaacatctgctatagggctgactgaatacatgtaatttttagtcagtataagatgactttatcccttactatgaaatcaatcttctactttgatatggtgattagaagacacttttgttttacaaaataagagcacatatggcctgtgttgtatattccatgataatttttaaagggaattattttcccttttgttctaatacaattggtgtatttgtataaatttttaaatgcgaaccaggaaaataccaaaaaaaaagaggctatgtttagaattaccctcaggcatctggtgtgagcttggattgttttgacaaatcaagacatttgggtgcttaaaatacaaggtaatgtaatgaaaggtctatatattccattaaatttatgtcattgaataacaggtttggtttggagggcatacatgtaacttcttttgagacaagaaatatttttacattatgaaaaactgcatgctgactataatgtctactcatgataaactacatggaatcttcaagaagctaagcatggaattaatgttggcttttattattatactctctgggatactaatgcacgttagagaaatatgtaaacaacttgggaaaaaactaaattgggaaatttttaaaaaggaaatacattgcttagcacttatattgtagtgtttacattttccaagtaatttatatacttattacagacatactgtagttcctaaatgtgaatagactataagatactagcctgagtttatttagtagctgatggccttctgcccatcctcaggttgctctaagcaaagtccacgtttttttaattgaattctgattctttttgaatataaaatagattatacatttgtttaaattttgtaatattacattacatatttaaagaaaactttagagaacggtttactttttccttctgttttaacagagtaatggaaagcatgcatgcagaacaataacaatgcaacataagcatctgtggccccaggtggcagggatgtagagagaacataggagatacctatatgtaaaaattcagctagttatggacaagattcaacaaagctggtacttaccttaacactgctttgtttccaactatattcttaaaacaaaatttggtaaagtaaaaatacagtacatacacaaaaaaaccaaggtggatgacatgcagatcaggtttaaacctggcagagaccaggtattaaaggaagtaaagacatcagagagccagaaaaactcatatttgttcatgacttattaaaaatcacattaggccgggcgcggtggctcactactgtaatcccatcactttgggaggccgaggtgggtagatcacttgaggtcgggtgttccagaccagcctgaccaacatggagaaaccctgtctctaccaaaaatacaaaattagccaggtgtggtgtcacatgcctgtaatcccagctactcaggaggctgaggcaggaaaatcacttgaacctggtaggcagaagttgcagtcagctgagatcgcaccattgcactccagcctgggcaacaagaaagaaactccgtctccaaaaaaaaaaaaaaaaaaaaaaaaaagtgggggaaacaacatatgtatgcaaaggagggtagaaagaaaggagcagcgactttgccaaatacacatattctaaaggaaaaaaagaaacctagattctagtcattcttgaaaaaaatttgaatagaaagggacaaaattaaaatatgatttagagtcggttacagtggctcacacctgtaattccagcactttgggaggctgaggcaggcagatcacttgaggccaggagtttgagaccagcctggccaacatggcaaaaccccatctctactaaaaaatacaaaacttagccagtgtggtggcacatgcctatagtctgagctacttgggaggctgaggcaggagaattgcttgcacccaggaggcagaggttgcagtgagccaagatcgcaccactgcactccagcctgtgcaacaagagcaaaactccatctcaaaaaatatatatatatataaaatatatatatatacataaaatatatatatatgcacacatatatatgcatgtatatgatttagaaacagtagtgtacaacaagcattaaatagaaggagagtttgggtgtagaaagaatagattgtattgaacaaactcaataaggatgttataaatttgaacaatggaagaaaaaaggatagttgaaaggcagttttaaagtatatgaaagtggcttcattttctctacctattattgtattgtaagtttaacacatggcaatacaatgcaatgtaattgaccattttatgttcaagcctaatccctgctaaaagtattaagagcctttattggtcccatcatttaaccaaaatgctcaaggtctacaagataaaaccccgtgaactcacaaaaacagattctataaatgatttgtcatctttatgctaccgccaaatactgcctgttggtttagccacttttgattcttgttttcaagtacataattaaatagaaatttgatgcttaaataactaagaaccaatacttttccatatcatttcatttctgctatcatatatcttatttttggtaccagttcagcccagtaagacctgaaggaaggacttagaacctgggatactcaagacagaaagaactatgtatgctttagcacaaggattggcaaactatttcttagatgggccaaaacatgaatacttcgggctttgcaaccatgtagtctctgtcatagtgctcaactttcccataacatggaatttgctacatacaatatgtaaaagaataagctcagctgtgttctgataaaattttatgaacactgaaatttgaatattgtataacttttaagtatcatgaaatattgcctttctttctgtttttccactaactttaaaatattaaaactatttttagctcacaggccatataaaacagaaggtgggccagctctggagaattgattttcagactgcaggctgtgattcattaggtatacaatgtaatcaataaagcaagccctggccaatactttttaagggcaaaccatgccatagcataacatagatgagaatatcacagttaaaggaagtactattttgtaaaacatttgtttcagttacatatacaggatcatgatatgaaatgtattgctgtagactgtaataaaaaagattttaaatcattaatctttactagcaaggaaatttagtgtcaagaatgtgatgtgtcttagctcaagtttacacagctagtttgtagagactacattaaaaccagatattctgattttcagttcagagtttctttgactgaattaaaaattagattcagactaaaataattctgaaatacttataaaattgcctaattttgaatgatcaggataaaccctaacattaaaatatttagaggaatgtaaaaactaactggcttattactaacattcagattattagcaatagtcacctaatttgagtttaaaacaatacaatgaattagaaagtatacagacagagtttttcctggaccttgatctgtgctgtccagatatgttgttccttgctctctagtttcagactaggaggtcaggcccagggcatgtcaactttgaccatcagtcttcagtctgtccttctcaggtatcaaaacacaatttttcccattacacatgccccttaattaggtagcgttaccacaacataggtggacactggatcacaagagaaataagccaccaagaactaacttgctgaaaagcctgagaaaaataagctgagggaatggacatttcctaagacataaacctggagaagttatccatttctcctgtctgcccatcatgggtgtgtcaggttgattttttaaaggacaattttaacatataagactattttctaatttttaaattatttgaaatttattttagtagagattttatttgtgtgtatctagctaaattaatttatagggatatacatgttatattatccacacctgaaaggttgttctctctgtactcagtaggattgttctaattacacaaagtccaaccaaatatattcttctgattaaacatatattttagcttataaactatttacttaaaaagattatataggtaatttcaactgaaaaatattctcacattaagtgtgctatttacatatttgttttgttatagagaatatctgaggctctacatcctctcatgagtaaaagaagatgtttaaattaatttcagcagattttcttttataaattgaataatattatttataattactgatcctagaataatccctaggtcagtttttctctagaaattaatagctgttcattatttcaagttaaatatttcctactggtattttttaattccaccattttctaataatcacaataggaattacattaatagcatcatttagcttgcttaccaagtcaatatcctaaaaagattctgagataatacttggtctcatcataataaactgatcaatgtaactacctgtatactccattagaattcaggcttctccagcagatggaacataactgttttatatttgtgtcctggcctatggtaagtatgcacactacttatagaatcaaatctttggatgccttttatccttggaaatgactgggttctctttttgacagatttttttttttgccatttatttgatgcccttttttagatttcctagttcatccaatttcaaaatataactcactttgtaatagatctccgtcatattataactggattctgagtaataaaagtaccacttacttttagtttataataggtctaatattttacactagaagtgtttttttaaaattacgaagtgactcacatactgacttctttattgtatcattattggactgtattctggtatgtaatatagaacttgactcttaagatctcaccatgaattgtggatagttgtgatttggatataggattttctagttaggcaaaataatcttgttaattcaatgacatgtaattttttgtgtatatagtctttggcatactatcccaataaattatttcttgggttgaatcatgattataatagtttctgtgactttggggaatatcttcaatgttgtaaaattgaaggaaattctaagaacctatttcattcctatgaatgaatgcaactgtactgattactcatctctaatttttttcttaaatggaggattcgtaagaaaattcgacttggattacatttgagaatttattgctttgagcacaaataaggaactttgtgaagtttagtttgttttttcagggtatttcaacaatttggcaataattattgtataaagttaatgtgcttttggaagtaagtgaggttcgcctgactgacctctacttgaacctgccttagcctgaaaccatttttttggtgatttatgccttaattacaatgattatcaaatagtttccttttaccaattatgttttttctctttgacttcgtgaatatctttttatgaagagtgatacatagcatttccattttacatgatatattatttaagtatttcaaagaaaaaacaccagtgcttttttgaatacaaaaataaagatcttaaaggtgtatacaatacaaaagctacctgaaatttatttaaatttgtgaacttgtaattagtaaatatatttatttgagaatttaaataaatatcagaatttaggtagtttgaaactgtatacaaattgttcgtgtatacacactatgcttaaaaggatttatattttatagaatataaattatgttatttatttatttattttgagacggagtcttactctgtcacccaggctggagtgcagtggcccagtcttggcccactgcaagctccaccttccgggttcactccattctcctgcctcagtctcccgagtagctgagactacaggcgcctgctaccacgcccggctaattttttttttttgtatttttagtagagatggggtttcaccgtgttagccaggatgatatcctgaccttgtgatctgcccacctcggcctcccaaagtgctgggattacaggcatgagccactgcacccggccaattattttatttttaatatggaagcattactatagccacttttatttaaatgtaactacttgtgtaatgtaatcatatgactaacatggtatatgttctcttttgattattaatatttcttgaaatgatgtgtacatggttaaaacacatgtatcattcttaataattatttaggaccagtctttcttgagcagtgttaaaatttgaaccagacataggttagtaactttagaatttaattaaggcttttgaaatttcaaggagctcagagagaaataaagaaagttgatgcagaggagtgatacaggaataacaattgattctataattaaatttaacccaaaaataattgcaagatccaaatgatttatgatagcgaaaatgtctcttatttcccttatttcatccgtactcattgctgttgtgattatattagcaagacactcaggtcagtcaccttctgtagtagaaatctgagttactactgtgaataaaagtatctcattcaatttcaaaaataattgttttatattatttagagtcatagtactttattgtaatccttatttcagtaccatattctttagactcttacataaatctgtatttgtatgtcttatctctgtaactggtctgttagctccttgagaccgaagactgtatcatttctggatttcttaaagatccttatagatagtgcaaggcctatagcagtgatgtaattattgttccttaaataaatttttaaagcataaattaaaaaacagtaaagttggggcagtgtttcacagacagtaggtgttaataatattgctgataatgccattagagtattctcttcagctcatattaaaatcaggttactagtttaaatctgtataaaaaccatcactatagattcctttttgtattataatctgtcattttgtagaagatttatctgtgagtgttatgaacttcaattctggcattatgtaaaaaattctcagcagaagcaaaactataaaaaagaaaaaatattcacagtaagatttctaggctgtatcaacacaatgacaaaaaatttagaaagtttatttcaataaatcaatcaaaattattatttgggtattgtgtaactacaattaaacttaactttgtttctgagcaatctaaacattctgggattacaatttaaaagcacttagtcaaccattctcatgtggaaattgatttcagttcttccaaatatctgaaatttccgtagggaaatgtgtaatatcaaattactttgaaattgcaattaaaattaataatattaatttctttatcaatcttcgaaaatatctcatgtaacacagtaccactgatttctgacttttgataagccagatgcattttacaattcaaatattttggatcaaagaaaggtaataagtgcatatatttcatagcatctttaggaaaggctgggagagctccctaataaaacacattaacatgtctacagtaatacataaggattttcacaataaatagaataacaaattgtaaatagcatcacattattcaggggaaattttgctgataattgaatttgtgataatcttacatgaaagctttcagttttcagagctttttgggtttcagaattgtaaagtatcatggatgtacagctgaaataattgcccctgtgatttttaatatctatagatgtgtaagtgtgtgtatgtatgcatatgtttttctttttccttttctcttacagatatgtactcatgcacatgtgtacacagacacacacacacacacacacacacacaccacacagatgcatgtacacacacatcttgggatgagtaaatagtttccttggaagacagccaaactcatttgtttatgtattgtctatggctacctttgtaccacatgccagagttcagtggttgtgacagaaacttatagccaccaaagtcaaaaatatttactatcaggacctttacagaaaaagtttgctgccccctaatatatctggtatatccagaaacttacgttttgttcctattttaaagacagtaagactgccataagtttgtgataactcagtttttagtgaactaaagaaatcaatgaatgcatgaactctcactgtctttacagtattttgcagggttttttttgttaaaatttataatccaaacatgaatgtaagctgcattggcttaattatatttaaataaacttttttagtcaaaaaaatgaattttattatagttttaagttaatattagagttgattccatttgtaatacagttttaaaataaaatacttgagagaacacataggcaaaccttaaaatgtccaattaacatagtaactaatctacctatatacatcttaatattaattttagcaatgataaaaatttaagccattattgttatttcaaaggatgtttcatgtctatttttgtttgttttcttggttttgaattagaaagccacatgaattgcttgctttgctgttttttagggtttagatcttagtaagttcaggtgacttacatggtaacattgaaagtaaattttacagagagaagcatatcacagtgagggaataggaagacaatttcatgtttcagattaaaaaagtaaaagaatagtagaaaatatcagaaattactgttgtgcagatagaggtgtataagtattacaggagtctaaaagacactcattatggtaataccctgtgtcttagaatccttcacaataccatgggagaagtgtagagaacagaattttgaagaatacaccactgaaactaaggcaaatgaagcatattggacatgcaaaattcctttccacgtctatagttattcaacatttgttactgaaatgaaagtatttcagtgccattcagctctactaatttggggatttttaaaagttaagaataggctggacctggtggctcaagcctgtaatcccagcactttgggaggtccaggtggatggattgcttgagctcaggagttcacatcagcttgggaaagttggcaaaaccctgtctccacgaaaattacaaaaattatccactgtactccagcccaggtgacagagcaagattttgcttccaaaacaaacaaaaagattaaaaatcattagaagattaactaaaaactagttagtcctaggcatatttgatttttaaaattcagattgtcagtatagtcatgtctatttgatagaaaataaattggtatcttttattgtgaggagaaatattgtctataatgaaactgatcacttttccttctgcagatttgcttcttaatttgctttccttatctcagttaaaggtatcatcatcacactctgatggttcctttaccctgtcccaaatagttgttaaaatagttgtctaaaatagtttgtctcattacagaatgccttgagtctgtctctccttgcattgtcaccatcttgagctcaagctttcagtcgtgtaactaaactctttagttactagcttcttcctatactgctgacagaaagtggtctttccaaaatagagctaattctgtctgcgccctgcttaaaatcctgtagtggctccctggtgatgataggatagtgtgccatgtatggctctgcttcctgcctacctctctgtcttcatttccagtcacttcctttcatccttcacagcctacgacataacattccaactccactttgctgacgattgcatgcttctttatacctcagacatttctctgtcacctggaatgaccttcctttctttctactttttgcttagataggctcagcattatccaacttaaatgtcacattccccataacttcttctcctagacacagttgcttactacccttcctgtgcttctcacactgcattctctatgaaccccctaagattctctatcatgattatttgcttatattatctgccccacatcccacttagtacctgccatggtgtcaggcacattagacaatatgtttggtaaatgttttttgaatgaattgggatcttattctaaaaaatgatgttcttatttttgctcaaaatgtaattttttctctacagttgatagtgaatgatgatttatagatttattgattcaattaatatttactgataatatattcaaagcaatcatagatgtctgtcagagtctcctctcttggatccttacttaaagaaaactttgacatttaaaagattagttccatataagagcatgatttcttgtccctagaacatgtaatattcttcatctcccaccatgaggaacattctgctagagatggaatttttcaacggtattttaaagctttagggctcttttaacttgatattcaattcaacagatgtaaaaagttagacccgcagattgactcaaaagagtctgacagttctttattaaaataatatcattgtaccttttagtagtgtttgtattaaataaagatagctttgtcccaaaggccaagcttctaactttatactcattttggagatttcttatctggtttatcatttgtggcagttttttgttttgttttgttttgttttgttttatcttgttttttagtggggagggagtgtcattctgaaaatagaaattgacttcctacccctagtcagtgtgaacccaaaagaactgccagtttttttggataatggtttactcagctatatctgttttatttactgcctggatctggaccacctcaagtttgtccagctaattaatcttctcaagtacttgtatcttagccactcagtgagctgacttcatctttcaacaatatagttcataatatattcaaaagcacttaatggacggtttccttactgttagaatatctcccaaatatacaagcctccttcctcataggcccccacacatttattgtttacatcccaggtgttcattttatactgctaagctgtatggcttgcagtactgaatcagtaattctggttagaatatttattccagtgaacatatatattttctggtgaaaatattctattactttgcctgcactcctaactatatttttgttggggaggcacatatgtacagctcctttgggggcttcttcttaattaacaaggcacagattgtcatgatagaataggaatgctataaacagtccttagtatcatttctcccgttttataacttgctttaaattattccttttgtctttcaaaaccatataattttccttcaatcttaatctatctttggttttcaccctagccctccagtccacttttaaacactcttatagtctattcatccatcccccaagctataaaggtttttttcagattttctctttgttctctgcttcctgtgtactttttgcttaagctattgctttttgtccccttgtctgaccacaataagctactttcaccaggaaaactgtcaaaatcattcacctttgaattgaccattacaacccttctcataatcaaatattgccatcttattaatgccaaactattcatgtagctctgcagcaaacagaatgggctttgagttagatgacctgaatttgggacccagttccaccactgactgaatgacacacctttggctagccaccaagtctcttcaatttttatgtatcaaatgaggtagtaataactagtttaaacagttattaagagattcaaatgagtcagcatatatgtaagttatttgtaaattctaaagctctatataaattttatgtaatcttaatttgaattaaaatatgggcacttgggaaggtataaataataacttattactgtaaactccttagtactaacattatattttgctcataagtggagatatcaaatgagctaatttgattatgaattttttgccacatacaaaaaggatacactcaaactttttgagacgtacacttgtaaaatatttgtctcatgcatatacagcttaagagttacttatagcatcagtcagtggttgtattttcattatctctagtaaaacattgagtttacctcttttttttagtaatactcccaaccaaagtgattatgtaatttttgaagatagataggtctttcaaatttgcctctgcttgtgttctcaatgtcacgtttagttcttcttttgcttttgggagaatccatttattctttctgtccaaaactaattagacaaaacacatgagtaaaggtgtgaggttctatggacttgaaatcacaatagccttttacaaaatactgagagcactgtttgcaaattgcaattttgttattgtgtcaattttttgccattccttttgaacaaagcattaatgaagcatttgtttatatttttcttatgatggaatgatggtatttgtaaaaaactataaatggtcttgttgcatagggttttttataagttcattttaaaaattggtttctgagaaattaatgcaatttcatgtttttccaattttacttcaatttattatatatttaaaaactcatacacaaaatgtatgcgaataattctttatatcaaagccttattgtctaaatttacatgagtttaattatgatcctttggccttttacttgttttttctttgtcagaattcaaatctttgagtagtcaacaggtgataaatgtcccattaatctttctgactccctagaacctgagcatgagaattgctgatcagttacaccaattgtctcgtaaatgagcttctcacatctgcctcttatttcattagttaactgtctgcccaaatatctgataagatggaatactagtacctttttacagcttgttctgtcggtctgtacaataaggagatagggtcgttagcaaaatgggcacaaaagagtatttatccactacctacaataaatatgcatgctagtgtctagaaggcatttgagactgtttattgaaatcacctcaagaaacaaaaataactggtttcacttcgattttccatttagcaacaaataatgttaagaccatggcctgccttactgtatgatgcttttactaattacatttatcatcaaaagaagaaaaatgatagtatttctaaaaactatgaatgttcttgttacacagaagttatttttgaaagaggaaaaatctatttattaaattaattttaaaaacagtgaaaaactttagaaaatatttttaaattaccaaacatcataattaacgtactctcaacagtgtttttaatacttgattacctcattctctatgttggcacttcgaaaaactaccaattaagatctgctttcttatatacatcgttatacagcagtcatacttttaattggaaaaaatcttgataacttcatcaatacatataagaattaatgtttaaactgtttataggaaatatacgttcttaacctgtagaatgggaataataatactatgtcacagagtataatgataattaaatgagaccatgcacgtaaggcactgtgccagtgtgttaaatattgcccagcacatgctaagtgatcaatgagtagtagccattattacatagacattattgcaatcaggtttttttcttctgctatctatttggggagattggagtataacggtgaaatattttataagcattgcttgatgtgttaatcatacattttttattatttttaaaattatttaataactgataagctattgaaattacctatttgtaaattaattttgtcttttggaacaaaatttaggcagaacttcagtgattattgttctttgctccaaggaaacaaccatataataaatgtcattggcgtaatagcagctatacctagctcatcaattttaataaccttccccaccttgtttaaatgtaagaaatgcctcaaccaaataaacaaccaaagcatgaagtcagttttcgagtattttcacatcatcttgtgacaaacccacagccaatatcatactgaatgggcaaaaactggaagtgtatctaaatagttttaaattattgctaaaaatgtatgctaggtgaacattttcattcagtttaccttaggaattctatttaaaagaaagttttttttataaattaaaattatataatgaattaactcagaatgataatttctgccattgtaatttcattttgttttaacctttctttgttgtaggccttgtttgtatgaagtccagcacatctgtggttgagcttgttatgctgctttgttctcaggtacaaaatcccattcactcagttacattaatatatgagggttttttgtgactaataataaaaagtatgtgcatatatatgtgtatgtttatatatttttaaaatttccatctattatcccatagatggagaaaataatttatgttgagttttattagtatatagattatcttaccatgtaaatattgacttattctccctctcccttcttctactctttttagcagtattattctcctaccctttcgattcttccattgtttcctatcatatatatgtatataaaatacgatatataaaatatcttaatttataatttttaaatgtattattaattatcttgtatcttcttctcttatatttgagataatgaaaagtaagtttttaaattccatacccaaagtgtatgatacagcttattaatgaatggtctttgatataagaccttgctgctttctcttttttaaatgtaatttgtatatgtcagtgtaaattctaaaaatctacttgagctgtttgtctttaataatcagaatcaaagataaatgataattgttgggtattgtttcttcttaacaattacagggcaaccaaaaataaatgtaaacatattttctgattacttaaataggaacctattggtttttcttctcaccagctctgtcaagtctcctagcagtcctgattatcctgattatcatattagtgttaaatattttttaatatcagaaggaaaaaagagcttgtgtgtgtttgtaataagcagttattatctttattcgtagtttcctcagtagaaagaaacatatatctaagctattcctaattactggcctgaggtttgcctaaagccacagctaactcgcagacaaacaacaatatgctttcaagtgatcctctaaaacatcagcaaaactgaacaaaacaaatgaaaaacttaccaattgatttcagttttcaggtttattttcttcaagaatatattcctaggaaaatcattaggcccattttcctctttatagccaggaacaatattgataaggaagaggttaaagaaaacaacatccctgtgaggaggtcgtctgcagggcatttgaaaattttgtcacctactgttgaagtcctgagttcgagagactatctggaccttttcgattcatgatgatgcacagttctgtaaaatgcgtttatggaaaaatagcttagaattccttcttccatagccctgtgtttcactgcagttcagagaaataaagaggaatgtagcattaagatctagtgtctttgatggcctcatcatctaatcataggtttaacattactcatttgctggctccaggaattcctgccattaagggccctagagatgaaactttgcctcagatattgattgaaaggaagagtgagaaatttaagctctctatgcagtgcactttctttcagtgtttcagcaaagcaatgttgtaaacacacctctcgatttgatttttaagttgaatttttaaaataattcagtgtttttaaatattttaagtgtttaattgattaaatgcacctcatttaagtaacttaagaatatatgcttattctttaaaatagctcccaattgtttttgttattttctgtttaactgaaataatgctttcgactaaatatttttaatgaaacaaataatcctcctttattcttattcaggggggataagtttaccattttactgtgaaattaagcttctagaactatctttgtagatcattaattgctccatgaatgtttaaaatcatgtctttagttgtaaggacacacataccaaaaaatggacatgtcttcaacgtttcttaaaataatgtgccatttttctatactacttaaatttgagatgatttatatcctattttcatccattaacagggcaacatagcagtaacatacctctgaaaagagaaataaatacagttaatgatgctgtggagattgcttggcatagctctctccaaagcagtgttcttctacagcctttaatgcatctcttgtagaatgaagcacagtccctgtagaattagtacagttctgtaggccgtctttgtgccaaggcagtaggtaatcctgatgaatcttgaaagctgcagagttctgagttctttttgttttgctctacagacagccctttgtaagtcttgatagctccatgttactgtcatgaccagtattaatactaataaaaatagttgaaaatctgaatgagtaactttaagttactatcttgatatactatgtgtatatttttccacagtgagaaatccaactaagatattattcatattgtaatttaatgctggttagaataagttggaattctgcaaatggaatttttaatgtatttatttgcataaaatatgcttttctttttccaaatttagacaagccattgaaagataaaaattttttgagagaccgggcagataagtattaaaaagggaaaagaaaatgcaatattgtgttttttataggattttgtttttctttgctacaacacattagatggcttttatttttatgcttctcattttcattttggaaatttcctgttagcaactacatattattaaggatattagcttttctttcttatctgagctcctgaataaacttactattcctaatagtttgtgcccaaaatatggtctaaatttacgtgagatcatattacaagtgtctgaaggtacttgtcaaggataattcagttcatatgggcaaacttttaaactccaaaggctatatcatccagtctaccccccaatgtaatttttcatctttgtggaaaacatatttaagtcttaagaagaagctgttaatattatcattctgatatatttatcattccacaaatacccaaaacatttttgactgtattctggatttttttctgatatagatcttatgatacaagtatatttattcttcttcacttttattttgtattaaagttgttagtagcattttaaaaattggtttcatatcattttgaagtgaaatgaactaaagtaaaaaaattaatatcaaatcagtgcttaattagggagtacaaggttttctacagattcttcagtatatcacaggtctgatactatcttctatcatagctttttaaaaaagttttataattagatatgattgaagtgcttattctctatttgtgcttattggtttattacattatttttactgtattgtgctctttgatgaatagcagatttagttttcaagtaaacttctttaggtgctataatagttcctaattacttccagattttttaaggaagtctccataagatatactccaggaaaagtggactgatgttatcccatagcatttctgtaagtttttataagtaaagcttagcagatggcacttgcatttttctgtgccttatctgtcaatagaaaacattttataaattgagaaactgtacatttaaaaaattcttagtatttaaatgctttctgactggaggcaatgattaagcaaatgcatgcttagtaagtcatttctactcttactgaaaagctaaagatgtataagtaatataaagtaagaggcctgcaagtcttagttaggcatctgtgtatgaagtcactaacatgaattattttgtggtttgtttgaatttacttttttctaaatacctcatatacttaaataaaaagaattttagtgacttcattgatgtgatcaaagcattaacccaggacttctaaagacaacacttgtaaaagaaccacaactaaagaacaatcttttttttttttaatgatttggcctttgaacatttacgtttttcatttttcctccagtgtgatacagttgagtcaaatagtacaaaagaaaaaaatatacttttcttctgaggctgagttacaaagacataggtaagagaacatagaggcctattaaaaaatattcattgtaagtactcagtagtgaaaggatttttggtgtgtatagtaagaagatttcaaatataaggaaaccagggatggagtagatgttttttccccgttgtctttggaaatatcatgaaatcctaattatcatgatgaagttatgtcacatttaatttggtagttatttagtgactacattttttaaacattttaatggttactaaagacttacacattgttccatttctcatgtttagtgttatctatgaaacttgccagttttgctgctgaatttgaattcaattaagaacaataaaaaattatgacctgatacttaaaactgaatataaatgagcagttacctttgtatggttcagtaaatgggtcctatgtaccaacaataagattgtcatggaaaagtttattgaggtgaactaaaaatgagccctgacgatgcaaggtatcctattcagcataagcagcggagaattgggctgaagaaacagcctgagccctgtttcttcagaaacctgaggtctggagaggaatgagtctgttcaacagtgtctaatcatttggcttccctgggccacactggaagaagaatcatcttgggccacacataacatacactaacactaatgacagctgatgaactaaaaaaaaaaaattaaaaaaaatagcagaaattaagtggccaggcaatgtataatatttatatttaatatataaatataatatttataatataaataaatataatatttatttgtttatctagggtattatccatttccaggcaatgtgtaatccaataccttcctcaagagtatttttaatataaaatattgtagtgtgttaatagtatagaattaaggctagtaagaaatgtctaacttttaaacagtattggatagttcatgatcattgactatagattctgtttttagaagagccactttttcattttctaatatctaagaaatccctgcctttttctctagacggtgggtgaccccacctcttatctgtgatataatgtcatttccaagttaaaggggtcaaatttgggcatttaatttttttggagtgtctatgttatataatctttattgccataaaagtttgtaatatgtcctaaagtataaataaaagttaaacaggaaggtgaaaatacagtgaggcataaagattatagtcacctcagataacaatatttaaaattattagagaatatggagaaagttatgtactgaaaatgtagacattttaaaggaaaaagagtatcagtagaaaataattgggaaatctgtatttaatatatcttggggagaatcagtacagaacagattgcaacaggaagacgggctctctgttatatgttcaattacttacagcattcctggatgaaaatttaatcaaagatttaaagagcatataattcaaattacttttgattagttctatgagatattttattgttgaattctttttttaaaactcttagagaagttagcaggtataagaaattttgagtcagtctcttttatgttataaaatattttttctaagctacctgtgatacatacaatactcacacatcacataacacttatatataacaacttagcacatatccacctcaaattatagaggtaatagtttatgaataaacaaaaagttctgacctcatctgttagaaattataaactaagcctgatcgcggtggctcacgcctgtaatcccagcactttgggaggccaaggcaggtggatcatgagttcgggaccagcctggccaacatagtgaaacccgtctctactaaaaatacaaaaattagctgggcatggtggtgggcacctgtagtcccagctactcaggtgactgaggcaggagaatctcttgatcccgggaggtggaggttgcatttagctgagattgcaccactgcactccagcctaggcgacagagcgagactcagtctcaaaaaaaaaaaaaaagataaaaaagaacaacagtcttttttttcttatgtctaacttctcataattctaataaaattgagggaaaaaagaaatcaataaccctaggccatctgcaggatcatttttaagagtgtttaatgtctgtgacagaagagaaggaatgtagaatattctgaatccctgaatccctgacactaagcccacctccctgacctaaaatttctttccatactttgtctcaaaattcacatttccctttctcccagtattttggtttatttttctttaatctttattttcctgtgtctacattgtataagtttttcagacaaattacaacaactttgaaaaatagtgaaaactatatatatatatatttcacacttttacttctagtatacattctcttttttggtggtaaattttcttcatttttgtcacacatatttcaatatgctttatttttattagctatcatataataagtagttttctgtatcctcttttttgttacattgtacatttcctcatgatcattttttctgtggtttcgttgtttaaataattagagactcacaggaagttgcaaaaatagtacacagagtcccatgtacccttccctcagcttcctccaatagtaacatcttacatataactgtagtagagtataaaaaccaggaaattgatattaatgtagtactgccaactagatgatagacattattcagcattctctcttttttacatgtgttcatttgtatgtatatgtaactcaatacaattttattccaagtattaatgaaaccaacatggttgttcctgtacctcatatcttcccaattatttcaaactcttttatttcacgaagcctttctgtattattattgttataaggttctaatctctccatcattcccttagcatctgagtgcataaatctagatgataaatataggtatctgtttatatgttttaattggatgctcttatatgtgattaaggtatgattttctttatctaccacatttcaggttccattagaataagctgcatttctagtatttcctttctttttgaagaattctattctgccaatggagaaaataagtattgtatagtctcaatatattaacatttatgaagagcatttaaaatcatacattgtttatttacaacaatccagaagaaaagactacttaaggatgacacagaactttgcagtttcgtgaagtcactttatggatgttattcatttcaattatgctacaaatttacaccatactaaagatcactttatttttctattgccttctgttgtgcttaccactatgtcttccactcctagtataaatatccagcatatagtataggtagttattaatgacattttgagttattttataaataaaaaggaatatatattagctaaggtgatttgttatttatttttattgtgataaaatacataaaatgtaaaatgtgccatttttaccattttaagtatacagttcagtggcattaattaaattcacaatgttatgtaaccatcaacactacaatgagaaggttagggaggccagtccccctacacagtcaaaaatatgcatataactttttactcccccaaaacttaactactaatagctcagtactagtgaccagagccttaccaataacataagccatcagttaacacgttttctatgttatatgtattatgcattctaatcttacagtaaaataagctagagaaaagaaaatgttattaaaaatatatatagatacatagccagtgtgtgtgtgtgtatgtgtgtgtgtgtgtgtgtgtgtgtatatatatatatatatatatatatatatatatatatgtatatgcttctttttttaattttaatgtagtccaaaagtacaagaagctgtttcagaggtcaagaatatagtaggtcttcaaacaaatggcagctaattatgtgtcagagattcttgtacttagttaaaaatgatgatctctaaatttctctacagcactaatgttcttatactggcttccacaactattgctgcatgatcatttgtgaataaaatatgaaatatttaatataacttagtacctatttctaaatcttaaactacacatttgaatgtgagaaactttttaacaactcaaacctaataaacatgagtgttgtatatactcatagaatatgctctctttaaaaatatcttgtaaaacagtctagacttttttattacaaacacaaatacaaatacatacactcattttataataataagatgtgtccaatttgaaacataatttagtgatcacctaaagtcctggaagcctgcttatgtttatatgatacgccaacttttccttgagtaaccaactaaatatatttcagtatttcctaattttttttatggttgactattatatcggtaatcttctctttgaattgatcattcattattcatttcttacattcagtttttcctataatacttttagtaagatcttcataaaaataagaaatgaaaatgaaataaatggtactttaaatacttcacatatatattttcagtaattatgtatgttttatatgcattgaaaaaaattctcgtctctattttcaccctacagagtgtttttttcacttcactccttatacttactgacttcaacttacagcacagaatttctaaacatgccagttataatgaacattcactttgaaaattttaagaaacacacctatgtattttagtgacagataatgataaatagatattaaagatatcagaaatataaaatcaattctggaattcttgaagacttaagatatcaatttactctaccatttttccttgtaatttttttatatattcaaaacttttatgatggattgaatctctaaggacggtttatttaattgtatacaaagaagagggaatgaaaaatgtacattgagttgacatagatggggagaaactgatgggaagcattatattttggatctgagatttcttcgactagtccatctaactaccataaagcgattgtgaagagaacatagggattttatcgtcatccttctggaacttatttgtcttcaaagtgtttagtttcaaagggtccttaacatgagatccagttccctgaaaaagtccttcatcttgaggaaattttatgcatccatgttgaagagttaaaaaattgtgacaaaactatctaaagacttggcagctctctgcaggcattcaaacccaaagttaagtattgtccccatgaaaataaaaggttgttcatttattttttcagcagaaaagtgcatatatgtctatgtaggtgtgttttctcaaatggcaaaaaattctggaataatttgtaagataagactttaaaatatacctttttcctgtcattgccaagagcttgttgttgatgaaatgacagtaaattattcttatccctttgcatgtgttttcatgtatctgtgtgccttgttttaagcaaattctctaagtttatgtatttgtcagagagaattgttagagtgctaggacagggactaaagttgtcttccatgtccacctctatcccattttttaactttcaaggtagcttatatctcagcatccacaacaaacaaataccgtttctcctctatgctatgtacttttcttgtcacaaagttttgtttatctctcctttcaatattttatccaattattttttgaagctcttagaatcagttacatagtaatatgcacttaagaagtactttttgaaattagccgggcatagtggtgcacgcctgtagtcccagccactcaggagggtgaggcaggggaatcgcttgaacccgggatgtggaggttgcagtgagccgagatcgagccactgcactccagcctgggtgacaaagcgagactctgtctcaaaaaacaagaaaaacaagtattttttgaaattataaaaagaaatgtgcatcagtataaaagaatataatcattgcctacccaagtttgttacaaaaattcagaaccgtgtgtatctcatttacttcacacacactgtaaataaaatactacaaatataaataattccatttcagaggcaatgtttcatgattaataaaagtaacattaactgatgagaagatgatgtaggatttatcccatttcttattttcagagttttaaaactatttcgtttacatgctttaagatttgtttcattgctatcataaattcttagaccttactcctatggaaaagggcgatagaaatagaaatttttagacctgactcctatggaaaggggcaataagaagcataaattcttgtcataggtattgcacttttccataggagtcaggcctaaaaattcatcggtagcttaggataaccaatggagaagatgccctttgttacacttttcctataggatacatttttcttctcattccgtttttttctttatacttatgcatttttgtttgccacccaatactgtgtactgttgtctacctaggatgtaaagggattggacttctcaactaaatatggtaaaaaaaaaattatctttgccacttttacaactgtcattcacaaattattaaacatgctttaaaaaccacatgcaatcctaacattttctgaggaggaaaatatactttatcttgtgaagaatattttatagtcccttttctgtctctcatttagtaggtgaaaaaaataaacttctgttttcttcattgaccacaacaatgagagtccacaatatgtttttttttttttaattttactttaagttctgggatacatgtgcagaacatgcaggtttgttacataggtatacatgtgccatcgtggtttgctgcacctgtcaacccgtcatctaggttttaagctccgcatgcattaggtatttgtcctaatgctccccctcctctttccccaaccccccaacaggccccagtgtgtgatgttcccctacctgtgtccatgtgttctcattgttcaactcccacttatgagtgagaacatgcagtgtttcattttctgtttctgcgttagtttgctgaggataatagtttccagcttcattcatgttgctgcaaaggacgtgaactcgttcttttttatggctgcatagtattccgtggtgtatatgtgccacattttctttatccagtctatcattgatgggcatttgggttggttccacatctttgctattgtaaatagtgctgcaataaacatacatgtgcatgtgtttttatagtggaatgatttatcatcctttgggtatatacccagtaatgggattactgggtcaaatggtatttctggttctagatccttgaatcgccacactgtcttccacactggctgaactaatttacactcccaccaacagtgtaaaagcgttcctattgctctgcatcctcgccagcatctgttgcttccagactttttaatgatcgccattctaactggcatgagatggtatctcatgagagcccacaatatgttttatgctaaatcccagaaaatagctgatacaaacttatctttaaaatttctagttttagtgctgtctgtatggctaaagtcattaattctccaactcttctacttgaagcagcgcctcatgggctgcagtagggaggagttggaagggtggcccaaactgtaacgcatgccaaccaccagaatcacaaatgttctatgctcttaggctttcaaattctcattttactttattgttcttacattccttaatattttgaattagattactttagataattttttaattttttgttttcctctcaggctccagggggctggacatgtattatatatcctgggcatagttactgcctgtgtcttatgtatctcataccccaaattgaataaacaaaaactttaaactcccttccttcagaaaagacaattggtaacatttttgtgaccttatacattgttaatagcagttcataattgttcatgtagttaacagacattgacttggtaaattgaaattatgcaaatagttgcaaatagctgaagaattttgaaaaccttcaaaaactgaattatactctcttaatattaggtggaaccactttggctattgcttaggtcaaggcctgcataaactgttcttgtgccccagccatatcatattaatggagcatgtgtgacagaaaacaaaacattcatatctggcaaacaaactaataatagaacctagggaaaaaaatgcaccaggaaatataaaatttaaacatttttatacataaggattttttctgtgtttgccattcaatgttggctaaacttctagaattaaagtcttgtttccttaatgttgtagtatagtcattatgacaattgcaccatctatttcttctggccctagtgtcatcacagattaataaaacctgtctcttcctttaaaaatacagtacttaaaatctaattatataatgtgcacataaaacacataaagagtaaactgaactcatagagtcacatgaagaagactgttcagccagctggtgttaaactcccatattgaaaaattggtatttcaatttaaagttgctttaaattcctatatcaaataaaagtatttgatgtctacctatgtcaggacaggtgagcaggacagatagcaggatagacagaagacttaaatttcctgcagggcacagaggagaacaaaaaaatcttctttacattaaaaaaatcctttctcattttcataattagtaatactttttcatgtcttcatggaaaatgagaacccagttagattcgttttctataggattaaagaaacactatgttcaattagtattgttcatccgtagtagtattattttaagaggtctcattaccagtcacctggtttcatatctttggcaataacaagaggtggattgtatgttaatcactattgacccagtagatcactagttaataatatttattattatgttactcagactgtagcaggtattgatttaaaattatattagaatttaaaaccacatatatcttaaattcaaaaagaccaagacaaataagaccaaggagtttacagttttctgggaaagaagtaaagtttacagtcatgttactaaagtctgggtgccttcatgaataataaatggactattttatacataaacaagtacaggaaaacttcacactttttactctttttctgaagaattaactgttcttatcccttttcaggacactccattcttttatgcattcatcaggatttctgtcacctttcatctcttgtaatctttctgtctctccttcaccctttcattatggtccataattatattcaagtctcttcatcataaaaacttcacaaacactttcaaacctatctttctctgagcatcctgtccattgtttcttggctttaatcacaaagctttttgtgattgtttactctagttaccactttctctttctcacttaccagcccagtacaatgactttcctcccagcatttagggcctgtcttttgtcctcatcatacctgactttcctgaaatacgaaaatgacaatgtaatggcatgcaaacaaatgaaatagtgatagttttctaatgattgtattttaaaaatatggaaaatcttgcaaaattaaatgagaatgtgacacagtcccaccatcaaaatgagaaagtgacacagtcctactgtcagaaaatgtttaatattctcttcgacaagaagacttctgccaccctctcttcctctctaatagtgactcttcttttggtagaaaactaaaaaaagagcaactcaggccttctgagaaaggagttgaacacaaatacaggtcaacagtattatattgtcattgaacaaattcaggaattacattgccttgacaaaagcaattctctgtgtgtgtgtgtgtgtgtgtgtgtgtatatctgtgtgtgtgtgacggagtcttgggttgtcacccagactggagtgcattggcgcggtattggctcactgcaacctctgcctcctgattcaagcaattctcttgcctcagcctcccgagtagctgggattataggtgctcaccaccacacccggctaatttttgtatgacaaaagcagttcttgaagggaaaacatataattgcagtgatacatttttattcagaatgttttcataagtcttctgtgttcagaatctctctctgtaggctgataaagttactgtttcctttttgacagtctgttaccctgctttcagtacaagtctctcctgattcatcacagaaactctttatggttctgtaaaactatcactgttctaaaaaaattgtttttaaaaattttttatatttactgtgtgtattttaaaggcacataaccaacaaataacagacccctactccaccactgagatccactggtcgaaatcaactatttcaactcttttatctgtttactttattagtaaactatatttttgaaataacactgttatactaatgttcttggtttttcaattttaaatattttttaaatttattatatatagcatgtcactcttacaatgcggccactaccacctactaaaaaatatgggggaaagtttctgcttttctcagcatttccccactatagccatatcacagttttaagtgtgtcagtgtttcttgtaagtatcatctgtagctaaactatccaccatttccttcctaagataactattttcttttagagtgaattgcctcttcgctctttatttgttggctaagttttctggatgcctgttactaaatttcccccaaactttccagtagaactaaaaacctgctctaactctagtgcatgttaagtattctgtcagcctctgcttaatcctgttttggtacttccattaacaattatttagataattttcattgcctctgtcttgtttcagtctaccatttcttagatatgggtctatctctttttaaagttcttttcttatagtatgtttagggtttgtcacaagttctttccgtcttattgagcgcttttggtgtgtttgcattcccctcctccagtgagattgggcttcatcataggactttctctggccagtgaatatgggcaaagggacatgtgttacttctggctagaagctacaagagccggggcatgcttagaccccttctctttccctccatcttggctgccaacagtgttccagacaattgcaacatagtatgactcccaggatgatgccaatgatgatgtagagcagaacacagacagtggacacagaatttgagcaagaagtaaactttcatgttttaagcccctgagattcggggactagcacaacataaacttgtttctcctgtttgatatattttctcattttggcagagcacaccatcggtgggttcttgaacaagagtcagtgataaatttttatgcatgtgtgaaaatgtgattattctatcttcatatgttactgatagtttggctgcatagtttgttctgagtattctattcttcataattttgaaactggctgatgttaaactctcatattgaaaaattggtatttcaacttaaagttactttaaattcgtatatcaaatgaaagtatctgatgtctacatacatcaggacaggtgagcaggacaggcagaaagcaggatagacagaagatttactttcttccatcttctagttttgctgttgagaagtctaatctcattcagattcctgattctttatataaacttttattttttcctgcaagcctcttccttaaccctggtgttctaaaatttaatgatgatatacttgctaggttatattatgtattatattgttcatcatataattaaatcctagaaaatatttgaaattcctttgataatttcttgatacaatgtttctcattcactctttctaaaattcctatttactagatagtgacctttaaaaggaagatcctctaatttctttgtctcctttgttttctatctctgtctttttggttgtacctcattatctctttgttctattttctgggagatattttcaactcttttttaatgtatacaatatcttcatatgtcccagttttattactacatttttttggtgttgcttcattgtctctcattatttgggtttcattcccttccctccaacccccacctccattatccctttctaatattggtctgtgtctttaatataaggttgcaaacaggatcataggtagtgactttgaaagtaatatttgtcattaaagggtcctttctctttctgttttcctgaggcaatgtatatacgtggagtgttttctttcaaataatgctataatattctgcttctgttcttaaattttgatagatctttttctgtccctttctattgcctctttttgcaatcttaaaaatgtgaatcctttccagcctaggaataccttctcagcctagatatttgatcctcgttttgtttatacttcttaggagactttgcccaatgttatgccttactcaatatttctatgtaaataattctgaatttcacattcttttttgatataccattgccactgtaaatccaacaaattcagacaacagtgtttgtgattttccccaaatgtattcttcagtattttcataataatattaccattatcctggtcatgtacattgaaaacttaataatttttttatctcaacttctctacatcagctcttaaattcagattctcatctagtctcggcatctcttctttgtaacatctcttattttttattccctatttgaaatactcatttagactcctaatatttctcttgtggaaaggcgtgtaacaacaatatcctacaatttcctctggctcaaaactgacaaattactcttctaaaacactgatttattgaatgaagtcttgtgatcatatactttcattggctttctcaaactttaaactgtaatgtccttagcttagctcagacttacttctactgttcctccatcaaaggttgtaaattagtacatctcattggctgtatgcagattccatataattttagattgattcaaagataattttctcttgatttttttagacaaggcatactttgggatgcacatgtaatacctagatatgtactctgtgaaatatcttaccgaaaaatcttattcatgttagaagtttatggtgactaaagagtcttagtgtacaaacactatcacagaaaatcaggtgtaagaagttgtaagaatctagtcttcatagtggcatgggtcttcgtatgtaaaaatcaattttctctttaagttaatatcccaatgaatatgaagtatttctgagaaatgtatgtattttgtaggatcctgatttccaataaatacagaatatagaatgagaataacaaagaggctttaaattttgtaaacatttgggaaaagaaattttctgtaattgttttatacagaaattgtttgaaagtttcagtaagttctgtacaatggaatagcagtcttgtcatttggataaattttagttaaagattatgatagctagaacccagtggctttgtactatccccaagttaccatatctcttttcactagttgttgattttctctccttgggagattcaggatttgttattctataattcagcacacatttacttagagcagagaatatttatatacacacaagtacctactttgggggaccatatttattttcagaatgagtgtaaagcctttaaagggaaagggatcaggagtagaatgaagggttgatacagagactgtgttttttgtgaagctgaacccatggccagggcagctgatcacctctgtacaaccaacaccttattagaaaaatcatagggggaaaaatctatagaggagggccatgactggtcaataaagatttttctattaaaatgcattagggaactttgaggagtatttagttatagaaccattggaagggatataattttcaatccaaaacactgctatttactatatatatatatatatatatatatatatatatatgtatatatatatgtgtatatatatgtgtatatatatatgtgtatatatgtatatatatgtatatatgtatatatatgtatatatgtatatatgtatatatatgtatatatgtatatatgtatatatgtatatatgtatatatatatgcacacacacacacagatatatatatgtatttaaaaccccatatatatatttaaccccaaatatatatatttaaatatatatttaaaaccccaaaatatgtatatatttaaaaccccaaaaatagaaatcactagcataaaccaaaaacagtatataaattatattctaaatgtgctttaggaacagcataaaataagcatatgcttttctaatccaaaatacttcattataatcacttatgttcataatgatgagccttaccttgagaactgccaaattcacaaatataatctaaattagcagagattacatagttatctattacatatttagccataggtttactacttttttttacaattttcaaaatagttaatttgtaacttttttctaattagcattaaataattagcattaagtaatttggaatgtacatataactagaacattgcacttccaagtcaatttaaatatgttaatgtttctaagagtttatatttctagtattcattttattatcttaatgtaaaatttctatatgaggagctaaagttttctatcccaaatatttctagtccttgtgtagtcacattaggtctcttttggtcatttgctgtcttttggaaagaagctttgtgctcagagccccttatacctgcagtctcactttccatctcagtttgcatccagcctgaaattttctggtgaatcaaaagcaccttataaactaagtgataaaactaaaatttgattttttacaaaataatattcattacaaaatcttgtaaagacatttggaaataatataatgtggaagttattaacaatatcaacatgatccttaaaccagaagttactttcattaagtgttcacttttctcacgtttgttttggtttctccttttaggaatggcaaaactctattcagaagaatgcaggacttgcatttattgagctcatcaatgaaggaaggtaattaattttacaattttagacaactagtcagtgtacattttattccactgggcaattgctctttcctaccatctgttccaaaaatgtagaagaaaatgtcttttagttaaataatttatcacacaggtacttaattaatctttaacaaagtttaaaatgctaaacatttatttttgaagaaaaagccgtgcatgaaataaagggacaaaccttataaggtttggtgagatctgaagtacattttactgagtagtaaagttgttttacacagatcaagtgaacccaatctgcaatcccatctgccactccatctgttttcagagcagtgctcagtgtttactccttcagcttctcctcagtccatgtgaaacagttttatctgaacatgtcatgcattcaatgtccaactgaaaatgtgagggatattaaatatagcaaatatatctgtctcggttagaaatttgtatattctattattttttttttctttaacaaaatttttatttaataaatggttaaaatcgcagtgccaaaaatacattgacatttagcaatttcactgaaaggaagaaactacagaatgcacggtttcagaaagctattttaagttatttacaaataaagtatctaaaactcaaaaacaggctctgtatgctatatctagtttatcccttcctgaacaaaatttctgttatttgggcaaattcttaaaccatggtttaaaccgtaatggttacaaaccacaaacacatccatccaaagactgaaaccgtttttatccggtcagtggcaaaactgttgaaagggcaatagttgaagctgttgggttttatatagtgtgaactctgataaatattcctaccaggactaaaacacagcacgctttgcgggcatggctgactcacaaaggttgtatattctattattaaaacaataagtaaaattacatttgaacccattatttaccattttgtggtaaatagttgttaattattatttttgcagtgctttattggcagtggacacattaaaacagacgtagctgtcaccatgtgacatatatagcttctatcagcccaagacctgcaaactttacaacttgaatttcttgtatgatatagtgcattctttggaatatgatgattatttggcatgacctattcatttcatatttgaaaccagctttcattagattaatgaggaaataatgcttactgtatataaaatttatcttttcaagtaggggagtcatgaaagaatagtccttgaaaattagtttctatatggtatagatacccaatttttaaaaattaaatatcacttagtattcattttttatcactgtattatattttgagaaatatcttctgtttttataacaatttatcttattttatatttctcattttgatattttgtgacctaatcatgttagccagtagtacagatctaaaatttaaaataggctttgcattcactgcaacaccaaagttgcaggaaaatatcagttttcttttataacgcaaatagtgttttacataacagcactcaccatgtcttacagagtttcactgtgataagagttactaacaattattatccgttttcaggtgatgaataaacagaaaaaactatttgctaaggctaatcattgtcatttaagttttagaaataactctcaatgacatatccacaattattttgtttcaactgcgaagtaaaaatatatatatatataaaattattattatcagtaactctcctaagagttatcagaattgaacctctaaacacttaaattaagattatagtaataggcttagaaaaggaagggggtggaaaatttgctaatatcagagattttaagcttctgataatgcttttgtcagtcagtggtagaatttgggatttgctttatattaggaaaggttagaaataaagaaagtagtcacaattttaaaaaaaatttcaatctaggttgggtgcagtggctcacgcctgtaatcccagcactttgggaggccaagttgggtggatcacctgaggtcaggagtttgagaccggtctggctaacatggtgaaaccccatctctactaaaaatacaaaaattagccagttgtggtggcaggtgcccgtaatcccagccactcaggaggctgaggcaggagaatcacttgagcccgggaggtggaggttgcagtgagccaagatcgtgccattgcacttcagcctgggcgatgagagcgagacttcgtccccccaccaaaaaaaaaaattcaacctataataatctctgaaattctgtccattatgttctctgtgctctcctaagtttctgtttctactcttcataggactcgttcttccaaataaatatgattttggaataaggattcaaacatgaatagctgtaaatatataagaacaaatcatgtatgcatgagtgcagcaaatgtctgttcaacacccactacatgtcaaatactgctataagagttaggaatagagttaggaataagatataaatgattccagtttcttggggaaaggcaaacattagatgaacacatacagtaatacaaggatactgtgataaaagaggtataggtaatgatgcaatcgtaccacagaataatttacctagtctggagggatgcattccactgagtggtgggattatcaaggttttcaaaagagtacttacccaaaggaatgccatttgagagatcattaggagacagccaagtgagaaaaaaaagtagaaatacaattattggcagagggaattgtatagtgcagaggactagcggcaagagaatagtgagacatgttactggagagctatttccagtcagccagcagctatttaaatgcatgttgtatgccagccacatggaggcacaggtcattggcaaaggtcatgccatgaaactgtgcaaagaatactggagaataactgaaaatgtttaggtgtggcctgcaatgtggagggtttcacgggctcaagacttgaagcaataccaatctgaggttcagtaatcttgttgaagaatatggtgtcatggactaatagtagctatgaggatggaagaagtgaacaaatttgaagtatcttttggaaattaagtcactatgattgctaatatattggatggaagaggggaaagaaggaatcaaggatattttgatgtcagctttagtaactaatagtttacagtataagtataattcacttggctaggagagtacagaaagcgaggtttgagttgagagtttttcacttttgggttacactgaacttgtggtaccagtgaaatatccaggtggagatgttcaataggcatgggcatttgagtattgagctctccaaagagagagctggcatggagatttagacttatgagtctccaggttattcgtggtaaactgtagaaaggattcagatgtgatgctcagagagagtgaatagagtgagtggagaaccagaggccctgcttttactcctgtttctgctgggaatcctcttctcccacatcttgacacgactggttgtttctcgactttgaggaatcagcttaaatgccaccctctcacagaggctcccctgactatcttatatagttgttacactcccatgacataatcctcttgtaacacataataacatcatctcaaatgatctgctctgtttgcttgtttacatctatttctcctgctaaaatgtgttttccttaagatcttgtgtcttattcatcgtcttatttgctgctatatctctatattctggaatagtgcctagcatgtagttagcatgctaatgaaatatctatttatttgccctgttaaatgaatatttattgaaagcataaagaaaagaatggtgagtggaatgtttaaggaagaatgtatggtcaaaaagaggatttttaagttagtactaaagggaccactgggttcagccacaaggaggtcatgatgatctcatccaaacttaatgctggtgaacacctgtgtgctaaagaagctgggtgtagatccaaatcctaccctattagagtttacagtctagtgtgggcaacagccttagattaagtaattgcaagtttaataaatatgtgaaggacaactagaggatgctatgggagcaggcaactgagagaggtattttttgaaaaagtgatgatttacctagagtagagggacagaagccaggttgctttgagttgaagagctagcccaaaatgaaatacagacagcaagtacttcgctaaagaaatttggccaagaaagggaaagatagagtggttgctgtaggtgaataaggtttaaatttggagagaggggttactttttagaatgaagaacctatttttcaattttgatggaaaaacgcaatatggtgggagggaaagaaggcaatattgacagcataaactctctgagaggggtgcattgagatagaaggattggcctttagtggaagagcactgagaaagggtgaagacaattaaattggtggcagaattcagaagagatttcatatgatgccttctgtctatgaagtggcaggtaaggtcatttgctgagaataaaaggaattgggagagggtatatactatctttagaaaagtaaagaatactgaaaatagcgattgtaaaagaatggagaagagaaaaaactaaagaaacctgagaggcttgccaggcaatttgggggagccaattgaggttgctgtctttgatagtgtaatgttttcttcagcagttcgcagttcagagaagataggcatttgctttaagacattgacttctcttactttagtgaaaataatcttttcactgaggaccaaccccttcctacccctaatctggattaggtacctttctctgttctcccagtacctcaatttttccctgatttatatttacctatctatagtgtttatttgtagtggattttttatggctgttccacaatgcatagtataatacatagtatccatatgttaattctactgagttcaaatatcagttctcccattgataagctgttagacaacaggcaaatcataatcttcctctgacattgtttctcatctgtagaatactgtagcacctttcttgctcagtttccctgaaagttcaaaataatatatatgatatttattacagctgctataagtccttaaaatggaagtttttacttttgttattacatataatatgtattcagaattttgcttattcccacctttagtttggatcatttctttcaatttagacttttctctttcacaagcatgaactgggacttctggttcaaaaagtcatctttaggtagctgggatgcagttccagtaaaaagcccaaaattactattactctgtttatcttcctactgtatgttgatgcccattatgtgcgaagcacaaattaaatattttatacatgcttttatcccatttgcatgcacatataacatttttacaactttttcatatggcttaatatgaaatatttaaaaattcactttatttgggttgttagaatatcagtctttaatttgtccttatgggaatgaagataaaaatctttaagtagaaattattataaatgtttatcctacttaacagctacacttttgaatacaattcatcaatcatagctggagaaagcaattgtgcagttgtctacaattaacaggacaaaaacagttgataaatgtgcatctgaattaaagtactccctgggaccggctgaaattatacactggatcatttaaaggaatctaacaaaggatctttataattaaaacaaagcaaggttaatgggatgtaaaattgcctgtaatatcttggcaataatgattggaatttgaattattaaaatatgcattgaagaataaggcaaataggaagtacttatttaaaatacagaatttgagtgatctttttaaataaattaatcatttgcctgaaataaacctttgtcactcttttaaaagaatatagaatttaatttttgaatattcatcagaaaagaacagataatatttatgtttagcactgaatttaagctagagctctcaagattctgattttttgttttgtcctttagaataggggaaaatatacaccatgcatttcttaggtttttaagaggagaagcatattgcatccaagtataattttttagtgattgtatggcaccaatttgaatgtattctttaatttaacaaatgctagttaatattttaaccaacaagcattggtttgcttgagtttatttctcttatgtctttgatttggcaaaaactgtatttaaaaataaaacaaaccaaaaaaaacttccaaatctgtaaaataagaaactatttcctaaagtagatattctggtttaatttggagccaataatctctggaagctactggaaaacagaagtttcttttccatgtgttttcttataaaatctgacctatgccaggttttctttaacattcttttttaattattattattttctaatattatactttaagttctagatacatgggcagaacatgcaggtttgttacataggtatacacgtgtcatggtggtttactgcacccatctacccgtcatccacattaggtatttctcctaatgctatccctcccctagtcctccaccccccaacaggccccagtgtgtgatgttcccctccctgagtccatgtgttctcattgtcacctcccacttatgagtgagaacatgcagtgtttggttttctgttcctgtgttagtttgctgagaatgatggttcccagcttcatccatgtccctgcaaaggacatgaactcatctttactttatggctgcatagtattccatggtgtatatatgccacattttctttatacagtctatcattgatgggcatttaggttagttccaagtctttgctattgtcaacagtgctgcagtaaacatatgtgtgcatgtgtgtttatagtagaatgatttataatcctttgggtatatacccagtaatgggattgctgggtcaaatggtatttctggttctagatcctagaggaattgccacactgtcttccacagtggtcaaactaatttacactcccaccaacagtgtaacagcgttcctatttctccatatcctctccaggatctgttgtttcctgacttttaaatgattgccattctaaatggtgtgagatggtatctcattgtgattttgatttgcatttctctaatgacgagggatgatgagttttttttcatatacttgttgaccacataaatgacatcctttgagaagtatctgttcatatccttcgccctctttttgatgggtttttttgttttatttcttgtaaatttgtttaagttccttgtagattctggatattagctctttgtcagatggatagattgcaaaaattttctcccatgctgtaggttgcctgttccctgtgatgatagtttcttttgctgtgcagaagctcattagtttccttagatcccatttgtcaattttggcttttgttgccattgcttttggtgttttagtcgtgaagtctttgcccatgcctatgtcctgaaaggcattgcctaggttttcttctagggtttttatggttttacgtttaagtctttaatccatcttgagttaatttttgtataaggtgtaaggaaggggtccagttatagttttctgcctctggctagccagttttcccagcaccatttattaaatggggaatcctttccccattgcttgatttttgacaggtttgtcaaagatcagatagttgtagatgtgtggcattatttctgaggcctctgttctattccgttggtccatatatctgttttggtaccagtaccatgctgttttggttactgtagccttgtagtatagtttgaagtcaggtagcatgatgcctccagcattgttctttttgcttaggattgtcttggctatacgggctcttttttggttccatattaaattgaaagtagttttttctaattatgtgaagaaagttagtggtagcttgatggggatagcactgaatctataaattactttgggcaatatggccattttcacaatattgattcttcctatccatgagcatggagtgtctttccatttgtttctgttctctcttatttccttgagcagtggtttatagttctccttgaagaggtccttcacatcccttgtgagttgtattcctaggtattatcttagtagcagtggtgaatgggagttcactcatgatttggctctctgtttgtctattactggtgtataggaatgcttgagatttttgcacattgattttgtatcctgagactttgctgaagttgcttatcagcttaaggagatttggggctgagacgatggagttttctaaatatataatcatgtcatctgcaaatagaaacgatttgactttctctcttcctatttgaatacgctttatttctttctcttgcctgattgccctggccagaacttctgatactatgttgaagaggagtggtgagagagggcatccttgtcttgtgctggttttcaaaggaaatgcttccagtttttgcccattcggtatgatattggctgtgggtttgtcataaatagctcttattattttgagatacattccatcaatacctagtttgttgagagttttttgcttgaaggggtgttgaattttatcaaaggtctttttgacatctattgagataatcatgtggtttttgtcattgtttctgtttatgtaatggattacatttattgatttgcatgtgttgaaccggcgttgcatcccagagatgaagccaacttgatcgtggtggataagctttttgatgtgctgttggattccgtttgccagtatgttattgaggatttttgcattggtgttcatcagggatattggcctgaaattttcttattttgttgtgtctctgccaggttttggtatcaggatgatgttggcctcataaaatgagttagggaggagtccctctttttctactgtttggaatagtttcagaaggaatggtaccagctcctctttgtacctctggtagaattcggctatgaatccgtctggtcctgggctttttttgttgttgttggtaggctattacggcttcaatttcagaacttgttattggtctattcagggattcgacttcttcctggtttagtcttgggagggtgtatgtgtccaggaatttatccatttcttctagattttctagtttatttgcatagaggtgtttatagtattctctgatggtagttcgtatttctgtgggatcagtgtgatatcctctttatcattttttactgtgtctatttgattcttctctgttttcttttttattattctggctagaggtctgtctattttgttaatcttttcaaaaaccagctcctggattcattgatttttttgaagggttttttgtgtctctatctcctacagttctgctctgatcttatttatttcttgtcttctgctagcttttgaatttgcttttgcttctttagttctttcaattgtgatgttagggcattgattttagatctttcccgctttccattgtgggcatttagtgctataaatttccctctaaacactgctttagctgtgtcccagagattctggtacattgtgtctttgttctcattggtttcaaagaattatttatttcagccttcatttcgttatttacctggtagtcattcaggagcaggtttttcagtttccatgtagttgtgtggttttaagtgagtttcttaatcctgagttctaatttgattgcactgtggtctgagagactgttatgatatccattcttttgcattggctgaggagtattttacttccaattatgcagccaattttagaataagtgcagtgtggtgctgagaaaaatatatattctattcatttgggttggagagttctgtagatgtctattaggtccacttggtccagagctgaatttaagtcctgaacatccttgttaattttctctcgttgatatgtctaatattgacagtggggtgttaaagtctcccactattattgcgtaggagtctaagtctctttgtaagtctctaagaacttgctttatgaatctgggtgctcctgtattgggtgcatatatgtttaggatagttagcttttcttgttgcattgatccctttaccattacataattcccttctttgtctgttttgatctttgttggcttgaagtctgttttatcagggactacgattgcaacctctgcttttttttttgctttccatttgcttggtaaataatcccccatccctttattttgagtctatatgtgactttgcacgtatgatgggtctcctgagtacagcacactgatgggtcgtgactctttatcaactttgccagtctgtgtcttttaattggggcatttagcccatttaacatttaaggttaatattgttatgtgtgaatttgatcctgtcattatgacgctagctggttaatttgcccattagttgatgctgtttcttcatagtgtcgatggactttacaatttggtatattttttgcagtggctggtaccagtttttcttttccatatttactgtttccttcgggagctcttgcaaggcagacctggtggtgacaaaatctctcagcatttgcttttctgtaaaggattttatttctcctttgcttatgaagctgagttcgactggatatgaaattctgagttgaaaattctttactttaagaatgttgaatatttgcctccactctcttctggcttgtagggtttctgctgagagatccgctgttagtctgatggggttccccttggggtaacctgacctttctccctggctgcccttaacattttttccttcatttcaaccttggtgaatctgaagtttatgtgtcttggggttgctcttctcgaggagtatctttgtgatgttctctgtatttcctgaatttgaatattggcctgtcttgctaggttggggaagttctcctggataatatcctgaagagtgttttctaacttggttccgttttccccatcactttcaggtacaccagtcaaacgtaggtttggtcttttcacatggtcccacatttcttggaggctttgttcactgcttttaattctttttctctaatcttgtcttcacactttatttcattaagttgatcttcaatctctcatatccttctgcttgatgtattcggctattgatacttgtgtatgcttcatgaagttctcgtgttgtgtttttcagctgtgtcaggtcatttgtgttcttccctaaaccggttattctagttagcaattcctccaacgtttttttcgagattcttagcttccttgcactgggttagaaaatgctgctttagcttggaggagtttgttattgcccaccttctgaagcctgcttctgtcaatttgtcaaactcattctccatccagtttcgttcccctgctggcgaggagttgtgatcctttggagaagaggcattctggtttttggaattttcagcctttttcagctggtttttcctcatcttcgtggatttatctacctttggtctttaatgttgttgaccttcagttgaggtttttgagtgggcgtcctttttgttgatgtggatgctattcctttctgtttgttagttttccttctaagagtcagacttctctgctgtgggtctgctggagtttgctggaggtccactccagtccctgtttgcctgggtatcaccagcagaggctgcagaacagcaaagattactgcctgttccttcctctggaagctttttcccagagtggcacctgccatatgccagctggagctctcctgtatgaggtgtctcttgacccctgctgggaggtgtttccttcagtcaggaagcactgtggtcagggacccacatgaggaggcactctgtcccttagcagagctggagcactgtgcttggagatctgctgctcttttcagagccagtgggcaggaacatttaagtctgctgaagctgcacccacagccgccccttcccccaggtgctctgtcccaggaagatgggagttttatctataagctcctgactggggctgctgcctttctttcagagatactctgcccagagatgaagaatctagagaggcagtctggctacagtggctttgctgagctgcggagggctccgcccagttgaaacttcccggtggctttgtttacactatgcagggaaaaccacctactcaagcctcagtaatggtggacacccctccctccaccaagctagagggtcccaggttgacttcagactgctgtgctggcagcgagaatttcaagccagtggatcttagcttgctgagctctgttggggtgggatctgatgagctagaccacctggcttcctggcttcagccccctttgcaggggagtgaacggttctgtctcgctggcattccaggcaccactgggatgtgaaaaaaaaactcctgcagctagctcagtgtctgcccaaacggctgtccagttttgtgcttgaaacccagggccctggtgatgtaggcacccaagaaaatctcctggtctgtgggttgcaaacactgtgggaaaagtgtagtatctgggccggagtccaccgttccccatggcacagtccctcacggcttcccttggctagggtagggagttccctgaccccttgtgcttcccaggtgaggcgatgccccaccctgcttcagctcacccaccgtggactgcacccacagtctaaccagtccaatcacccactgcctagtcatcccaatgagatgagctgggtacctcagttggaaatgcagaaatcaaccgccttctgggtttatctcgctaggagctgcagactggagctgttcttattcggcaagatggccagccaacgccccatgctccttttttgccactcttttattcactttatacatctaattagttaataaacatactgagtttcatacgtgaaacatgacttttacaaaattacctgcatacatcttaaatagtatttcttatttatacatataaccttagacattgatgataaataaaatgttatttatctaaaactaaagtcccatttaataatggttagattttaagtaataaggaaatatatttcaaaatttgtgatcataaattgtatttgaattatattttgttttttgagacagggtctcactctgtcatccaggttggagtgcagtggcatgatctcggctcactgcaacctccatttccaaggctcaagcaatcctcccaactcagcctcccaagtagctgggactataggcacgagccaccatgcccagctgcattttgtattttttgtagagatggggttctgccatgttgcccagtctggtctcgaactcctgaaattaagtgatccacctgcctcagcctcccaaagtgctgggattacacgcataagccaccatgcccagcctaaatcacatttttaaccatgtttaaaatatatctacaatttgacccagccatcccattactgggtatatacccaaaggactataaatcatgctgctataaagacacatgcacacgtatgtttactgcggcattattcacaatagcaaagacttggaaccaacccaaatgtccaacaatgatagactggattaagaaaatgtggcacttatacaccatggaatactatgcagccataaaaaaatgatgagttcatgtcctttgtagggacatggatgaaattggaaatcatcattcttagtaaactatcgcaagaacaaaaaaccaaacaccacatattctcactcataggtaggaattgaacaatgagaacacatggacacaggaaggggaacatcacactctggggcctgttgtggggtggggggagggggagggatagcattgggagatatacctaatgctagatgacgagttagtgggtgcagcacaccaacatggcacatgtatacatatgtaactaacctgcacattgtgcacatgtaccctaaaacttaaagtataataataaataaataaataaataaaataaaatatatctacttatgtacacatattattttttctcttctgagcacaagtttaaatatacttttctccttattacattaagaaacataacaatttaaaagtgaatcaatgagaaagttacctattttggtgtattcatttctatgccatatttttccatttcttatttcttagagacacatatcatattttttttgttcttggtttactcattgcatacaaaagccagtcaagatgtacataatctgtgcctttattagaaaacttttatttaatttccataccattctgataggtaagatcaacttggcaatagaggagcctagagttggcctttgcatttgtggctggtgtattgtgacataatggatgcaggtagaagtgaattaacaggggctacactaacaggaaggtatagatgttgtgcacgtagccaaaggatacaccaaaggtgagaagtgaggagataagatgagcaggacagataggacaagaatacaggcatgacctgtgtcatagattttagcctatgcaagagtcccaaaatgccaggagaattagaatattgagttacatggactgattagttcatatgttggtaaaataagaacacgtaactgatttatattcctcatgtcctgttgtacagatcaatatttgaaaaaccagaatatttcttctataacatgtctcttataaagatccagtcccagccaaacaaggattaagaaaaacttattgttactgttttttaattacaaaggtaatataatacatggacatgtattcctgaagttcttagcacttattaattacaatgtatcttaaaaaacaaaacctgaataaatacttagaaaacactcattatgtagttagttttagcagggacataaatacattttgcacatattcctcatctacgagtaactcataattgagaggttaggatttatgtgcagaaaaaaattaaacagttccaaaatattatagtcaatatatgactgttttcaagctaaatgatataaaaatgtcagggactttagaaggagctatttcattgggcaataatgattgcagaaggtttcttttgagagagaggacctaagcaatataagcacaatgtgtggaatccaaacaaacaaacaaaaaatcatccctggcttttttggtgaaaattaaaatttagaacaacagaaaataccttttgagtttcattatctaatgaagcaaatgtggtcctaattttagttggaaaagataaaatctgtctttgaagtttatattatttaaatagtcaaagttttcctgattttttagtgctaaccagtaatttgcttaattcttaatgctgatcgggttttataacattaatctctatatcagaaagagtatgaaaattttacatatttttcttttttaaaagaattactcataaagcagacttcaaaacaatcgattataccaaagtctagatttccgtattcatagaccagtataagaaaaacaatggacttaacttactaaagaactgggttgatgttaaacaataaatatttctttttagttttttaaaatttttaatttttgtgggtacataattgtatgtatacaagatatataagatgttttgatacagggatacaatgcataataatcacatcagggtaaatggggatgaaacattattatttaaagaataaataataccaatatactgaaagtcttccagaaatagaagaggaggtaatgctttatagttccttttatgagatatcgtaatactgataccaacgccagaaaaagacataacaagaaatgaaattacagactcatatccatcataagcataggtgcaataatttttaacaaggtttggcaaatcaaatctagcaatatatgaaaaggattatatcatgaaaaaggtaatgattctccaaaatgcaaagtgtatataacattcaagacgatttatcataaattttttcccaaagctaatgtctagaaaggtatttcctgtgttttctcctaggattcttacattttgagattagatataatttaaatttttaatctttctttagttaatttttatatatggtgaaaggtaggggttcagtttcaactttctctatttggctaggtagctatcctagcaccatttattgaataaggagtcctttctccattgcttattgttgtcaactttgttgacagtcagatgcctgtaggtgtacagctttatctctgggttttttatccccttccattggtttgtatgtgtgttgtaccaacaacaccatgctgttttggttactgttgacttatagtttgaagttgtgtaatgatgcctttggctttgttcttcttgcttagggttgctttggctgttcaggctctcttttagttccatatgaatttcagaataagtttttctaaatctgtgaaaaaatgacattggtagtttgataggaatagtgttgaatctgtagtatggctattttaatgatattcattctcccaatccatgaacattggatgtgtttccatttgtttgtgtcatctatgatttctttcagcagtggtttattgttatccttgtagagatttttcaccaaattagatgtattcctagatatttttgggagggaaaggggaactattataaatgggattgcattttttatttggctcaaaacttgaatgttattggtgtgtagaaatgctactgatttttatatattgatttggtatcctgaaactttactgacattgtttattagttccaggagccttttggcagagtctttagggttttctagtatagattcatattgtcagtaatggtatgatagttaggcttcttctttttctattttggtgccttttatttcattatcttgcctgattgctctggctacaacttccagtactatgtgggatgggaatgttaagagtgagcattcatgtcccgttccagttctcaagtggaattattcccattcagtaagtcctcaaaagcaattacaacaaaaacaaaaattgacaagtgggacaaggttaaactaagagctccagcacagtgaaagtaactgtcaacaaagtaaacagaaaacctacagaatgggagaaaatattcacaaaccatgcatccaaggactaatatccggaatctataaagaacttaaacaaatcaacaataaaaaacaaatagcccaatttaaaaatgggcaagatacatgaacaaacatacaaaaagaagacatacaagcagcaacaaacatgaaaaaatgttcaacatcactaatcatcagaaaaatgcaaatcaaaaccacaatgatataccatttcacacccatgagtaatggatattataaaataaaaaagcagcaggtgctggagaggctgtggagaaaagggaatgcttatacactgttgatggaaatgtaaagtagttcagccactgtggaaagcagtttggagatttcttaaaaagcttaaaacagagctaccatttgacccagcaatcccattactgggtatatatccaaaagaaaataaattgttctaccaagaaaacacatgtacacgtatgttcatcgcagcactattcacaatggcaaagacatagaatcaacctaggtgcccatcagtggtggattggataaagaaaatgtggtatgtacacaccatggaatactatgcagccataaagaggaattaaatcacgttctttgcagcaatatcgatgtagctagatgccattatcctatgcaaattaaagttggaacagaaaacaaagtaccacatgttcttacttataagtgtgagctaaacgttggataaatgtggacataaagatggcaacaatagacactaggtactacttgaggagggagagagagcaggagacaagggcttaaagactatctgttgggcattctcactaccagggtgatgggatctattgtaccccaaacctcaacatcatgcaatatacccaggtaacgatcctgcatcccctgaatctaaaataaaaattgaaattatttgttaaaaggaatatatatcaatgaatattccacatcaacagactgcaaaagagaaaaatatacgatcattgtcatagatgtaggaaaagcatttgaaaaagtcagcatctattcctgatatataaaaaaaaaactctcagcaaactacaaattaagttgaactccctcaatatgagtggcatctgcaaaaaacatatagctaacattttaatgcatggtgacagacaaaatgctttccttgtggatctaaaacaaggcaaggatgttctcaccacttatatcaaacctttgactggagttcttggccagttcattttggcaaatagaagatcttaagatgtatgacagaaggtattagaactaataagtaaatttagcaaagtcacaggatacaggaccaatattcaaaatcagttataataacaaacatgttaacatatataaaacattggaaactgaaataaaataaaccattataatagtatcaaaaataggaagcacttaggggtatactttaaaaatatacaaaagactcatacaataaaacctacaacatatttctgccaaaaaaataaaaataaatacagggggaatggggatggttaacaggtataaaaaaatagaaagaaggaataatgcctagtattcaatggcacaacagggtgactatggccaaagtaattgtacattttgaaataactaaaggagtataattggattgttcgtaacataaaggataaatgctggaggggatggataccccattttgcatgatgtgattatcatgcattgcatgcctggatcaaaatgtctcatgcaccccctaaatatatataccaactatatacccacaaaaattaacatataaatatatttaaaaatgtggagacacggtgttcatggatctgaagacccagcattattaaggtgttagttctttctaaagtgagagacacaacacaaacctaattaaaattccagcagggtttttttttttttggtagaaatttagccagctgatttaaaattttctgtgaaaatacgcagggcctaagatagccaaaacaaattgaaaaggaacaaagctggaagatttataccatttgactttgagacttattctaaaactacaataatcaagacaggatagcactgatataaagatagacagatcaacggaaggaaatagagaatccagaccttacaactcaatgataaaaagatgaactacacaagtaggcaagaaatctgaacagacactacaccaaagaagatatacaaatggccaatcactgtatgaaaaaatgttccaccttattagtcgtttggcaaattcagtttcaaaccacaattagataacattacacacttgctgtaatgggaataaatagattgtcaacaccaagcattggtgaggatgtggagccacgggaacacttataccatggtggtggaagtgcaaaatagtatacccacttggaaaacagttctgtcagtattttacaaggttaaacatatttttaccatatgtcctaataattccaagcctaggtatttgcccaagagaaatgaaaaataagtccacattaagacctgtatgtgaatattcgtagcagttttattcgtaatagccaaggactgaaagtaccccaaatgtacatcaacaggtaaatggttactcattatcatccatcattataaggaaattcaactccacaatttaaaaaatatgagctactgatacacacaataacatgtatggaacttaaaaatgcttatgtgaagtgaaagaagccaaacagcaaagacataccacatgattccatttatgtgacattctataaaagacaaaattatagggacagaaaacagttcaagttcacttgctacagatggcaggaaaaggtaacaaaagaacattttggggtgagggaagtgttcttgatagtggtcttgattagatgaaatatgcatttgtcaaaattaaactgcattttaaagggttaattatattatatgtaaattgtgtcttaaaaaaactacagtagcatttcattacttataaagttcaggctctgtaacactacccagaaggccttcgcttatctggccttctttacttctcacactgaattaggaatctacttcaggttccatgaagtgctcctataccatgcttatattttactgtcatttactaccacaaagaaggttctcagtaaattattgttcagtagatgaatgcctaactctgtaccccttgtctttacttactctctggaaactattagcagccacaccaaactgatagcttttcccgaacaacatagtcacctgtttctgtgcctttgagcaagttacttaatctgtttcagttttttttctttgtgtatagtggggctaattgtgcttaactaataagatatgaagtgaagtaagaatcaaatgagatgataactgtaaagcacttagcctattaagtaatcagttctcaatgtttctggaacataataaagactcaagaaatgtcatttgtttttatcaggatttagttatttaagtggcactttagctggattttgaaggctctggacaatcgtgaggaaaattgaggacctttcacatcccacgcaggagcacagatgggtttcctatctaggggctttcccttaacacttaattccacagggaagggatgggtttcatccagtgttaattcactctcatcaccctgccttctcttttcaatgattctctcctttccatatcaagcccttatgtttcattgtcaagctccagaattattattttggtttctctttattctccctacttctcacccaatcaaaatgatagttcccatagtgaattaatacgtagttaggtctgattgtatttttatataattgttcatataatcaactgacgcaaaggcatgaataattgatagattttatccgtgaggaaagatttctattttgagagaatagcttatcaatttttttctaatagctatatagaggggaaagtctctagtgtcttatttttccatcttgttctacacaaatagaaagtctcaaaatagcctgctacatataccatcattatgcctcagtgttcagatctttgtaattttacagcctatgaaaatgagtaaattggttcatccttcaaaaaaaagtttgattagtagcataattcatagctaatatggcagactacaaatctagattatgaacatgaagaattgatatgaattcccaccacagtctgatatggagcttcataactaaatagcaagatctgccatctctttttctctcttctaaggagcataaagatgaccaatctatcaatgtgtatctttcagaaaaaggaactaccattttcaggtactttttagtgacaccagaaacttcgtgacttacttttgagattttggagccagaggaaattacactgaggtattaaatccccaatcaaagtctgtcttcttcactaagtaaatcaggatcttaaaatctaatcttacagtttgggcatgcactctttcccctagtttgtaggagatctgaaatagtatactcccattctctgatgacaaaaactgaaattaagacatagggaaaattatttgtccaaaattataatgctgctgaacaacagaacgtagatacaaactagttctcccttttgttctgtaatctatatataatgaaaaatgaatttgtctgacctatcctattgccttttctattgatgtatttttcatcaagtaatagaaattgtttatatttaaaatgcaagatctcacagtctgaggtcaaagacatgcatttaaaagataacaaactgcataaagtcagttacttccaagaacatcagaacttgcttgttgacatctattccattttgaataggatactttgttctgttaactgacttcttttttctggtattcatgacaactcttatctgttattaaacagaaaagaataggactggataaactattttctgtttctgtttcctatggaaaataaccttgcattagaaaatgaacatcacttcattcactttctgtgttgtatagatactccaagtaggaaatgttctgtaatagctattcttaaattatctgatgttttatttaccttgttttttccatgttaaatgtactgtacagttttatagctttaacaaaaatgacatgatcattaaaattctatttttcttagtgttcttcttcccacataacatactcatgcattcattcagtcatttatccatttagctgtatactattggtgatttcatacttcatgacaggtaccatgcaaatcatactggatactgagataaatagattttgtacgtcatttactgaattttacagttttagaaagtgaaagactttttaaaagaaaataagaggaaatagccaagctagtgtgataaataaatatccggaacatctgagagattgggagaggtctcttagctctatagggatgagggcgtggcaggggttataagaagaagaaatggcatatataaaggccctgaaatagcatgactcattaaaggaaatacaagggttgttcaaggatatagaataaatatgttaaagtggcagcagagaaggttagagaagtagacagacatctctatatcataataaatttaactgttatcttgtaagttgtgggtagccactggaaaaatttaactttggataacaccaatggaaaagtgaaaaatgtagatgtagacagacatttctatatcataataagtttaactattatcttgtaaattatgggtagccattggagaaatttaactttggataacaccaatggaaaagtgaaaaatgtattagaaggatggaagatttcagggaggcagaaaattatatggctgttgtaatccaagtgagaaaagattaaaatttaaacaaaagcattattacttgaaagaattaatagattaaaagtatattatggaggtaaaattcacaaaccttggtggttcagaatattcacattctacatagagtacactcattgaggcatcatgagtcttaaaagtgttaggactccttcgtggccagcactccccactataaattagtgccccaaggggaaggaattccctcagtatatgcctaaagtaacatgtcattgggattttaaagctgccaccagaagtaaagcagagaatctagcctggaactatcagactaagccaagatccttaagaaaggctgatatgtttctagtggactcttcttgttatcaccagaaacaaaagcaaaccatcatagataaacacttaatgactaaatatatgagaccgaaagccaatatgcatgagaatcatcaagggggaaaaaagattttagatctctaagggctgcaaaggttagaattgtgaaataaaataaagcgcaaaatagaatgaataaaaagagaccattaaaaatgaagaagaatatttggaaaaataaaacttgtagaatttttaaaatacaagttggaaaaaagatgtttattgatgattcatcagattagacaaagatggaggtaattagttaattggatttttaaaattttttatttttgtgcatacatggtagatgtatatatttgtggggtacgagatgttttgatacaagtgtgcaatgcataataatcacatcatggaaaatggggtatccagcgcctcaggcatttatcctttatgttacaaacaatacaattatacttttagttatttttaaatatacaattaaattattattgattatagtcaccctgttgtgctattcaatattaggccttattcattctttctaattaatttttttgtaccattaaccacccctacctctctccaactcctcaataccttttccaacctcttgtaaccatctttctactctctgtctctatgagttcaattgttttgaattttagatttcacaaatgagtgagaacatgctgtttgtctttttctgtgcctgtcctgtttcatttaacataatgacttccagttacatcaatgttgttgcaaatgacagggtctcattcttttttatggctgaatattactccattgtgtacaagtactgcattttctttatcaattcatctgttgttggacatttaggatgcttccaaatcttggctactgttaacagtactgcaacagacgtaagagtgtagataactcttccgtagatcgatttcctttcattggagtatatacccagcactgcgattactagatcaaatggtagatatatttttagttttttgaggaacctccaaagcattcttcttactgggttgtactaatttacattcccacaaacagtgtatgagggttcctttttctccacatcctcgccagcatttgatattgctaaagtttagataaaagccattttaactggcatgagatggtatctcattgtagttgcttgtttgtttgttttgggacagagtctcaccaagtcacccaggctggagtgcaatggcatgatcttagctcactgcaccctccaactcacaggttcaaggaattctcctgcctcagcctcctgagtagctgacattacaggtgcccactaccacgcccagctaatgtttgtatttttaatagagatggggttttaccctgttggccaggctagtctcgaactcctgacctcaggtgatccacccaccttggtgtcccaaagtgctgggattacaggcgtgggccaccatgcccagcctcgttgtagttttggtttgcatttctctgatgatcagtgatgttgaacacctgttgatattcctgtttgccattcgtgtgtcttcttttgaaaaatgtctgttcaaattatttgcccatttctaaatggattattagatttttaccaatagtgttatttgagctccttatatattctggttattaatcccttgtcagataggtagtttggaaatattttctccaatttatggattatctcttcactttgttgactgtttccttcgttgtgaagaagttttttaacttgatgtgatcccatgtgttcatgtttgctttggttgcctgtgcttttggggtagtgctcaagaaatcattggcctgaccagtatcctggagattttccccagtgttttcttctagtagttttatggtttgagtttatggatttaaatctttaatccattttgatttgatttttatatatgatgagggataggggtctagtttcattcttctgcatatggatatccagttttccccacaccatttattaaagagattgtctttctttggcacctttgtcaaaaatgagttcactgtaggtgtgtggatttgtttctgagttctctattctgtttcattgctctatgtatctgtttttatgccagtaacatgctgttttggttactatagctctgtaatataatttgaagtcaagtaatgagatttccccagttttgttatttttgcttaggatagctttggctattctgggtctttggtgattccatgtaaatttgaccattggcttttttctatttctgtgaagaatgtcattggtattttgatggggactgcattgaatctgtagattgctctggatagtatggtcattttaacactgttgattcttccaatccatgaacacagaatatcattccattttttgatgttctctttgatttgtttcatcgatgtattataaatttccttatcaagatctttcacttcttaggttagataagttaggtgtattgaatatattttcaacttacagtattttagacttatgatggttttattaggacacaacttcgtaagtcagaaaacatctgtgtagattaattacacatatattaatgttaattaatgttaattaattaacatcctaggagatgttactgccttaggtaaaagataagagtttaggcaaatagtgcgttaaccaaaagtttgggaggaacagcttggaaataggtacataagggctttgaaaagctctaacatatttatggaagtctaaaaggctattcgcatgccgggggctacatgcatcctctggacagacttaagaaggccttaagctttcaccttctgctggccttgcgacaatatggaaacaggaagtaaatgctaaggtacagttgaaacctgcctggttgattattgaagggctgtccttacacagagttccttaggaaaatctgggaggttttttctatccaggaatttaaggaaatctctattcaattattagctgaccactaaggtaatgaaacacagatttcagtggccacacatgacaaagaatgcaaaccatacaaaattagttaagaaaaatcactcatcagataatgaaaacaccaacaaatcctagggaagagagagaatgagatttcaagaattgccatattataatactcaaaacatcattgcaaggagacaaattaaaaagtacgacccacacacagcaaaaaaccaaatcaatagaaactctgcttgaggatatattgcctagaactttctaaacacagacattaagtttttaaaatatgttccactagtcaaagagatatgcttatacactattggtgggggtgcaaattatttcagctattgcggaaagtagcgtggcacttccttaaagagcttaaaacagaattaccatttaacccagcaatcccattactgggtatatacccaaaggaatataaattgttctaccattaagacacatgcatgcaaatgttcactgcagcatcattcacaatagcagagacatggaatcaacataaatatccatcaatggtagactgggttaagaaaatacggtacatatacactgtattatgaagccttaaaaaaaatgaaaccatgtcctttgcaacaacatggatagagctggaggccattatcctaagcaaactaatacaggaacagaaaaccaaatactgcatattatcttttataagtgggagctaaacaatgaaaacacatgatactaggaggtaaatagcagaccctggggcctacatgagggtagaaggtgggataaaggagaggatcagaaaacatacctatcggctacagtgcttattactcaggtgacaaaattatcgatacaccaaacccctgtgacatgcagtttgcccatataacaaacatgcccatatacccttgaacctaaaagttaaaaagaaataacaagggaaagaaaatgctacactaaaaaatatttagttagtacaaaagaaggcaagaaatggaagaagaaataaataagacatattgaaaacaaatagaaaaatggcagaagtcctttcttatcgataaatcagtaattgcactaaatgtaagtgaaatgaactttccaattaaaacactgagaattgaagaatggattttataaaaaggattcaactgtaagctgtgtacaggaaacagattaatagacacaaacaggctgacagaaaaatgattttaaaacgtattccatacaaatagaactcaaaagaacggatgactatgctaatatcagacaaactatattttaatacaaaaatcattacagtgacaaagacattatataatgttaattatgtaaatccatccataagatatcatagttttaaaaatatatgcacttaacaagagacccctaaaatatatcaagcaaaaacatacagaactaaagggagaaataaataattcaaatatgttacttggagactttagtatcccattttgaataatggatagaacacctagactgaaacaacagtatatgtcacctagacctcccagccgtctatagaatatgtcatttaacagtagcaggcacatgttcttcacaagtgcacatgaaacattctgtaggacagaccatatgtggccaaaaaacaattctcagtaagtttaaaaaggttgaaagcatgcattttatcttctccaaccacaatggattggaatttgaaatcagtaagagaaggaaatttgaaagattcacaaatgtgtggaagttaaacaggaaactactaaataaccaatgggttaaaggataaattacaagagaaatgacataatactttgaagaaatgaaaaaaaatcaaaactgatgggatgcatttaaagtagggctcagaaggaaatttatgactataagtaactacttttaaaaaggggaaataagaaaacattaacataacctccccgcccccaacaggacaaactagaagaagaggagcaaattatttccaaaacaggctgaagaaggaaaaaatagcaattaaaatataaataaagcagagaatttgaaagtaataaagcttaataaaaccaaaagttgatcctttaaaaagaccaacaaaattgaaaaaactttagctagaaaaaaaagaaagaagactcaaatcactaaaatcgggaatgaaagtaggaatattattaatgaccttaatgaaagaaaaaagattataagggaatacttactataaaccattgtgtcaatactagaaaactctacatatgaaatggaaaaatttctggaaacataactaacactaaactaaaactgactgaatatgaaatagaaaatctgagtattgctgtaacagtaaggagtttgagttagtaatttagcaaaacttccaacaaagaaaaattcattaccagatgttttccctggtaatgctatcaaacatttgagacgaaagagaatcaacagcagtccttctcaaactctcccaaaacatagacgaggatgaaacactaactcattttatgaggcgagtattacccttaatgataccaaacccagataaagtcgtttgaaaagtaacaaaccggtatctaccacgctattaagtaaaggttaataaaactacaaatcttatgactatggatgcaaaaatcctgaacaaaatactggcagatctacgtcagcaatatgtaagaaaggattatataccttgattaaatgggatttattccaggaatttatagttggtttaacacatgaaaatcaatcaacgtaatacaccatattgctgaaatgactgggagaaaaacacatgatcacatcttaatagataaaatcatttgacaaaatttaatactgtttaatgataaaaatactcaacatattaggaaaggaaggaagctttctcagtctgataagtgagatttacaaaacaaaacaaagaaccccgcaatgaagtcatgcttatttatgaaagactgaatgtattcaccctaagggaagaagacaacaatggccactaatactagtgctattcaacattatactgcaggttctagctagtgtagttaattaagaaaacaaaataaaaactgtctaaattgaaaacgaagaaacaaaactctctatttgtagaaggtaggacttatatatagcaaaccttaaagaaactaccaaaaaaaaaaggatctgttagagctaataaacaaattcagcaaaatggcaggatatgagaccaatatacaaagatcaattgcatttctatacaccagcaatgaaccatctgaaaataaaattaagaagatggttccattaacaataaagtcaaaaataataaaatgtaacaatgatattaagtaatgctcaacatcagtagtcattatggaaatgcaaatcaaaagtacaataagctaccactgcataaccatttggatgggcactgtagtagtctattcttgcattgctataaagaaatacctgagactggataatttataaagaaaagaggtttaattggctcttctgcaggctgtaaaggaagcataatgctgacatcttcttggcttctgggaggcctcaggaaacaaacaaacaatcgtggcagaaggtgaagtgggggcaggcatgtcttacatggcagaagcaggagcaagagagaggtgggaggtgttacacacttttaacaaccaaagttcatgagatctcacactctatcatgagaacagcagcaagaggatatttctaaaccattcatgagaaaccaccaccatgatccagtcacttcccaccaagccccacctccaccactggaaattacacttcaacatacaatttgggtgtgaacacagatccaaaccatattaggcactatcaaaaaattagaaaataatgagtgttagtaaggacatggagaaactgaaacacttgtacattgttggtgggattgtaaattggagtagtcactatggaaaacagtattgcagatcctaagaaatttaaaaatagaattgccgtattatccagctattccactgctgcttatgttgccaaaagatttaaaagtagggactctaagtagtatttgtgcccctatgttcatagctgcattatttgcagtacttagaaggttaaagcaaccaaaatgcccattgacaagtgaagcataaacagagctctttatacatacaatgggatattattcagccttaaaaaggaatgaaattctaacacattctacaacatggatgctaaataaaataagccagtaataaaaggacaaatactgcatgattccacttgtatgaggtacccagagtagtgaaactcacagagacaaagtgggatgatggtggccaagggctgaggatggaggagcaggtaatggggaattattaatatttctaaataggtaaagaatttagattttacaaaatgaaacaagttctgttaatggatattagtgatagtagcaaaacaatgaaaatgtgtttagtaccacttaactgtacaattaaatgctgtaaattttatattatatgtattttattacaattaaactttttttaaaaaaggaataaatttagccaaagaatgtcaacacttgttcatcaaaaaccacaacattattgaatttctttcaaacattgttgaaagaaattaaagagggtataaataagtggaaatacctcccaggttttaatggattggaaaagttaataattttaagataacagtacttttcaaatttatatataaggtcaatgcactctatcaaaattttagctgtcttttttcagaaatggaaaagctgattctaaaatatggaattgcaagagacataggataaccaaacctatattaaaagaataaatttggaggacttatacttcttaatttcaaaacttaatacaaagctacagtgataaaaacagtgtggtgctagttaaagatagtcttacagacaaatttaatagaattgagagtccacaaagaaacccatatacttatggtcaatttattttcaacaaggttgccaagacttttcaaaatgactgtccttaccattgttgaaaagacggtcacttcaacaatggtgctggaacaactggatatcaacaggccaaagaacaaatctagtctccaaccttacactctatgaaaaaatgaattcaaaatgcatgaaagacccaaatgtgagaactataactattagaaggaaacatagttaaaaatcttcatgaccttgaattacccaatggttttcatagatatgacaccaaaaggacaagcaaaaaaaagtagattgatagtcatcaaaatttaaaacttgtgtgtcaaaagacattcatttacaagatagtgaaaatataacagcagaattgaaatcaatgtttgcaaatcatgtgtctaataaaagtctaatctccagaatataaaagtaacccttacaactcaataataataagacaaatggcccaatttaaaaatgaatagaagatacaagtagacatttctccaaagaagacatacaggtggccaatggacacatgaaaagattctcagaaatgcaaatcaaaaccacagtaagataccacttcatattcattagaatggctataatgtttaaaacagacaacaacaagtgttggccaggattcacagaaattggaaccctcacactttgttggtgagaatgtgaaatagtacagccactgtggaaaagagtttggctgttactcgacaagttaaacatagagttaccatataacccagaatttcatctgtagatacatcctcaagagaattgaaaacatatgttcacaaaaaactattcataatagcataattcctaattgcctgtaagtggaaacaacccaaatgttcatcaactggtgagttggtaaacaaactatgatatatgcataaaatgggatattgttcaccaataaaaaggaataaggtactcatacttgacatggatgaacctggaaaatattgtgctacctgaaagaagccagacacatattgtatgattccatttaaatgaaatgtctagaataggaaaatccatagaaacagaatgtagactagtacttaccagaagaaaggaggaagaggaaattgaaactaactactactaagtataaggatttttgcagaatgataaaaaggatctagacttatatagttcgtggttccacaagatagtgagtatactaaaaaccactacagtgtacatttttaaatggagaggattttgttatgtgaaatatatctcaattttaaaaatactttttaaaaattagcatgaaatgaacttttagcgataaccataattttagatggtttatccccaagagaacagcaactaagaaacttacaatgtatgcatgtcaggacagcataagaaaatctcataatgacaaaactatacaaggagaaaagtatgcaaacaaattggtaaatttgtgtacatctacgtagaaattgtctttataaagggctaatgatatgtaatatgtgagtttgaactggacaatattgggcaatagcttgtaagttagaagggattgttacataatattgttgcagaagaggcttatgatgttatttaacttcatacttatttaagttaactatacctggtaaaagcccaagcatagcaatgaaaagagtagaataaatacatttccaatcagtagggagtaaaaaagatggaattaaaactaaagtttctatccccaacccctccccaccccaataaaaagcattaaaaaactgggaccaatggaagatttttaaagtattgggctagaattaaatacattatatatcaataagcacaataaatataaaaggactatgatttccaattaaaaaccaaatttctcagatatgattaaaactccaggtgagttccatttattaaaggcatacctaaagccaaaagaatgttgaaggtaaaaagatagaaaaatatatcctgggcactaatcaaaaaactaagctgacatagctatattgatattttaaaaaatatttcaagggaaaaattgttagtgaagaactaagttgtatgggtaggaagagctgaattttcttaagtaagatgctaccatcctaaattcatgtatttcaaataaataacctcaaaatgtgtaaagcaaaaattgatgaaacatcagggagaaaatgacaaatctgccatctttgtggaagatttcaacactcctatctcagttatcaaaatatccaggagacaaaaaaattcagtgaatatatacaagatttgaataacataattagcatttgatactattgatatatagaacttttcacccaatcatagacagtacatattattctcaagcaaacatgtaacctgtgtaaaatctgatcacatggttcaggggtccccaatccctgggccacaggctagtaccagtccttggcctgttaggaaccaggcagcacagtagcgggtgaatgacttgcaagagaacaaagcttcatctatatttacagccacttcccattgctggcatcaccgcctgagctccgcctcctgtcagatcagtggcagtattagattatcataggagcatggaccctattgtgaactgtgcatgcaagggatataggttgcatgctccttatgagaatctaatggctgataatctgtcactatctcccatcacccccagatgggaacatttagtcacaggaaaacaagctcagggctcccactgattctacattatggtgagttgtataattatttcattatatattacaatgtaataataataggaataaagtacacaataaatgtacttgaatcatctcgaaaccatccccttccacccacactggcccgtggaaaaattgtcgtccatgaaactagtccctggtgccaaaaaggttgggaactgatgacatagttagatcataacacaagtcttaccagattttaagaattagtgttatcaataccatgatatctgaccagtgtaaatttatatttgaaggcgaggacaaataattatattaaaatattctcattactgctgaagaattttgaacacttaacatatttcaaagaaacataaaaagtatttagactaaacaataatagatatactaaatacaaaaacttgtagaatgtaaggaaaatgaaacatgaagataaatctatttgcgtaaaagcttattacttgagagaaaagcctaaaattaatgaactaaatctctaactgcaaaaaaaaatgtccaagttaggaaaataacagaaccccttcacaaagtagaagaaagctaataataaagaagtttaacagaaatcagcaaaatagaaaaataagatacagtggagaagattaacaaagataaatgtttattcattaactaataataaatgagcaaactcttctaagattgattaagaacaaaataaaacaacacaaatagtgaacatacagaatgaaaaggagacataattataaccaaaactaattagaaaagaaaatgagagtgctatcaaagcattataccattaaaattacaaatttaaatgaaatgagcaatgtcctagaaaatatacagcttcctataactgaaaaagaagaaacaaaaccctaaatagttctttaagtatgaaaggaagttaatcagtaaaatttcttcctgtagagaaaactctaagcccaaatagtttacaggaatagtctaccaaatgttcaagtaaaactctgttccaaacttacaaactcctagagatcagaaacagggaatgttccagattgttcactgaggactgtgtaatcttaattataagagcaaacaaggaaaatcacatgccaatctcccttatgaatatagatctgtaagttctaattaaaatattagcagaactcaattcaactgtgtataaaaagataacatgtgtatgtggggcaaactggaagacggtgatgagggaaatttatcccatgaatgcaggagttgttcatcattttaaaaatttctaaaaatgtcattcatttatcacattaaaagtgaaaacttttatgatcatcttagtaggtgcagacatctagtaaaggtcagtaacgttcatgattagaaagaatactcttagcaaattaagaatagaagagaattttgaactattttaatttaaaaaacaatatctacagaaaacctgcagctttatttataaaactcacaagcaatctgaacaacatattgctttggcatatatacatatgtgagataaaatggtttgttaaggaagcaagagactgataaataccaagtgcagcagagtggtttatttatttatttatatatttacatatactattatttttaagtgagtgagcttaggatagtaaagacattcgtgtcgcctctcaaaacctgagttaaaaacaacttgactgtgaaaaagaaatatagattttatcctcagtgaaaattcattttgttactttccttagcagtctagatgtaagactgagaaaggagaccagtgtgttaacccagggtcacacatctttgactccagtgcagcaggtagatcaggaattaagtgaaggtgttggcaagagagtggttaaaacatggaattgtgggatcccagatggatgcaaaaggaagtgaattattaagcagaagaggaaagagagcagcaaggataggagatcatgatctgagagtagacttaaagcataaagacttgtgaaatgaagctacttatggccattggatttatttgctgaagtaagggagacttgaagatcttttgagttaatcagtcaaagaattgtgagctgctgtgatcaatgttttccatgtggataatggtgtcattcagagtggtgtcaagagtcatggaaagataccttctcttcgtgtaaataaaacatcatagatcagttggcagaactcataagtgcccaagataggggaacagactaaaaaactgatacaatttctttggtgtgtctgaggacaggagtcttttgttacaaagcctccacccccacagccatgctgctttgcttttctaatccactgctttgctcctgggaatgatatgtattagccagccagaccatgtacccttcccttcctgctgtctcctgttaatctatttaagttttgtaatttgcactaatttgcacatattagatttcttcctggctttcttcagccttcagcatgcactagacaaagccattgaacgaaatattctaatatcacatctcttctctcttttgaagcctctctacaaaatgtaggctgataatatgatcaaaagttaataatcagagtttacgtgatgttcttttttagcttcttttaattttccatttccctcagtgattaagactgtatgtttgtttgccctccaacgtcatttacagaggagtttttatcttttttcctaagtattgtcacatctaacagatttccataacctttgtattcttttaataatttgtgttgtggttaacttttagactgaaaactggacaactttcccattagaatgtgtctatgtccccctcaacagattggagagatagctgctccatgcttctaggaaatatctgcagctatcctgctgctatgcaagattttactggtgccgctgtcatattgtcagaaccgttcccactggtcctagagtgacagagtagttatttaacctaaatcttatcaaggagtgattaaatctatatctgagcagacatggattttagacggatttctactgagaactatcttgagttcagtgttgctcagtatttacattaccaccctaaaataaaggaaccattcacctgtcggtttttatggaagatgccacaaagatattgcaagtaatttggtgggaagatattaaaacttcatgttttgtaattcaaccttgatattagaaagaacaaataaatccagtatagtcacactcacctcaaagacatatgtaggcttttaaaattatatttaaacaataaattagaaatatcagaatacataatgatattttgtttcttctgcttatatttatgtatcagtaaagaagaaagtttgccacaggtagacatgatatagtgaagaatataggaggaattactaggacttagtatttagtaagtacagaaattaaaacaaagttaaacctatttccatctgatttatatttatgaaaacttgagcaaaaaaaagttgatatatttcattaatgagcagtgaaaaaaagtaatgctgttattgaagtagtactcctgtttaaaatccccggaaagaaaaactggacaatgaaggaatatgaggattagaatgaaatttaaaaaggacatagacaaaggaactgaaaccacttcttaagcttgccctttaaggaaaacccagaatgacttgaaggtagctttttaaatattattttttttaatatgcagtaattacttaatgcaaaaaaaattgaagaagacacaaaaaggccaaatcattgtttttaattgacacagtgaaaaacaaaatgatattagttattataatcaatattatcttcccctcctcttcctcctcctcctcttcctcctccatctcctccatgatcatcatcatcatgtggcttaaaccagtaatcagtttttttctttcttatgattctcattgcctgggctcagctaagcagttctctctggctccatgtggagttgcctgggtctgcagtgtcctgaatgtgacttactttgggctgagacctcatttaggcctgagagcccgagcaattctgtgctcttcaatgtgctccatgtgatgtgggcttctctcaggggagcaacagactccagaagagagagttcaaaaaaaatcaaaagctgcctggcatcttatgtcctagcctcaggagtcacatagcatcacttctgctgtattctgtggctcacaggaagtcacagggcaagtccagatccacaaggagtagaaaaagtctccattttttgatgacaaagtcacactgcaaaagagcatgtgggatgggaaatgttgttgcagccatctttggaagtaatctctgccacatgttattaaagaagttagaagaagctcactgtgtgtacatgtgaaaagatgtccaagatacatttctatgtgagaaaagctgggtaaagaacagactgtataatgtactaataattatcagtgttaggaagtgtgggaaaagaatatatttgtatttttatttatatattttagaagtctctgaaacacacccaggcataacagtgggtacctgttgaggttgaaaatttggtgactaggggacatagtgagaggcttttcactgtaaaatgttactacacattttaaaaataattcgaatctcctaaataagtaacttctgtagttaaaaaagtcagctatatggttgaactttaactgtagttccatattagaatttggaatctcagcatttaaaagaattttagatgtcatttagtcctatcatctgcattatttaaagtaagaatctacatggtttatctgaaattcaaatttaactgggcatcctatatttttaaaaattttattgaggtacaatataaaaaaataaaaataaagtaagaatctagtctgttgatttcctaaagtgtggtcattgaacttatctgtgaaaaattacctctaagatagtgacttctgttgcataaccatttgaaaacactccaaccaaaattttttatttttgaggaacctatcttaattgaattaactgaattgctgattaacaagacacactatttaacagaggaattggtgcaacagttttatgacatctttctatatttcacattttactgaatcataatttaaaatatattaattttatatctagctttatctaaaacttatgtatatttgaagtactgaaatctgattattgaaaaaaattggactgaccaaagctattaagaataatatttctaaaggtatttttctttttagattactgtgccatgctatgaaggaccatatagtccgtgttgcaaatgaagctgagtttattttgaacagacaaagagccgaggatgtacataaacatgcagagtttgaggtaaggttttgggagtagactaaattctgcctttctattataagccaaaaatcacctatctgtgaccttacataagaaggtttttttaaaaggaaaatttcactgaaggcatttctgttcctgttttttaaaagctttagtaaatgtcaaacagagtactaatatattttcaccccatttacagcatgaaaacattccttctgccctatatatgcctaaccatttggtagactgaagttattctaacctactcaagagtaaatgcaaaaaataatttataatgcaacaattttagttattttaagctagcagagatttacacaccaataggtagatatgagtatatgatacagttatatgaataaactcatataagattcaaaaaaatctttcaatttctgttttatacataacagttatttattatttcagtttattccatttacaagacaaaataggtccgagaaatatttatgtgccctgctgtttggcttagttggacttgaaagtaataaatgactcaccaatttattctcctgatacaacaggctaacaagtatggtgtagctagaaatcagagcccacaattctagttttgatgaggtttttatctcagtaaagcagctctgtgagtcatacaagttgatagactaggtctagtgatctctgacctagctggctgaaaagcatgagacaggaaaatagccactatcgctttcaaacacatgacctttgcttcatttggtcagaagaggcacaagacaagcagccacttgtcttgtgaaattgcaacaaccgtattctgagaaagataccagatattttaaacttcgataaaagtatagtgatctttaagtgtttatcaaagtgaagtttcgtattagtaaagatttggaatctcaactgaattccctgcaggatcagttttgagtctcttgtatttccactaagaaaatcaagataatttgtgaggatataagcagatcaatatttgtcatgtgaaaacatttaaaatagattttcaagtggctagatattagttatgagctttaacatgtttaaccaaggtgacattaagccaagggcagtgtttctcaaccttttttattgttgttattgattccctaaggagtccttttagacattttgcctaattggcctctcatcccaaagaaattttataataccacccataggctgtgtatctgtttttgtacttacatacatttgtgttttatgtactgaaataacaatatttttatcccccacccgacacacaccaatttttcactcttaggaatgagattactctcgttgtgggtcatcttcccaaggtgataagaggtttccaaggaaacatgaagacttagtgttttttagattttataaacataaaatataatattaatgtaaatgtaattttgattatattgccagtgttatttgatgattgtaccttatttttttaacctgaaatgtttatatctctcctttttgggttagagctattgatgtgtgtgtgtgtgtgtgtgtgtgtgtgtgtgtgtgtgtgtgtgtagtttacacaaagatatcccttttaaattgtaaaagattttacaagtcatgacattttgctagaactttttgaggaatttttctatcccccatatcagcctataattaggaagaaaagtatatttgattttagatgggtacttcacagttaagtttttttagttaactactgtagttgttaaggaagaaaaatgaaaatttaattttactctccaatgagctaatgaaatattaacctcattactgaggcagatcgttgtactaattggtgattccctgtacaaaaagataaattggaaaatgaattaatccttcttagattactgtagggttatttctccagaagagattacttgtggtagtagtgtatatcaatagataaatgagaggaatatgttcaagtaccttccatgaaatagatttttgcatagtaatgatgaatgtgaactacttctatttattttatcagatgtatgagacttttttcttcctagttatattacttgtattacacatttattaatgttaaaagttatagtcacaccactctgtatatttattgtagttttctgtataaaaactacaataacaagaatcaaatttataattaaagaaatatttctctttatgtttacattaaatatttttaatacaaaaaatgatccattgatagcagtgttgctaacaaatgtaagaatgaatacatgtcagatagctgacatgacaactgataattatgggaaaaggaaggtaagaataaggtagtagttctcatgaaaccctttgaacacattacattttaagaatatggagggatcatagaaaaaaatcttgtctcagctcctcatttacaaatatgaaactgagtacattaaaatatatggagtttgcatattttgtgaattaaaatctaggtctactgaattcctaaatgaccacattttcttctgtatcacattaccattcatgaaatggaaaatataaattaaatgacagatttttgattcatatgtaattatcaggaacatacctcttattttaagtgagatatactatattggcttgataaacaagtaggtttacatttatagtaaatatttgtgcttctaaaatacatgaaaattagattctcagaattggaagaaaccatgagtctttaattacttcaatattattcaaattattttacatatactttagaaagagcacatttttatatttgaaaggtgactatatgtattctttagaacaaaatatcaaaagattacattatttgagttttaaaaagttgaattcctgttaccgtttaacttaaatgtatatcatccttacttatatgcagtaaaaagtttattattatgcatcatttgtatttctttatagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcataggtgagttataataaattcgagtaaataataattcataggttaattataatagttggtaataaaaatatggctacaaatttaaaagtcatttagaaaatataatttaaaatataaaaaattacttgaaaattttcctgaaatctttaataattcttcatcagaagagtttaagggaaaacctaaactttttatagtagctacagtggaagttatttctactttataataatatgcaacataatacaaaatatggttaggcaagtattttagtctactgtctctcatatgtaacatggatgtttaggtatgagaagtggctctttttaaaaaagaatcttttagagtcaactcttcctacttattaaatttatatcattcttttttatacagaagcatatataagcatatactacagagaaataatatgttcttttaaaaagttttctttcataattttctattcagtcttaccaagggaagattttcatctcaaatatgattgtttatgataatatagtacaactaaaaccaaaatttggttgtttataaatcacaaatgttctccctaaagttttgtggacatacaattattgttgttgttgttgttgttgttatctatacaatgaagttttctggaaaactagaagtgaaacaggtcactatatttagattgctgatgttcttcctttttatattatgttttttgaccccactaaatgtttttattaagtctgtgtttggcagagtttattaaatctgtttgacaaagttggctggtgaaatgtaaacgggatactactaagaagagccttggtaaaaatgattctgttgacctggtgcgatggctcacgcctgtaatcccagcactttgggaggccaaggctgctggatcacctgaggtcaggagtttgagaccagcctggccaacatggtgaaactccatctctactaaaacacaaaaattagccaggcgtggtggcgggcacctgtaatcctagctactcaggaggctgaggcacaagaattgcttgaacccaggaggcagaggttgcagtgagccgagattgtgccacagaactccagcctgggtgacagagtgagactttgtctcaaaaaaaaaagattctgttagagaaaaacacctagaatatgagtaggatggtatttaaccaacttcctgggattatgagtgtaagataggttttttaaaactttattaattttggatttaaggtaaaattataacatgtgtctttaaaatagtcagcatttaatatttatcataataatagcaataacccatggcctctaacatttattatttgttgtgtgcgagggaccatactaagaactttacatggattatttcctttatccttgaacatctttattaagggtgacattgaggtattctccattttaccgggaagaacctaaagctgaaagaggttaaataaaacttacatagtatcacactgcttgtacaaatagaggcagattatatcagtcaggatgctccagagatatttatattcattaactaaatttattttaaggaatttattcattcaatcatgggagctggtaagtctgaaatctgtaggacaggctggcaggctagaaactccggcaagatttctgtgttacagtcttgaggcagaatttcttcttctccgggaaacctcagcttttgctaaggccttcggttgattggatgagcctttcccacattcttgagggtaatatcctttacttaaagttaactgactgtagatgttaatcatatctacaaaatacctccacagcaacagttagactaatgtttgaccaaacaactgggcattatagcctagccaggttgacataaaatttaaccatgaaacacactaacaataacctgagcattttacccatctacagaccttgtctccctttttgtgtcagctgaattgggtttatctattaatacttacttatatgtagtcaggactgtaacattatattgctagtaacgcagctggtatgattcaggatattgccttagctgtataaagcagtacatggtttgggttttaattatttccttatgtaattagaatacagctaaaggacagtgacctccatagcagcagtcatgtggtaacatgtcagatgcgtcctgtgctagctagtcaacaacctttctgacatctcattagactgacagaaagcatggcctgagccctcagaagagcaggtgtcttctttccttgcacattagtttctactgccaactatctgaaaaaaaaaccacaatatttttatgatcatttactaactgtgtcactgaactctaaacctttaagcataggttttgttctgtttaattctccttagtatttgattaactaatagggctcagtcattggacctcttctcttttctatcttattcactctctagacaattttatctagtcccatgatttaaaaatactactaatatgttgataactccaaaatttattattccaagtccagatctctcccgtcgccaggtctgtatattcatctgcccacttggtatcttctaattgattagctgatagtcacctcacacctaacatatgaaaactaagcttctaatattttcttccaaaccagtttctcttatatttttctccatctcagccaaaggcaactccattcttactgtttctgaggccataaatgttgctctgtccttgactactgtttacacatcccacattgagcccttcagcaaatcttactgacactgccacaaaatatatccagcttcgactgcttctcaccattaccttggatcaccttagtccaagccacatcattctcacttgacttattgtaccagcatgatatatagtcttatttttatatttcacttgacttattgtaccagcatgatatatagtctttctttttatatttttcccctgtcctcctaaagtccattctcagcgcaacagcctgagtgactcttattaaaatgtagatccctctgctcctatgcttagaaacctccacagctgtactatgccagactgtaaccactagtcatgtgtggctattcaaatttaattaattaaaatttaatttaatgaaaaacgtgatgcctcagttgcactagccaaatttcaagtactcggtagccacatgtggctggtggctaccatagtagttatcacagaacctttccgtcattgcagaaagttcttttgaacgcttgctgcagaggtttagcattcactgagggggaaaataagatctcatagtgacttattaggccctacatggtttagtctttgtttgttaactcttcaacctcctctgccaatactctccccttggttctttttgttctagtcaccctggcttctttcttgcaggtcatgtttgctctgtttagaatgctttcccaaaaagttcattggtcaaactttttcattttcttcaggccttaattccaaatgataccatctcaaaaaaaaaatcattctctagccactctgtctaaaattttactcttcctccaaatattttatattgcatttccccacttttcaacatctattactttgatactaaaatttcatatattttacttatatattatttttattgttttgttttccaatagcatgtaagcttcataatgtaatagattctttgctcttttatccataattgtatccccagcacctagaataagccctgatgcatagtaggtaccaaaaaatttgtgaataaattaatgaataaacacttggtgtatgcccttttttcagtaatgatacctatcatggaataatagaaaataaactagtccattgggaataattttatattttatttaactttataaaatgccaaaaagtacttatccctgcatgaaaccaaagtgttagagccagcaacactctaaaacaggtgttcacaaatccagtaacattttacatagaaaagtttatatattctaactggagtcacaagttcctcaaaaagacaggaaaatatttcaacagcaaaagttgcttttgaatgctgtttattctgtgaatgttacagatttggtttttgtataaattatcaacttctatatattatacagtgtacgtttctactacagaatgatgctttcaacttgtaaatgcaagaaaaatatgtggccatattttccattgctaatccaatgggattaatacaattgtgcatgtaagaatatttatgtcatacttaggagtaactgaaaaatattcttccatattagagtgaccgttgattttttgtttggagttcatcctactgaacttctaaactgtatttgacagtcttctatgaactctattcttttgatctcttgtgtttcaccattacgtctgacctcacatcctgccatgcatcttctcagcccatggctcactccaccacagccaccctggcctctgtctgttttgtatacaggccaagcacttcctccttttgtatgctgttccttctgcatgatatactcagataggtctttgcacaagtgtttcctcattagagtggatttctctgacctttctatcaaaaattgcacaccacatttttcccttcatcactccctaaattttctaagctttaatcttcatagcacctatcacttggcatataatttactgtttaactatttttttacctgatattatggactttcatttactggtgtgtacccagtgcatagaactctgcatataataattgttcaacacataatttaaaaattcatgaatccatgaaaatttccatacacatgtatcatggcacttgtgtagatagcatgtaagctagttttgatactttccacatagaatttgagctttataatcaacattaagagctcaattacttactagctgtatgacttgtaagctgtgtaatctcgaacagagaggtttttttgtttttcttttttgttgttttttttttaacttttaagttcagtgatacatgtgcaggtttgttacataggaacacgtgtgggggtttgttatatagattatttcatcacccaggaattaagcctagtatctgttagttatttttcctgatcttctccctcctcctaccctccaccctgtcataggccccagtgtgtgttgttcccctctatatgtccatgtgttctcatcatttagctcccacttgtaagtgagaacacgtgggatttggttttctgttcctgtgttagtttgctaaggataatggcccccagctccatccatgtccctgcaaaggaaaggatatcattttttgttatggctgcatagtattccatcatgtatatgtaccatattttctttatagagtctatcatttatggccatttttgttgatttcatgtcttttgaacaaagattttaccttcctgatgttcaccttttctcattcagaaaatgggatgaatagtttctactaaattgagttacgttactatgaaaaattgaaatactgtgtgcaaaatgcttaatataatgtcagacacaatagatatccaatgcttattagtagtctcttcttttttctgttagtctgctctttgcaaagacccttttaaaaatattttctgtctgcttaatcactccttaacttctaatatatagttgtaatatgttgattttatttgttttatcaacagataattctttttttcaattgagatggagtctcacgctgtcacccaggctgaagttcagtggcacgatctcggctcactgcaacctccacctcccgggttcaagtaattctcttgcctcagcctcctgagtagctgggattacaggcacgcaccaccacacccagctaatttttttatatttttggtagaggcggggtttcaccatgttggccaggctggtcttgaactcccgacctcaagtgatctgcccgcctcaacctcccacagtactggggttataggagtgagtcaacacacctggcctcaacaaataattcttgagcttctatttgtgcaaaacagatatactttctccccaactgagcttatagtctagtagaagagattgatattgaattaataattatagaaacaggccaggcaaggtggctcaaacctgtaatcccagcactttgggaggctgaggtgggcagattactttgaggttaggagttcaagatcagcctggccaacatggtgaaaccctgtctctactaaaaatataaaaattagctgggcatggtggcgtgtgcctgtaatcccagctactcgggagtctgaaacaggagaatcacttgaacctgggaggcagaggttgcagtgagccgagattgtgccagtgcactccagcctgggcaacacagcaagactctgtctcaaaaaaaaaaattatggaaataaaagatataaaactttggcaaatgataggatagaaaagtgccaagtactttgaaggagcacataaaacagaggagctttattttagattagggagtgaggaaagacttgtttgaagaagctctgtttaagtaaaaagatgagtagcgcgtctttagcaaagggtggtgtgtgaatcattcagaaaagaaatattacaaagactctgggcttgaaaaacagaatgaacaaaaaggagggtagtttggagcttagtgaatattgggagtagtggcttgagaggaggctggagaataacatgagccagatgatttaaagtcctgttcaatcacgttaaggatttgtgactttatcctaagtagcatgaaaagcaaagaagtatttgaacaggagaataacatgatctgatttatgttttaacaacatcagtctggctgttatgtgaagacacatatgcaggataaataggaaaatatagtcaccttatttatagctgagttcaaatgtcacctttttctatagcatcccttggctttctcttatcttttttaacactgcttccccatattttgttgttgttatctgtattgaaattaactgtgatatatcacttaatgttttatagccatgtgaatgtgcctgtctctttcaacatacttgtagcttcctaagcataggaattgaatactaattgttgttatatccctgttctcaaatatatgttcaatatgaaggaatttcatccctctaattttctacttgctattctaccaaaaaaatagtttagttataacataaaatctcttttacatctatctttggattcagtggtggggtcggttctaacatactttagcatttgaattaataatattgatctttatttctgtgttgaggaaaagctatgagagatcctttaacatgcatatttccagattcagtgttgttaaataatgctcaatgtatatagtttttctttgtttattttagctttttggatatttcctattgcttaaactacgtaagccatacagcctaaatttcagtgaacagggtttaatagccccttgagtttaataggtgtgtgtgtgtgtatgtgtgtgtgtgtgtgtgtgtgtgtgtgagatctcagtttttattattcattttcaaataatcattactattgtttagttttctggtaagatgttgggagcacacctatgtattgacggtaactatgttgatacttccattggaatgtcttattttcatcctaacaactgtaaggaagacattattttttctattttacgggtaaaaaatgtgagattcatagagatcaaatgtcttgccctgtattacacagctaagtaatagagacaggagcaggatttgagtctaggttgatctgacctaaagcttgtagtcatttcaatgactaattactgattattgtattgattataaaaactagccattagaataatgaaatgcaaagaactgtgtaattaagaagaagactgaagacttgcaaatctggagctttaaaaagtattcttaggtttcctaaatccaaggcccaaactgaactgactttggaactgccacccactgaaggcatgaaagaacttgtctgaacctaaaaggttcacctgacttccaaaacaaaaataaacaaacatcctaaagaggaagttaacatgatccagtgtactacaaggtaatattataaatgtccaggatacaatccaaaactactcaatatacaaaggaaaatctcaccgtttctcaaggacagacagttaacagatgccaatcccaagatgactaaaatgttgaaactatcaaagacttaaaagcacctttattatcatcttccatgaagtaaaggtaaatactttttaaatgaatagactgatagatctcagctaggaaataaaaagtatataaaaaaacaaaaaatgaaaaatccatcacctgaaatgaaatattcactggataacctcaatagtagaatgaagatgacagaggaaagagtaaatgattttgaagatagatgaacaaaattttataattgaagaaaagagagaaatcagattgagggaaaaattaacagagcttcaggcacctctgggataatatcacacaaaacgtctaagtttgaacactgaatcatcagaagaagaggagaaagaaattggtacagaaacattatttacagaaaaaatggttgaaaatgtatcaaattaggtggaagatgtcaagttagagactcaagaagctcagagatgacaaacagtataaatacaattatccaattaaggctaaatctagacacatcataattaatcttctgaaaaccaaggtaaagaaaaaatcttgaaagaaaatacaggaaaacacaatatgttacatataataggcaacaattcaaaagataacttttttatcatagttaaatggaggccagaaaaataattggcaacccagaattcagcattcagcaaaaatattctctagaaatgaaggcaaaattaaaacattctcaatgaagtattaagagaagtcttcactaatcaaaatgttatcaaagaaattccagacgacctctttcagatagaaggggaacaaaaacatagaacttgggactttaagaatgcagaagcgttctttgttttgttttgtttttcccacaacagtgcaaaggcaatgtagtggagaaatgataatcttttcagcaaatagtgcaggaacaattgaacatccatgtgcaaaaatcggaacttgacctgcactgcggaccatatacaaaacttaactccaaattgaccatagacttaaatacaaaatgtaacaccataaaacttctaggagaaaacataggagaaaaatcttggtgaccttgcttgttttgggcaaagagttattaaatacagtaccaaaagtctgatccataaaagaaaaaataattaaaaacattttttctgtgaaagactgttgagagaatgccacattccttcagactgggaaaaccatagactgggaaaaaatacttttaaaacttaacaatgagaaacaaatattgtaattaagaaaagcaacctaaatattttaacagatgcttcgttactgtaggcaaacagatcagtggttttcaagggttaacacctgagggaggatttaactagaaagtagccacatgagagagcttttcaggatgatggagctgtcctatatttttactggggtagtggttttatgactgtatgcatttgtcaagatttatacaattgtaagtcagaatgtgaattttactatatgtaaattttaaaatgttttaaaactttaaaaaaatacatggcctgggaaaggttttataggtgattattcagttgtcaacactagtatttgtcacagtctgcattatatatttattgtaaagatttccatcaaatattatttaattgttgttataaagataaataagttacagctcagattatctgttatttctgtgcaaacactattatgttggtcatagagtctcaagaccataaattggattagctttctctatagctatacctataaataggttaatttttactagatgtatttatatatgtgtgtgtatgtgtatatgtgtgttttatataatcctaaattaaatttaccattctctaataaagattatgaattattaagatgagaaaataaacttttcccagcaatttttatataatataaaatgtccaggttttacctagaaatgtgctctacactcaatgaattatagttgttacaagtatattgacagttattgagttagactaaacagtctaccaattgtgatctcagtaacaccgtgagatctaagatgactcacccatgcccaccaaacaaacatgcttaggaaataaatatatttacatcatagattatatttttaatggctataaagcctcacagaaggctatgttatagttttatgagagctatgtaaatgtacataacaggttcaaatgagaacatgtgttctttgatttcagtttgatattctacacttccaaaacaagagttcttaaactcactgtttcaataatttaaagtcaaaataataatttaaataaattagaatgaggattataagcacaaaataataacttaaagtgacataaggtaagcactaaaacaaagtaagcaatgactaggtggaactgtaaagtaaaaattatatgctttttcagcaaattctgggtttagaatattctcatgcagtctattcactttcacttcctggtcccactcctgtttcccttatcttcagaccttcaccgttgccatttatggtggatgtgcactgcaaccaccatactaaggcgtttatttaaatccagtttaatttgctcctagcccctccatggggctggttggtagaaaatgtaataccagttatttatagagccccaaacacatacacactccaggattaggtagaaattttaataattttactggtgtaaagccctgggattcttatttcactctggaatctaggagcgtgtttgatttcttcttaaaggtaggtctgtttctggccaaaatgctacattagtttctatactaaggcaaggagctgtggtacctagggcatggctatatggattcctgccatttcattaaaagtaaatgtaccctatcacttttatgacccctttcttatattaccttcctagccttggaattaactacttgaaccctgattacttcaatttcctcaccccaaagagccttcctgtccatcctcttcttctaggttagttcatctgctaacagttcttatatcttttgagaagataagggaattctcaggtctcctgaattcaagatcctgcttgttctgaaagggttggcataggatgaagtggaaattttgcttatttctctgatccatttggattccctggcttccctttctagaaccatcctaaaacatctatccgattcgaaggtactatataaccatggaacaattttttcttctcccttggatgtttgaacctctgacagttaactcatcatgttctagctaaatgattaattctaactgttctaatgaacagaaaacataaatctcactttaggtggaatcattgtgacttactgattgaataaataggaaagaatcaggaatgttgctgtcatccttcattgggtgaatggtggtgccactcttggaactgacaaatgcagaaggaactggtatacaaaggaatatgattatgttgagtttgccttgcctgtggcatgttctagtggaaatgtctaccaggaagttgaaaatagaaatagctccatgtgacatgaggtcactacttgtgcatgtgataaccttctcaaacatatccaaaacatatttctcttatggccaacaaatttcatctctcccattttcccagtgaagggcatctaggaaacatccttgatttacttctttccttcagccctttctctgcctatacaacccatatacacaaatagtctatcagcaagtccaacaacacatgtagagtatatgctttcttcttccaagcactgaaaatagtttgaagatgggttcttccagggctgtgtcttgctgggtgggttcaccaaggcaaaagaacaaggtaaatattgagacacaagtaaggaagtggttaaaataatagagtgtacttaatctgagatagttaaagaaggtaagtaaagaaagaaggggattgatgagcagaaaattaagaagttaaggaaacaagcatcagtgttttaaaaggatgggacattgtaggatgtttgaatttaagattcagaaatacagcaattaatacaagattgacaactccaaaatgttgtcatgaaagtgattaagggggattgaagatcatggtaatcaggagattatgaaactaaaaggatggaatcttttgttgatttacccaagataaatccaggaaaggaagattgtcagcatcttctaaaagtcttcagtagataagtgaaatggcctgtgaggctgacagataatcccaaatgaggagaggtataagatggtattgcctgatttaacaggagccttaaaagaatcccatctcaaagttcatcttccttaaaacaaaatataatgcaggtgcaaagggagaggagttgaaaatacattacggaataacagagctttaaaagccagtcaaaattctttgaccctgatagaactctaatacaggtcacattggtaagagtaactatttaaaagcacttagtgatgtagatcaataatgattggatgggtcagcaccaaaaatgtctgttatttgacatgaaggaaattaggcagaaacctctatgagccagttcattgccgtcatcatttctgatgcattttttctaaaatatgtagatttttacaaattaagataattagtaagtcagaagtacgatactttgtaaaatgcctaatacatagattagaattacatgaaacaacaaataatgataatgaagaaaatcagcatgtaaatgtaaaataactctcacaaatattaaactactttttcagcaacagaaaagtcattagttttaaaataaaaattagtttttggattccctacattaatgaaactgctccttggcttacaaatggcatgacatttaaaatttttgacccattcgcaacaaacatctgtagttaaagtgaggctatcacagtctcttagtctataacttagctgcttattaaaatatacatctaccaaaccaaaaaatgtttttcaaaaagtaacatctggaatcttgtcagattctaaggcatttttgttgaaatcattgaagatggaacattattaggctagtgagataaatttcttgacacttgctgcgatttttgttttagaagcttgctttttggtttagatatttttatttatatatcatcacattttctaaaacaaaatgttctactcaaaaaatgtttggaaaattatgtaaatatatgttaaaaaggtttagaaatttgaattctgaccgcctttttctctgtaaatatcctttttttataacaacatatatttttgtttttcataagtgaagagtaaattggtttacagtgatattgttctatattatatgcacactcaaattgtatgcattagattgtggagcattttctgatatttgtgctcacaagtaggttagtgtcatttgtcagtaataaggcttgcctgtgtagttggaaagtgccattgccctagagtgctgtattttgaagtcatctgtcatggatacattgtagagagagaagactatttatgtttatggcattttaagtaactgagttaaaaaccctttggaatatagagaagtggcttgtttactgtcatcactgttcacttaatcctacgaccttgacatgatagcattcccataaatctccctgtgggtagatcaataaaacagatgaacatcaaaatgtaatgattgtttcagctttaggaattaactatgtaatggaataaatataagccagtaagcagtattacagaaacattctattataccaacccctttttctaacagataacacttactagaacataaggagttattatatattatattttctgataatgtttgcagtatctaacagattattatatattaaaaaaagaaaatagatacaagtaatatgcatattatgactggatttttaaatagcagtttaaaatttttggtatacctatgattataaaaataatgaagttagggttttttttgcaatgatgttttaatatagctttattttacattgtgtttttattgtattatatctccattgttaattttctctagttcattcattttaattttataattataattcctcaaacataaatttttaactacagtacgttcctctttcccccaatgtaagcagctactcaggtattcaggaaaaaaaaaactgaggaaattggaaaactgaaaaaataattaacacatcacactaggaaaaattaatggatgaaacttaagggaattaacactcagtcctcactatactatattccagagtccatgtccacacacaataggaaaataaaacttagattcaacagcctctgaaaaagtaaatactatgagtactcccattgcttacataatagatctgtaagataaaattattttaaagcaagttacatttgcctcttaccaattttcatatgtaacaaaaaaatggcaatttagtttggtgtagtaagaatctctattctttttgaacgatattttgtactttgcatgataatgatacattctaaatactaaaagtatgctatataatgtgaaatctgtgaaaaatcatagaatttatgctttatataaagattattatagaattattattatagaattatgtctaacataactgtaaagaccgttataagcatttttagtagctacttaggtagaaacctaacaaaatgagggttttgaagcctgtcagtaaagaaaaacaatattactatgatgtataagtccgcagaaaaaaagatggtagaagtatctttactaatttaatcttagaccattaacatcttccatgaagataaggtggatatgtgtcagtaaataaatggtcaactattttactttatgtttagacaattgagccccaggaatattttcttctattttaacaggctttcaagttgatataagtcctaaaaatttgattcgtaatttttctagaagttacaaattgtaatatctccttgtgcatactgttagaagctgttgttgttgttttttttttttccaactggtgttcttttctattaccattattcagtaagtagttaccaaattgtagtcaaacactctattgataaagataccattcagagctagggaatagagtattacacaaatagaatttttatgcctgttttgagtcttaacataagtctaaaaaattaaatacatctggcttttggatgaagaaagacttttgaagtctaggcagtaaaatatgccaaatataaactatcacactggcatttttacaggttgtaaactagacttatccaactgaataagctaagtgttcttatgacactttaatacacattactaagcagtaagttaacatgcatacgaagtggacaactaacaaaataccttgttaactgatttaggatcagtaattaagtccgcaataactgatggattgttaaaattttcacctttcattaaatttgatgtgttatgggcagagttatgtgaatatcggttccaagtattaatgcttccaggggcacttaagcgaagaggattttgtaattattttcttgaaaagaatcctatctgttgatacctactttagtttaaagtaaaatatataaatcaattactactatgtaattcgttatcttatataggtcctttcaatctatattaataataaagctttcttcccaggtaaattccagctatttctaatttactatcactcacattattttacattaaacttcaactgtggtcaacccaaatttgatcaataaaatagtaatcatcttataaagaaacctaaatatactcctgtctcagcctttttgtgactggtctgtgctattctgattttggtgtataatacaggacataaaggaataaaatacctgtcagatttgtcacttttcattgtttgaatttcttctctatctctattctgtcccacttgagatcatgccaataaaatattttttattttgaaattgcaatctcatccatcttcacacaatcaaaaattatttgtttttatttcatttattataaatatctttactattattgatactactattgttcgtttgttacttcttgaaacaatctatactccagatattttaagtggctgtctgaacgatttttaacatttaacaagactattatttttaatacacagtacctgccacttaggcttgaagattaaaaacatgcaaatgtaagtaggtgttagttattattatgtcattccttgttacgtatttaccaaatgaggcaatttgttaatgatataaaaatattaaaatatctaaattatacctaaaatctaatatatattaactcagttcagtatatttttttctttcagatgctaaggttagaaagtgtggctaacaagaatcctctattctagcctctgaccaattaacaaatacaaccaaaccatctaaggcacacatcagtgctccgaagtgtttgcctgcattttcttgtagtcattttatagctttgggttttaacatttaggcctttaatacatctttagttcctttttttatatagtgagagataggagtccggtttcatgctgcagatggatattctgttgtgccagcaccattttttttttttttttttgaagagagtgtgtgtttgtgacactgtttttgaaaatcagttggctgtaagtacatggatttgtttctgggtttcctattctgttccattggtctatgcatctgtttttataccaataccatgctcttttgaagttaggtagtgtgatgcctgcagctttgtcctttttctgtaggatttgcttaatctattcaagctcttttagggttccatatgaattttaggactttttgtctattgctgtgaaaaatgacattggtgttttgatagggattgctttgaatctgtagattgctttgaataatatgatgatattaacaatgttaattttttcaatcagtgagcattggatgtctttccctctggttatattttattcagttttgttcatcaatgttttgtagttttccttatagaggttgttcacctctttggttacattgtgaataggattaccttcttgagtttttactcagctagttcatcattcctgtatataaacactactgattttttatgttgattttatagcctgcaactttactgaatttatcagatcgaagaggtttttggtggagtctttaggtttttctagatataagattatgtcatctgtaaagaaggatggtttgatttcttcttttcgaatttggatgcccattactttttctcttgcctgattgctctgttcaggacttccagtactgtgttgagtagaagtgatgaaaatagtcatccttgtcttgttgagacttattttgtgtcataacatatagtcagtcttggagaatgttccatgtactgatcaagaagaatgcatattccatagctattggatgaaatattctataaatgtctgttagacccatttggtctaaaatacagtttaaattcaattttttgttgttgttgttaattttctgtctagatgatctaacactgatgtagggtgttgaaattcctaactgttactcaactggagtctatcgctccctttagatagaataatttaataatagttgctttatatatctaggtgctcctgtgctgagtgcatatatgtttagaattgttattttctcttgctgagttggtccctttatcataatgaccttctttgtcttttgtttttattgcttttgacttaaagtctgttttatctgatataagtatggctactcctgcttatttttggttttcctttacatggaatattgtttcccattcctttatttttagtctgtatgtgtctttgcagatgagatgagattcctgtaagcagcatatagttgagtcatgtttttaaaccattcagccaatatatatattttaagtggaatgtgtaatctgtttacattcaaggttgttattgatacatgaggacttatttctgtcattatattaatgtacttttggttgttttgtatatcctttgttcctttctctcttttattgtttatcattgtggtttggtggtattctatagtggtaacatttgagttctttctctttcttatttgtgtgtttagtctaccagtggattttatactttcaggtattttcatgattggagatagcattcttttgcttccaagtataggactcccttaagtatttcttgtgaagctggtctagaggtgatgaatttcctcagcttttgcttgtctgggaaagactttatttctcctccatttataaagaataactttgctgggtaaagtgtcctcagttggcagttttttttttctttgaatatgacatctcattctccactagcctataatgttcatgctgagaaatcccttactagtctgattggggtttccatataagtagttagatgtttttcttttgctgttttttgaattctttctttgtctttaacttttgacaattggactttaatgtgccttggagaagaccttttgaaattgtatctctttagggatctctgagcttcctgtatcaggatgtctaaatcacttactagacttgggaaatatccagctattattttcttaaataggttttctgtctcttttgttttcctgtcatcttcagtgacactaaaaattcaaatatttagtagctttgtgatgtgtgttgtgttatgaggactttgtttattatattcttttttctttattattttcttactgggttatttcaaaatatctttcttcaggttctgaaattctttcttctgcttgagctggtctattgttgaagctttctaatgtattttttatttcattccatgaattcttcagtttcaggattcctgtttgtttgtttgttatgatacctctttagtaaatttctcattcatattctgaattggttttgtgatttatttgtattatctgaattctctcatatcttactgagtttcttgaatatcattttgaattctttctctaggatttcataaatttctttttctttggaatttcctgctagaccataattttgtttctttggagatgtcgtatttgcttgctttcttcatggttcctatatccttatgttgatatctgcacatctggtataattgatgctacttctaattttttgaatttgcttttgcagtggaggatacttttatgaagatatgtctgtggtgtttgttgggtagggcactttggcctgattctgggtgcatgcagtagtgtactctctatataatttcttaagctttaaacagcatcagttgtatccatgatttcctcagcagcttagggtgtagttgtttgtggaggctgtagtaaagttttgttggagatagagatgccaggtgggccagtcctttgggctctgtggtggcaatggtgggccaagtctgcctgtctttggacccctatctggcataggctagtaccagttgtagcaagtccaggcataccaatttttgagtttccaggtggctttcttgggtgccagcagtggcagcagagggccaggtgggtagatgggcagattggctggtctttggttccctgggcagtgggcgtggtatgagtgatggtaataataatggcaggacaaccctccggctcccaagttgtctatgctagcattggcggtggctgtgacaggctgggtaggcctgtcccaggcctgcagatggtatattggaatgggtgctagctgtggtggtagtggcaaattgggtgggcccatccttaggcccccatgggaagtactcaggtggcaacagtggtggacagggcagagtgatctccaggcctccagagagtgtccttgggcactggggagggcagatccaggccagcaggacctgtcctcaagtatcctggtgatacatgcatatgctggctgaggtagacagggaggggtttttccgcagccccccagtgaattgcttggatagggatagcaacaactgcactgtggcctttctgctggggagggagtggttgctttcaatgtgcagcacccataagcagggagctggggagtgtgcacttcagcccaggtagcagcttcgtgtggtggtgtctatccttagcacacataaaaatgtgcagtggcaccatttctgggggcagtggggatgctaccagtggcttgtgcttcaactctgttggcagcagccaacagcatggcagctgtgggtgagggatgtcagtggaagcccaaggatgtagagatgcaggggctgttgggccacagggcaggatgtagtctaatggagactgggctctcaaaatggtgccttgatgtagctgcttaggcctcaggggtatgtgggatcagtttgagctccttttctctggcagtgtaatcacattgtttctaggcagcttcttgttttattatcagagcctccaagggccaagggactcgcctgaatctaggactgcaggagtccatggtgggaatgtgagccactgggggtctctcacccttttcccatactgggaagcctttccaggctcccagctgatctcagctgagtgggctgcctcacatccctctccttccttgccttaggtgtttcctgtcacctctctattgaattccagtgttctctcttagatgatctgttggaagtgtgattatctacctgctattttggttcttctttgtggagggggcaagtaccagatgcctctagtcagccatgttaaagccccacataacacatattttaatgttatatgtgttatatactgtattcttacaagaaagtaagttacagaaaatgtaatgttattaaggaagtaatggccaggcacggtggcttacacctgtaatcccagcactttgggagatcgaggcaggcaattgcttgagtccaggagtttgagaccagcctgggtgacaggacaaaaccccatctctataaaaaatacaaaaattagccgggcatggtggtgcatgcctgtagtcccagctattcaggaggctgaggtgggaggatcacttgagcccaggaggaagaggttgcagtgagatgtgatggcgccactgcactccagcctgggtgacagagggagacactgtctcaaaaataataataataataataataacaaaaacctaagaaagagaaaatatatttattacaaattaagtggaagtggatcatcataaaggtcttaatttgtatcatcttcatgttgagtaggctgaggaggaggaagaagcaaaggggttggtcttgctgtctcaggggtcttttttgcagaggtggaagaaaacccatgtataagtgaatatgaacagttcaaacccatgttattccagagttaactctacttgaatatcttagttattgtagcctccttcatcagtgatctgagctagatcttctgaataacttgctgcagcttctacgtcagcacttgtttgttttacctttatggtatggaagcagcctttgacatgccttcctcactaaacttaatcatttctagcttttgactttaaatgaaagacaccactttttttcactggaacagttagatgccattagttggggttattaattggcctgatttcagtattttttgcctcaggtaatggggaggcccaagaagaaggagaaacaaggcgaacagctggttctggagcaatcagaacacacattcattggttgagttcacagttagatatgggcaacattcatggcaccccaaaacaattacagtagtagcatcaaagatcactaatcacagattaccataacagatattttagaaagttttaaatattggaagaattacgaaaatgtgacccagagacattaaatgagcacgtggcaccaagagagttgcttgatacagggttgtcacagactttaaatttggaaaaatacagttatctgtgaagtataataaagctaagtgcagtagaacaaggtgtgttgtacctcataggtttgtggagcatatgttagaaaacaaaatcctgcagttttatgaaatttgtattaaataaatggatatttcaaattggtaataaatttaaaaggaaacctaaataataacatcaacacttactgtcttatttttctagtttaaatatatacagtattatatttaatcatcagaatagtcaccagcatatttcaaactaataaaatttacacaagtttaaaagtatctttactgttctgatttttaaccatttacttacggttttcctttatttttctcactgttataacagtgagaaatttatcaatgcattgtacttttacaaatacacaggaatgcatgctagactatttactagaaataactttcctaaataaaactgtgtcagagcattgttcatttgtaaatgttttccaagagaaacaataccaacttcaataccataaggcagaaattcacctttggctttaaaattcactggcagtatttttttatttattaaaattagaatgtgcataagactgcttttcatctctcagtatttaattataattagtcactttcgcactgctttccttcctttcaaagcagtacacacacaacttttgaacgcttctactagttttcgtgtttatttgctcaattaaaatcaagatttaaaattcatggtagacattcatttcttttggtatttaagtgaagcctaaaacatctattttattcaagaacttttagccacgccgtctcaacgtaaggtcatctcatacatcatattcgtgtgctccattttcaacaactttttgatacattggtaaaatgaaatttaagaaggtaacaatgtttttctgatttcaaaagggggaaatcttagaaaatctcctacttattcaaaaaataatattatatcaatcctcaatttttgactctggtttttccccttccaccttaactgaattatgattaaacatacatatttacagattttattctttacttccactacataaaagacttgcaactattttttatgtaatacagagaaagggacatgcatgattatgtcatagttttgcaaaaatccagcaaggtgacaagttaacttgtgtttctagaaaccatacatgaaatcatagcatttgtgatgctgaaatttattgtaaatgacagacatttgtctttgcagcagaacaacaagtgatcttaaatataatgagtcagaaatattagggaatttattaaaacattagacgtaatttctcagttactttctaaaattcatagttacctgaattaatatgactgttatttacagttaatagataaattgtttctacctaaatatttgaaatgtaatgcctttgtgttaaatattttctcctcagaagtatttatgaggggaaattgtctaggatacagttgtcagggactaattggataccctataaaacaaaagacttcattttatatatttattattattattctttacttttgcttttggtcaagaaggcaattggaaaagaacaaggacctgttatttccatgatctaaaggtttttactgcaacaactgagcagctcacttttattcaatgctacattaacttttccattacgggtgctgttgtcaagtacagagcctttgcacattatgaagttgctgtctggtatttgttcattgatatgatttccttatttgaatgtttcaagtaattctggagtgaaagccttcatcactttttaagattgttgtctctttcattttaaatttagttaaatttaattgcactgctatagtttaagggtctgtaaatgttttcataagcctgaattctctcattttttcttacttagaactactgtcacttaaactaaaatataattatagtgttactattattcataaaatctagtgttcagtgacaactcttatttcagcaagaaagagaaatactttggtgtcatgatgcccctttattcatttttcttcttttgcttcttttcattcgttctataaattattccagttgtctacaattgctcaagagccaaggaatattctctaggaggccggagtcttagggtgaaactgataggaggaggaataggattcccccattctggattagactgtgaggtgattagtctagaatggaggaggtggttagactgttgaaggagaaggagatttagagtagtagagtgtttaggaaaaggggttttgaagttgtgggcacatgctgtaatacagggaggctgcagaaaagtttctgtaagcctgcctccggttgaccatgtggtaccccactgagcagactggtgaacttacctattgagaggccctgtcccacattcctagcaaattttcagacctccttccatactggtaaaaggataaattctgtggtgatgaaaagcctattatagttacataccctttgttttcatgattccttgaagagctaagacatagagaaatagatcattaaaatgaagtttgtgttctgcaatattttatttgatgataggttggttagttttaaaattttgaccaaaataaaaaaagtgaagagaagaaacagatgtctccaccaactgtgggagtaagctacagtggtggcagtgtgattgatgttcatcaaaaacagtattaatctaataaacagcaaggagcagcagcagcaatggtgaaacacagggctgggaaggaagctaatttgaacactgtctagggattgcaaagggagatgtggcagaatacagttccctgccaatgaaggactacatagtcaatttaggttgaactgttgaggctggccatgagaaggaactatcctttggagattagggtctgatgggatatccctttcttgtatagcaataatcttgattcactgtagtttgatagttaatgtctcccaaatacttaatgcttccaaacttttactgctgaaacatgtcattgtcttaaagcagcaaggtgctatctcttattccataaccttgttaagtttacctgttccattgaataagcctctagctcagatctcagtgattggtacctatctatccctgatatttagccttccagttccctctaattttaaattgctttctcagcccactgttttaccataccttaacatcttggaagcatttgactcttgccttccagtaacttcaccataaattatgatactttctaccagtgtagtcctatctttgtgacccctgttatccctgtctctcatttctccaatcaaaacaaatagaccataaacatatacacaggtacataagcttactccctgcctgaaacaaaaacactgatttgtgtcttttcattgaagtttcttatttattattttgatctttatgagctcttcagtaattactttaagacagcagctcaaaatagagccctgtcttagtatttttacaaataaattatagttattctgattacaatatagctttaggaatggaagaacaaaataaaatgttatcatcaaatattactgtcttggggagaaacaggaatacttacgtgtatgtatgtgtttgtgtgtatccaggaataggcccatagaaataaagtctgtttttgcttcattcttcctcacatttcaaatatctttgcttctagaaatctctttggcccagctggctggcctggcctctgaagacaaacaccctgtctgtgcctcacaaaaataagtctattttgctagtagattctaagagacagagaaaaattcataactcaggaatgaacacctgtggtcaaatttcagaaaataaaataggtcattcaaaacatattttggttttgtcctggtatctttaaggtatatcatgacattggctggccacttagccactgcttataaagttagccttatactttatttttatttgttggtaaagaatccaagttagagccttttaggtcttgggtaagtgttattttacaagtaaatcaagttgatggatttgaatttcaaatacacgttgaaatggactatagatcaccacaggatatttaaaaaggcaaagaggcatgactgatttttttcctttatattaaagtatacatacatacagaagagtacatatgtcataattgaacagctccatgaattttcaaaaactgaaggcacctatgcacttaccacactagatgaagacacagacaattaccaacaccctatatgagcccttcttgtattcctcaccctgctaaggtaactgctatcctaaattctaagagcatttatttattttgtttacccttacatttataaatgtagatggaatcatatagtataaacgtttttgtctagtatcttttgcccaatattacatttgtgacattcattgatattatttcatacagtttattctcattgctatatagtagtccattgtgttaatgtaactgaatatatttattgtacagattttaactattatgaataatgttgctctgaacattctggtacatatttgtttttttttttatgaatagagttctgttgagcatatacctaggattggaattgctgagtcatagtgtagacttgtgtttaactttactgctgaacagttttccaaagtattcagttgctctgcattctctcctatactttacattttctgtgattttcattttagctatttaggtgggagtatgatgtattgccttatagtgttagtgcattttcctgaggttgagtgcctttcatcatggccaaaaaaggtcacttccctatcttcttttgtcaaatgtttatataagcctttggtccattgttctattggattgtctttttattcttactgatttgtaagaattcagtatatattttggatctgaggcatttgtttgatatatatattgcaaatatcctactctgggttgccttttgctttcttatttttagttcttctaatctatcattttatcttttatgattagtgatttctgttttttgtttaaagcatctttgcctagtgtggcatcacaaagatgttctcttaggttttcttccaaaagctttcttgctttgatttttactttcagatttgaaaaccatttggaattgtatatggcatgaggcagaagtcaggattactttttttttttttgcatggatattcagtcaaagtgttatttattgaaaagaccatactttttcttactgtagttaagatgtttgtttctggactctctctacagttcttttggtcagtttgtctatttttagaccaatctcacactgtcttaattaccatatctctataaatagatctttatacctggtagtgtaagccctttagctttgtggttctcacaaattgacttggctattcttggcctttgcattttcatattaattttttgaatcagcatgccaatttctgcaaataagtgttaggattttgattgggattgcattgaaggtagagaacaagttggagggaagtgacacctttgcacttttgatatgcaaatggcatcatttattgatatatgcctttctgtataggtcatctgtgatttctcttggtaatactttgtagttttggccgggcacggtggctcacacctgtaatcccagcactttggaaggctgaggcaggtgaatcacctgaggtcaggagctcaagaccagcctcgccaacatggtgaaaccctatccctactacaaatacaaaaattagcctggtgtgatggtgggcatctgtgatcccagctactctggaggctgagacaggagaatcacttgaacttgggaggccgaggctgcagtgagccaagatcacgccactgcactccagcctgggcaagacagagtgagactcttgtctcaaaaaatataataataataataataatttgtagttttcagtgtggaggtgttacagatatttcatcagatttatttgtaggtgttagatattttttgaagctgctgtaaaaaatatcatttttaaaatttgactatgaacttgagactgataaagaatttgttttcctgcatatacttttatctaataaccttgccaaatttgcttactagttataatagtttgtacattttatttgattttatatattttattagattatgagcacagtcatttgcaaatgctgtcagttttctttttcagtttgtgtagctttgatttgtttttctactttctgtaatgactgcggtctccagtacactgcagtatgataatgagaatccttgtcttgcttctaatgacagagaaagttttaaatattttgccacaattgtgatattagtcataggttgtttgtttcgttttgcttttttatagatactttttaccaaattaatgaaatttccttcctgtcctatttgttaaaagtttttatcctaaattggtatagaattttttaatatgctttttctttatcataattgccatatgatttttctttttttctacgaatggtagtgattgaattgaatgtggttataatattaagctatcaaaaggtaattattaaactctataatgacttttcagactgtaaacttcttgacagtttaagtacctaccctctggcaatgtttttggtacctaagtagtagtttttgttagctaactggtagttcaattaatatgtcatttgggggaatatatactttctttcatccaaattagtgccattaaacaactattctgtaatatgtcacagcagactactatgctgtacactttgtaaaatggaaagatatataagaatcagtcccagcctcaatgagctatagtctcatttgtgagagcataccaattcttaggtaattataatattaatacaaagcaatatttagtaatatttgagtgaggcattaactaacctgtatgctttataaagacatacatgaatatccagacttctattcccgagtagcatgggatgaaaccgccaggcttctttgagaaacattaagttatttaaaataaagtatgagagcaatagtagttgaagataagactgcaactctactgcaaagtagagtccaaattcaatcaaggaggatcttgaatgcccagctaaagattagacctggttctacctggttctgtaagcaactcaattttacaaataaggaaatatatcttgagaggtcctgacctgcctttggtgataataaatcagaactgggagttcataataaaaagaaggtaatcaccttaatccttaatgaaattcttcaccttcaccaaaccagtttatgtgactgattattataccggtgttgctttatactcataaaaataatttgtttattgtccatttttaattatcttcttctatttctaattatatttcttagttgtaaaactaaattgatgaagaatggaaaacaacaattattctctagccatgacagatataataggcattcatgtcatatgatactaaatgttataatgaggtcacagggcactggagaaaaggaaacaagccatatagtacctctgagtgatgaatgtgaggggaaacatcttatatagggcactagccaggatatttatcatttagtactgaaaacctgatgacatgataacaaggattttctatggtagtcatgatagcagaatcccatagactctcttcatgatgtctttatccctttagcccagcacttgcttaaacaagaggcaaatggccacagatttcatttgaaatgataaaaatacctttatcatttcctttttggctgttgttttagttatcttaatattcagaacaaataatgtaattctattttatttaacatatacttaagcaccagaaggctagcctttgtagttggaaggaaggtaaaaggagaaacacaagccatatagatgagaaactcattaacagttttgttgttttggggagtatactgcatttggagtagtaaatgctgtcttttagaaaacattaattgcacataacaattatcaataaataattgtgaaatgaattaatgcaaaaagggagtgaattgttatcatttctacataagcctatatgcacagtgttaatctcttctcattcacttgttttttaaatcacaactttttaataggtttacattttccaaaaagtgtatttatattattcactttaatagtaaaaatgcctgtattttgcaacatgataaaaaatttcataagctaatttgaactaaaagtggttaatttggtagcaagggaaactttagttcatcttaagcccctagtttagacttttatgggctgtatttcaaattcaaacttttgctacaaacaaaggaagagtaatcattctggtgtgaacagtgccactgaaggacataattctctcataccatctgtctttatataacctttagaccagcaggcactaattgataatacagttgcttttccctctgtccttaaatgcattaatactggccagatacacatctcactatacactgattatacataccagtaccttatagatttgaggaaatttgaattgtaagagaattcatggaagagaaatttagacataggctttagtggaggtaaatcatcaaaactgcccatctagaaagactccgaatttggtaagttaggtgacctcaaactgagggaggttagatgacttggtagaatttttaagagcattcagaattgagaatagaaggacgtatattatctaaagtcagaaaataaaataatatcagccaggaccaagatatgcctaatcaatatattaactgtcaatagcattatttaagggggagagtgaacagatggaatagggattgttcatgtaacatagttcagtctaattcagagagctatagggttttgcatacccaggggaatgattgtcaatgtgtagctggaaataatgcttttaagtgaacttttagatcaactcaaggcagagataatccaaaatacagcttttagattgagaagaaaagcaatgagagaccattgtgggtgagagggtcaggcatagccaagcgatgtgactggtcctcgtgcaggcatcctcctagcccagagacaacagtcactacacaggatctattggacgtagctgtactgctgagaaagacatggaaggatatagtatataatacagaagttaggaaaatgaacaataactaaaattattcatgaaatttgacctcgatgacaggaataatgttggtaaaatttttatcagtatttttaaagacaaggaaaagaatttcaggaaaaaatacaaatttgtgtgtatgagcatgtttaaacatatttttatgtttaaggtaaatgtatagtttcttctatgtttggcatagtgatgaaaaagccaagcagataggtattggcatatgactggctggccaaaagagagtcaatctggaaagatgaatccagtatagaggcacaagtgatttctagaactaattgaaagaaaaattgaaaaggaaagagattctaataccaaggcccagtcacacccatactgagtgaggtagcatgcggaagtcactaagacaccaaggaaaaggttagaaaactggaagaaaaacatgaacaacatgaatattaattttcagatgctaatattatatcagtgttctgttactgaatcagttgtaatgttctaaagagtatttacttatcctaagcttttatacctaaatggattctctctacctttagtaaaaattgctaaccagtaaattacatctctgagacattaagtagaacctttgaagtatgtgagagtaatacatctccaaaagtacgttatatgtaatcagaggagtgattatttcttcagtggattaaagccttctcttgtcaaagctgtcttacttaggcttttctacaaagcagtttttaaaatgcatcccatcagcatctagaaccttgaataatcttttttttttttttttttttttgagagggagtctcgctctgtcatccaggctggagtgcagtggtgcgatcttggctcactgcaacctccgcctcccaggttcaggcgattcttgtgcttctgcctcctgagtagctagaattacaagcacctgccatcatgccgggctaatttttctatttgttgtagagacggggtttcaccatgttggccaagctggtcttgaactcctgacctctggtgatccacccacctcggcctcccaaagtggtaggattataggcgtgagccaccgcgcccggcctgttttttaattacttattttcaatcatcttcattttgcaagtggactactttttctggaaagattatgatattgcaccattcccattgttaattacaagttcagctgaggatcaccaaacaggattcagtctgaaaatattatctactttttgatgttacctttctctttcgaaagtatactcctgctactgttggctcagatgtcctgtgttttaaacactgcatttatagtattacattttttccttctactggtgatagttttattcttcaagtaaatcttttttagtctctgctgcattaaaattttaataagttctaaaatagttcagcttttttagacttcagtaagttaaggttggcttgagtttctgtatgtattacttgtagagtactttgttttgattattctatgaggtaaaggttttaaaatttttgttttaaaattacagttttttataattagttttttgccttgcttttttctttttaagcattttgcttccacctggttgaacaatataaatcatacatttctcaatttacaacattaagaaattaatattttattttatttaacatactagttgggccaggaatggtggcacatgcctgtaattccaaagctttgggagtgcagagtggacaatcactggaagccagaagttctaaaccagcctgggcaacatagcaaggcccttgtctctgcaaaaaataaaatgaaaattagtcaggtgtggtggtgtgttcctgtagtaccagctacttgggaggctgatgcaggagacttgcctgggcccaggagtacgaggctgcagtgagccatgatcacatcgctgcactccagcctaggtgacaaagaaagatcctgtctctaaaaataataataaaaaaataaaaataaaacatgttaactggaaatgttttgtctttggtatgtgcctaatgcaataaaatctctattgctgttctctgtttcatactgactgaacagggattggctttatataaggctcaccacagtgccatgcacatgtggaaggtggagcttaataaataacatttaccatcactgatttacattgtttccccatcccatccattttcttgtaatgttttatataatttcctagagagattcacagtaaatataatggtatttcaggtaattacattaatgtgccaggttttaattaaaatacacattttctgaatatataatagaaaacctacaatgtttataaatagataaaataaatatgttaaaaataaaatatataatttgaagttgaatgctgtcaatttggaagatttttttaaaggccatgattattccataactgtttattttctctagattcttaatggtactcacaattaaatactaatagtgtggcaacaaatacttacactttgtttgcaaaatatattgatgttctactttaaactctccagtacattatggatgacttgagcaaaattcctattaacagaattttcatccgtacatttgtgaattaagaaacaattaagtgttctctgtccccaaaatatttctactacatagtctgaaattcttgcaaaatgctttattaatgcttaatgccacttttagctgttagttaacaaatggaggtactttgtatgttacataataattcactgactctaaaatttttctctttttaattctaaatatttacaatagctcattataaaataactataggcttatctaatcctgtaagataatgttgacctagttaaaaattgagaacaggcaaaatgaaaaagtaatagttatttcccaaagtattttttaaaattcaatgttttggttaactagatttaacaattagtttgtaaccatgattgaccatcaaggcaaacaaacctgaatttcatttgatcattttattttctaaacctctgtttaaaaatatattgagttttttatggttgttgataaatgtggctgccctaagcttatagcagaagatcaatgttttaaaaattgaaacagtataggtttgtattgattaatgtggctaaatcaaaacgagaggttttgtaacagctttcttagacaggctgctccccagtaatggcaacctatcaattttagctttccactgataaatcagcttgaaaattggatgtcaaaatttttttcactgaagtagtgattttttcatgccctttaaccttttctgatatattagattggtttataagactaagctctatcttatagaaagtagttgtcaaattgacatttggatagatttttaaatgattgtaacaactatttttatccctgtatataaaatacctgtgtgtataatcatatatattctacctccctaactagaaggattgtttatcatgagaaaaattcaatttcgcattacaaaattatagatgtgctgtttatgggtcttggatattcaaagaaggtcagagcctcaactggaaggttaagacacatggttccagaagtattttagttttcattgagtagggacattgattttttttccttgcgaattgattttttttccctttttttctttttatttccttgaaaattactaatggattaattaatggcacctattctatgttgttatatggtcaatagtaacttgatatgctttattaccaaaaacaacgaaaacaaaaaactgacaacactttcttatttatcaggaaccagtattgaggatttgaaataacactagaaaagatttgattaacagcacaggaaaacaggcttaatttggatttaatggggtagacttcagtgacagctgacagtaccataccttcatgcctacatagccgactttaagttagcctgaaaaggtattgattgtgaagttcctgttgtataattactttttgctaggaaaaaaaaatgcatggtgtattgatctagatgggagcatttgagtagcagtttcccttggctaacagtgagtgtcatctttcagccatgataaatggtaacgctctggctcagcataattactttgtggtgaaatgaacctcctatccccttcgccttttccctgcaaggagatatagtaatcatcatcgtctgaaagccatgatttactgaactaatcatcctcttaatagaggaaaatctttccccccagagtgtgtccagtttttgctaactgaaacagaaatgcattatgaaatgatagaatttttttaaatttccgaatccacaaatacacatctttttaatcaactatcaattattcctgacctatgcttctcccctctgtctattccctacctactaggtaacctttgatcttaacatcgaatataaataaaaagagaaaagagagatggccaaatcttatgtactcattttgacgataggtggaataattatgtaaagaaatttattacatttggcaaaaataggaatttatttagttaaaatatgtcttggaaagccttctgggtgtaacactttttcatacaatttttagtgttaagcaacattattattttttagtttctgtgatggttctctacattaagaggcaaataagatgcctttaatgtggaaaccatacattccccccaattctaaaaaactaagataatttatattgtatgctagcttttttgacaaagatatttaatatgttatctattttttattaagcctgtgttatattttgctgaaaatagatctgtatttacttgccagtactttaatatttcccctgggtaatgacttttagttaagtaatgttatttaaagaatatctggcagtcattttagatcattttaagactgctgtgaagggtttggataaaggtcattttcagtgattgtgcttagttaaataaatgtgaaaggtttcacaaagggaatcttgcttttcagtgtgctgtcataaatttcctcttagcacatctgggaataccaagtaaaatgtagttgtttctgccttgaaggcattatattttatattttccttctctttgtttattttctcctcataattctatttattcccacaactgagcacagaggtttcattttgtcataaattagatcctccacttttgacagtttgtggaaacccctacctatatttctctaaacgtttacgaagagtagatttttttgctaagacttcttgaaaagtctggcgggtttctttttttttttttttcttttggtaaacaattcctccctgaatgtaaccctggttcacagtttgctcccactctgaccacagctggcctcttgctgttcacagccgaaaagtgaaatcaattcttggtctaacaaaatgccaaatgcagatgaaagccattctgatcattcatagtcatttcccgtaattgtatcagcctgtggtacttatatgatctctggaaagcattgtttattcaagtaaattcagtcccagcttctttgttgagtgttgctgtcttctaggaaaataatacttccttaaacccataagcattgtgaatactcatcattatgcagttttctaaaataaccgttgctttttccccctaaggaaatattacatgtctaatcaaatcctttattatttaaattctagaaatttgtattctaggcaaagatgtctctctatttcttactgttaacaaaatttaaaattctgaaaccaaaaaaatgctaaaatacctcaatccaaatgatcattgatctagtattttcttaaaattttttaaatgagattagatagaaagctgtattattatagctgaatgcttcaaaggtcacagaacaactgtgagtttgatggaaaacagcttttctccttcctattttaaatggttcctactttgattgcaagcatttattataattatcaagagattagtctgctgtgatagaatccttgtaatggaaccatttaaaaggaatataatggcagtttattggattctgcaaaagaaaggagcacagataaagtggtccttttataaatggctcaactgctagctgagtatactaattttattattctctcttagttccctcactttagtagtttttgtggttaagattacagtttttttctaatatataacctgtcctctggtcatttctatggtttatgtcttttgtagagtgtgtgtgtgtgtgtgtgtgtgtgtgtgtgtgtactcagtactctctgatatatcgtttttgttttagaacatatatttgtataatattttttctaagattattttgaatatttacattttgatttttgaaacttataggcatattagatgagtccattcatcacttctcattcatgtgtacttattctctaggtacaataaagcaatccctcccagtgcagtaaatacccaggaagtgggacttaagacctattccgtgctaataccttttctataaaaattaatgcagttgacactcagggtagatatatttggattctttctaatttctcaaaggcaaaaataagggctttaacactttctttttctttggagactttaatccatttggaaccagacacaagacaatacaaggacaaaatttttgaagaacctaaattcagtaaactagatattcctgttctttcccaaactggaaactagtagaattgcaatgtttgctaaaatacttgaataaacaattagagaatcgatgcctgcagagaaaaggcactaaatgttatctgtcagaggtgtcagggctaggtagaagactcaagttcatccaaacagattcttgtgaagtgggggactggaatggggaaacttaaataatgctaaaataaggctattttagagattatacactttctgaaaacaaaaatcagctagtaagtaccttgcactaataggtatcttgagcataataggtcttcaagaatattttttggaaaattttgtttttattaaagtagtaaaggaaacatcactttttaaatcttaaattttatatttctttgaagaatttcaaattgtattatctccttttttatattttgtgttatcagtgtacatgttgttattttcttaatattgctgctatacaaaaatgcctgattgaagaggagtaatggttttatttcttcatacttacctgaaaattcttaaatcagttgtcctatgccataagaaggccttgcattccaggtgcagtggctcatgcctgtaatcccaacactttgggaggccaagactcgcagatcacttgaggtcaaaagttcaagaccagcctggccaacatggtgaaaccctgtctctactaaaaatataaaaatttgctgggcttgatggcacgcacctgtgatccctgctcctggggatgctgaggcaggagaatcacttgaacccaggaggcagaggttgcagtgagttgagactgtgccactgcattccagcctgggtgacatagccagacttgatctcaaaaaaaaaaaaaaagaagaagaagaagagggccatatagcttaaaggtttctagagataataactcactgtaagagtatacctagttttcttttcttcattacttgagtttcatgttgtacacatagaagaatttgaaattgtagttatgcaactgttattatagatataaaagaagttatttaaaagagagacatagttcagaaagactgaataatgaagatggttaaagatttacaaatttgttgtacattctacaagtttaccttgctttgctatttagttgcatacttaagctttgcttaaaagaatgttatacatgtgtgttaatatttacatggatgtttttaggtaaataatcattgtagatgcatgaagtatgtgtatataaataaataagaatattggaaacatggaacataaaagtaattcagaagggtaatttctgtgcacttgattcttatgagcactacacaaaatatctaaacaagtgaaataaggaaatttacatgtattaattgaaaactatctctggcattgattgtcaaaccaagtcatcagaaagttatttcttactaacttttcctcagatataattatatctgttaattttgcaaatgagttttctatacaactgaatttagtttttgcttctatctctgttgtaagcaataccacacatatagtgctactttcattaatatgagtttgatcaatagtggagctaaacttatatataggggagacgtaagaataattgcagtccgcttggtagaaggtatcacaagcacgctgtttctcttagattttatattataagtgaataaaaataaacttttctacaaatatcatatttgtattttgtatgcaatatttttattaattttatttagaagaattcagggagactggtaagatcatcctttaatcatttatgaaaatgaaagcaaaagaaaagatttatgtttacttgctagtactgtaataaggcaactgagaaatattattgaaaataaattaaggaattgtggcatttattcaagcacttggaccaaaaagggagaagagttttacttttaggaattgttacagatctccaatccctttaaaagccctgaagtatgtaaattttgtaatatgcctataggaaacatctggtggtaaaacctaacttgagccagtatgtgtgtgtgtggttttgttttttttgttttttttttttgcctttatcccacttagagtcaatattcatacatttctttgcagaaatattaatttatttgattacagagtagtaatctaaatgctactaggaatgatatataatacaaagtagctgcaccatactgatcttctaacatgagaaaaactatgatttgcaaaacatactcaatcccaagggttgtgcataagaaccgtgctaacggtacaaatggcagatcaaagctgccgtgagacctggagcaatcagaaaggaaaagttgaagtcaggtctttgaataaatgggactttttttgccctagataatttcaaattaagaatggtatcgtgcctagaccaaagatgttttgaggtgcagaagttaaaaactcagttgagttagcagtattcaaaaggaaggtccaaataggacacattgtggttattaatgacctcccaggtcacagttgaacattccattgggaattatttcctgttatagttgtatttgttggctatccagagctagcactttcggagtcctattcagtaattatgatctacattctttctgagaagctgtttttttacaacctctctagactaaccctaccaatatgactggtttgaaattgtatttaatcaatataatttgtccagttaccctaaagtgaaagatagcaattgtaatagattatttttccccgtacaacaccttaaacagttaacttggagcagtaatggaagctgcctctcaaaacacattttagcacattaaaaaaatgattttttaaattctcctggtagacaactaaatgtaaaattgtagagcatccactagagttttgctttcatcccagctgagattaattataagaagtacaatactccaaaaattaggataattctatggcatagaataaatagaaaatgataacttagctttcattgccaaacatttaaattaatatcctttggtatgcttttttctttaaagtgttttatttggtgaaaattggaatccaaaacatcatttgaaacactcatttatttcagaaaattttctgattattttattgagattatttaaatttagagtccttttttgtttttcagtttcaaacatttatggaaaattcaggtaccattaaaacatcctttttcttatttgaaatttctgtatgtaaatggtaccaatgatatccaaatttgcaactatgaagtagctaaaacactaagacaattagaaatacaattttagtgtatggttttccaagttaaaggaaagaagtatgaaatacattgtctatctttgctgtctcccttccatttagatttgtatttgattagacagagcaaacctaggcttaagttatgtaccttattagagaagttattctctaattagaagttattctctaataggcttattttccctggggatatgtgttaaacagtataactactacttttgctgccaggagctgtatcctagagatcaacagcccattctaggtattcttttataatatgcagcataccaagatgactaaggctcaccttcctgtttgaactattttatatcattgtatagacacagatgtactaagtgtgggaaaatagcatatccttcccttccagaaaagcagagactttatttagcttatctatacttctttttgctcccaatcattgatggattagcctatctgcaccacgcacttcagctgaacactgtacagatctgaaaggcttacttctgggaacagacgtttatgtatttctttacctagaaggaaaggattgtcttttcaaaacacaagggaaagtgcattttgtaattctctcctttcttccctcactcccttacttttccctcttgccttttttcctccctttttggtgttagagtagagcttcaagtatatatgtgatcattgatgaaaacttaagtgttacagtaaagctgtaatgtttagaaacatttttaagtagttgtaaagattttccaaatcaaataaaaagtggttcaatttcgatttacccacaaatacaaagaattaatataaatgtatttttcttgctacatgagcaaactcgctggaaaaaaaaatgagacatttcatgcattctagatcttggtatctcctccacataacatatgcatatatacaaacacagaacatgaactcacttccctgggacatttccaaaactatgctagacatggatccagctaaatttgcaaattctctaccagataattccttgtggtttcttctctcatccttattattttctttttctacttatattaggcttactttgttttgttttgtttttttctaattttttgaggtacaagcttaagtcattggttttagatctttctactttttaaaaaatataaatatttaaagctgtaagtttccttctacacactgccttaactgcatcccacaatttttatctgttttacttcctttgttgagtttcaaatgcttcctacatttaaatttcttttgtaacccatgtattatttagaagtatgttgtttaagtttccgatatttggagtgttcatagagatcttgttattgatttatacttcaactccattgtaatcagagaacatactccatgtaatttcagttcttttaaatttgaagattgttttaggacacattatatatgacatatcttgtcaaacataatgatatggtttggatctgtgtccctgcccaaatctaatgttgaattataatccccagtgttggaggttgggctcggtgggaggtaattggatcacaggggtggatttccccctttggtgctattcctctgatagaattctcatgagatctgcttgtttaaaagtgtatagcaccttctccttctctctcttccttctgctctggttatgtaagacgtgtctgcttccccttcgccttctgccatgattttaagtttcctgaggcctcaccagaaggagaagctgctatatttcctatatagcctacagaactgtgagctacttaaacctcttttcttcataaattacccagtctcaggtatttctttacagtagtgcaagaatggactaatacacataccatgttcactggaaaataatgtacatttttcactcattgaacatagtgttctataaatttaaattaggtcaacatggttgatagtgtgtttcagactgtttctttactaatatgtttgtctactcattctccctattaaaagagagatgttaaaatattctaatatgattgtgagattatttattcctatgattctgtcaattttgcatcatatattttaggctctgttattgactaagtacacatttgtgaatattatgtttcttcaataattgaactctttctcattattaaatatccctccttatttctggtaatggtacttgttttaaagcaaactttgtctgataataatatacatagctactctggcatcttatgcttattatttatatgcttttctattcatttattttccactcatctgtgtctatgttttttagtgcattttgtgaacacacaacatatagttgagtattgctttcttttttgagacagggtcttgctatggtgcccagtctggcctcagactcctgggctgagatgaacctcctgcctcagcctcccaagtagctggggttgtaggtgcatgccactgcacctagtgggtattgctttttaatctgttttgatctctgccttccaattagaatgtttagtttattagtgttgattataattattgatgtgattggatttagctctaaaattttaatatttatttgtttctgtgtgtctactctgtttatttctgctttgtgctctattctccctttcattctttttttgaattatatgaatatttttagaatttcattttaatttatatattacatttttcctatgtatttttgcagcatatttttagttgttgtctagggattattttatacatccttaaatttcagtttacatagagttaatagtgtatcactttatgtaaaacatagaaaccttgaaaccatatagattcatttgtagcttatcagacagggtcttagtcaccttgcgccattgctagggactgcagttgaactcaatccaaatgctcagaaatgggtaactcaccaattcctccaaattttcctcacctccaaaatgattctatttttgtttactcccagaacactcacattgttgtaacctctattttgttcagattttataattgctatctgttagagattcaatttatgaggcgtttactcctccaaaccggaagtagaactcgaactaggagtaatttttcattcattcctgtcctttaccactcctccagtaaccttccctgtgcccctgtattacatcagatagtcctgttggctctatcagtgaaagatattccatttctgacctcatctcttcattttcaatgctatgcactaccagtgtcttcatcctggacttctacactatcttgctaacctgcctttcagcttccactttaacactaccattgttttcctcacactgaagccaaagtaagataaagtaaaaatttaattttattactaccccttccttaaaaccttcaaagactccttcaagaccccaaatgaatttgtccctgcctaccttttagaacacatttgatccccttattcactaggcttaagccatactaacattctttctgttaaacacaccaggcttatatccaacttaatgccttccctgcaggctgtctctactgtcagtgcttttacctttaatctttgggtggctggatccttttcatcattgagctgtcagctcatatgtcaacttctcatagaggctttccccaaccatactgtatataatatttctagtccatctctatctcatgactaagctttattctattcataatacttaaccttatccacaagtattttgtttacatactctgcttaactacaggagaatgtaaactccatgagggcagagacttttttttactcttgatcagtgctgtatcctcagctcctagaaatagtgcctgttatagaatagccattaaataggtatatttttattgaatacacacatacatcagagatactgtgggttcagttccagaccactacaatacagtgaacatcacaataaagcaagtcacatgaattttttggtttccgagtttacactatacagaagtctgttaagtgtgcaatagcattatgtcaaagaaatgaaaacactttaatttaaaaatactttattgctaaaatgttaatgatcatgtgaaacttcagcaagttataatctttttgctgatgaagggtcttaccttgatgttgatggctgctgaaggttggagtgtctgtagcaatctcttaaaacaagaaaacaatgaagttttgccacatcagttgactcttcccttcacaaaagattactcagcagtatgtgatgctgtttgatagcattttcccatagaacttctttcaaaattggagtcagtcctctcaaaccctgcagctgctttatcaattaagtttgtggaatattctgaatgctttgttgtcatttcaataatgttcacagcatcttcaccaggaggaaattccatctcaagaaaccgttttctttgttcataagaagcaactcctcatcctcaaaagttttattatgagattgtaacaattgctattgctatttccactatatctgcagtgatttcctccactgaaatctttaattcctgaaagtcatccatgaaggttgaaattagcttctcccaaactcctgttaatgttgatattttgacatccttccatgaatcacaaatgttcttaatggcattgagaatgttgaatcctttccagaaggtttttgattgattttgcccagatccatcagagaaatcactagctatagcattacaaaatgtgtttcttaaataacaaaattgaaagttgaaataactccttgatgcatgggctacagaatggctgttgtgtttgcaggcatgaaaacaatattcatctccttgtacatctccaatcaaagcccctcggtgaccaagtgccttgtcaatgggcagtaatattttgaaaatctttttttctgagtagtaggtctcaatagtgggcttaaaatattcagctaaccatgctgtaaacaaatatgctgtcactaggcttgattgttccatttttagagcacaggcagactagatttagcataacacttaagggccctagaattttttgaatggtcaatgagctttggcttcaacttcaagttgtcagctgcattagcccccagtaagagagttagcatgccctttgaagctttaaagccaagcattgacttttctctagcaatgaaagtcctaggtgacattttctccctatataaggctgtttcatctacattgaaaatctgttgcttagtgtagccaccttcatcagtgatcttagctagatcattatataacttgctgcagcttctacatcagtacttgctgctttgcttcatcttgcacttttacagtatggagatggcttctttctttaaatctcatgaaataacctcttctagcttcaaactcttcttctaggcttcatggaattgaagagatagggctttgctctggattaggctttggcttaaggaaatgttgtgactgttgtgatctatcgaggccactcaaactttttccatatcagcaataaggctattttgcttttgtattagtgttttcacactgttttaaagatagtgccagagactgggtaatttattaaaggaaagaggtttaattgactcacagtttgcatggctggggaggcctgagaaaacttacagtcatggtggaaggggaagcaagcaccttcttcacaaggcagcaggagagagagaaatgaaggaggaacttccaaacacttataaaaccatcaggtttcatgagaactcacttgctgtcaggataacaacatggggtaaactgcacccataatccagtcattacaggtccctccctcggcacatggggattacaattggagatgagatttaagtgggaacacaaagccaaaccatataagctttcttatcattcatgtgttcactggagaagaacatttaatttccttcaagaactttttctttgcattcacaacttggctaaccatttggagaaagagacctcgcttttggcctgtttcagctttcaacatgtcttcctcactaagcttaatcatttctgccttttgatttaaagtcaaagacgtgagcctcttcctttctcctgaacagttagaggccattgtagggtaattcattggcctaatgtcagtactgttgtgtctcagggaatagggaagcccaaagggagggagagggacaggggaacaaccagttggtgtagcagtcagaaagcacaatatttattgtttaaatttaccaacttatatgggtgcagtttatggcaccctaaaacagttgtagtaacatcaaaggtgatggctgacaaataaccataacatataataagaatgaaaaagtttgaaatatcacaagaattactaaaatgtgacagagacacagtgagcatatgctgttgggactatgtcacggatagatttgctagatgcagggttgccacaactcttcaatttgtaaaaaaaaaaaaaaaaaaaaaaaaaaaagtatctgtgagtacattaaagtaaagagcaataaaacaagatatggctatgcttaatttgccagctggacttggtatatgatttattgagcctcctttccttatctatgaaatttgggtattaaaacatatatcatagaactattgtaagaattatatgtttaagggatataatgtagtgcctggctcacatttgttactcagaaaaattatcttattgagaatcacaaaaaagaaaggagacatctaatatgtcctactttttctcagagcaagaaaaattatatatattttttgaggattataccacaaccttgagagaaaaagtgagaggaaagaaccttagagctcatattatccaagatgatagaaaaatactttaagcaagcctgggagctctataaaatctgattcaaccctccctccccttactgcctcaatccacaatgaattttatattattccatttgtagtctggaatttataatctggaaagttctctggaaatgttggaatgggattcagactatgggatgatcaaggctatcacaatctcaagcaaaattcatttatccatttgtggagcactcctatgttaggagaaaaggagaaaatcactgataaaccttttttttttaatgggagttgatggtttttaggctcattctttttcagagtggctgtactccgaggttaagtagccctgctttcctcgtccacatggcacatccctctttatcattaaaggctcatttctaacatcatctgtctctttttgccccagcagaattcataattccttcacatgtgccctcaaagcactttattcaaacattgattatattatattgtaattatttatctatttgttctcctttccacattactgtaagattttaagtagaaaatactccttactaatatttattgtattaactcctagcacagttactagagcatggtagttcactcaaaaacagacgctgtagcaagcactatttctgagcaatgggaatagagcaatgataagacagaaaagacatctgccttcatgagcaagtaggaggtggcatgactgagctaacgtgcttaacatcccctgcctcatagtaaatgatatttttaagtgaagaatcaccatctccctgacaacacattacaaagtataaatcaaagggctatcaataagtgttacttaaataaaatagtgtgtggtcaaatgaatttaggaaatgttgagtacccaaacagtaaacagttttgtttacttcagatttccactattgtggaaaacttcaccaggttccctaaagttagttaatcaagtcttcctaagtgtattctaaaacatttgttacaccctctgttgctctatcttaagacatctgtaagagaaaatcttctagctcttttacaaagggtcattgccatctttaaatagttcagaatcaataagatccgtctattgctttgaaaagaatgtgcttttagagaaggcagaggtcatttattatcagctaaatgtacatcattttatgttcattatttatatttagaattagaaaaaaacttccattaaaggttaaatcaatggattatggattagtgagttgtgaagtgtgtgctgagttttctagtcatgatatatgccattgttttaaatacataaacctcctttatgtgaaagaggaaataatgaaattgattacgagtgcagctgtccatctgtaattataggttgtgtaacctgtgtacaaaatcttgggtttttattaacatgttatcgttattaattttacatgaactatttaaattttggatattgagtcaaaataagcaaaattctgataattacctaaattggggaaatagtttaaaaccacttcaaaaggtgaacaagaaaatatttcagacattttaatataaaatttaaatataattgcaataacagatataaatctcgaagtaaatacttaaaaagtttaaattatataaatacatctgttatgctgatctttagaaaaatattttatacctgaatagtaaaaatgagttcaaaattaaatgttatctttaaatatcaattttaaataagtacaaaatcatttctgtattgtgaatgccatttttaaaaatatttatccacattaatgagaatttggaagaaaaaatataatgaaagattgccatatggatgctgaactagcagttctttttcttgttcttttattattataatactcttaatgtggcaaatataagtcagggagagaaaattactttgagatggcttacagttttaaggactgacatgtgtaggaaaagaaccgaaccacacagtgtggagagtttgattgttttctgaatgggcacaaaagtgaaaacttcagccaagttaagagcttttgtaaataggaagttaattgtaaaactaacaagtacactttttaattagtttaaaagcagatgtgtttgataactttttggtgggatggaaacatttttctttggcatgtctcataaatatcagaaagaatcaaatacaaataggccggattgcatttaattactgagatgattgcatagcctaaagcagacttcacgaaggcagactaaattgtcaccatgttcttaatttactatgttgtattttcctttttgggctaaaagtgttattggcaaataattccctcctacaaaagaacaataagcttcttaaaaagtgatgcttttagttccattatcagtagtttcataactacttccacctcacttagtggagaagcaaaataggacatacatgattttgttaaaatccataagcatgtttaacacttaggagctttcctctgcctttgaagactattctgtgtcataactttgttttaaaatttatgtctacttttattgcatgaaaaaactgtgagacagcaatcacattaacaaataataaataaaaaattaattaaaataaattacttaaaattgtatttaaatattttctttgaaatagttattaatgttaatatgattaataacaaatattaataatagctgcctattatttgcaaacactattataagtactatagggttgcaaagctgcatgaggtgaatatcccgatctcttgttgcttacaatctagtaagagtgtcaaggtataaatgcatgaggcattaaattaacagttgagatccaaaaaaagaacaatacagaaataacgccgcatgtctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattagagacttaaacattagacctaaaaccataaagtccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaaaaggcaacctacaaaatgggagaaaattttcgcgacctactcatctgacaaagggctaatatccagaatctacaaagaactcaaacaaatttacaagaaaaaaacaacaccatcaaaaagtgggcgaaggacatcaacagacacttctcaaaagaagacatttatgcagccaaaaacacatgaaaaaatgctcatcatcactggccatcagagaaatgcaaatcaaaaccacaatgagataccatctcacaccagttagaatggcgatcattaaatcaagtcaggaaacaacaggtgctggagaggatgtggagaaataggaacacttttacactgttggtgggactgtaaactagttcaaccattgtggaagtcagcgtggcgattcctcagggatctagaactagaaataccatttgacccagccatcccattactgggtatatacccaaaggactataaatcatgttgctataaagacacatgcacacgtatgtttattgtggcactattcataatagcaaagacttggaaccaacccagatgtccaacaatgatagactggattaagaaaatgtggcacatatacaccatggaatactatgcagccataaaaaaggatgagttcatgtcctttgtagggacatggatgaaattggaaaccatcattctcagtaaactatcacaagaacaaaaaaccaaacaccgcatattcttactcataggtgggaattgaacaatgagaacacatggacacaggaaggggaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacatgtaccctaaaacttaaagtataataataataaaatttaaaaaaaagaacaatacaatgattaattgccaaatttacaagcaagagtattttagagagaggaatgtcatgtgatacgaaataaatattagaaacatagcaaagaagaatacacaattaattgccaattcgataagcattaaaattttaatgagaagaatagcatagaacttggaatgaacacgattggaggaaacagtcagaagggagtaaagattctaaataatgcagtaagagagatgatactggaaagggcacactctgtggaccctgagaagcagcataggaaatttacttcaatatttctgtcatttcagtaagtattgcattaaaaattgttatgtttgaaaagaaacaaatctggattttttgaaaacatattgttgtagaaatagaaatgcaaaaatacatgcactttagtctgtgtaacagttgatgtaattactatttattggtggactcatggcaggcactaggaaaagagcattataagaactgttacatccatatgaatgagaaacgaatactcagagaagctgtcatttacctagtaggtggcagggctgggatttgaacccatatcttagtagactgtctcatgctgctgctgctgctactgctgctttcttatatgtgctaggcactgggctaaacactttacatatattccttctatcagttttacaaaatcgatttaatttatcccaattttgtgaatgaaagaactgaggtttagataattgcagtagtaaaaatcatgaacttaataattttaataccaggcttgtaaatgtgacatagctaataagacatctttaatataaaatattttatgagatttaaaaaacattgattttgctgtgatagacgtagtttcaaaaacaattgacaattgtacaatttagcatttaaggatattcctcaaagtaagtccttttctgtgggatttctaacagtaatcaaatgttgaagtcttatggggaagaatttttaattataatttctaaaaataattgaataagcctattccatatagcagtaattattaagatgaaagaatgcctactttcttccaagtgtggtaattgctcagtagaattagctatttcacaagtaattttacagttttgttaattaagattaaagtaattatcttggccctaagattgctttaaattgagagtctagctctactggcagaaaagaaaaagagtgtataagagctctaaaaaggtttgtatgctattcctgccccctccatctccagaaaaaaaaggctgagtcagaaaaagagcttgttaaagacgcgaagagtgaaaatgcaattccacatttgtggtaatagagagcttattgaataaagctaaaaacaaatcatttctctctttttactctccagccctgccttcttgtttaatatttggagtcacttttttccttcatgttaataaagtgaaaaaatatactcattatactaaatttttcctcaatggcttcacctttaaaaccttccattgacctcagccaaatcttttttttttttttcatttatttcaataggttttggggggaaaagatggtgtttggttacatgaataagttctttagtggtgattttcgagattttggtgtacccatcaccggagcagtgtacactgtacccaatttgtagcgttttatccctcatcccctcccaccctttctttgagtccccaagtccattgtatcattcttatgcctttgcatcctcatagctcgtctcccacttacgagtgagaacatatgaggtttggttttccattcctgagttacttcacttagaataatggtctccaattccatccgggtttcagtcaaatcttttatgtaggatcacacctggtgacctttaagaaattgaaccatcacaagaaatcagttggcagtgttctactggggtggctcttcctctttagtcatagattaaggaaagctcaagaaccacaactctactgctctgtctgaacactcaattgttaattttgttcctcttcttttagctgaaattcagattttataaatattgtgaataaatattttgtgagagttgagctcaatttcctggacaacacacttaaaatacttgctcttatgtcttacagttgcatacagaacctgaccagatgtttatgggtttttttttcttttttctttgctctttttttttttttttagacagagtctcactctgttgcccagaatggagagcagtggtgcaatctcagctcacggcaccctctgcctcccaggttcaagcaattctcctgcctcagcctcccaggtggctgggagtacaggcacccgccaccacacctggctaatttttgtgtttttttttcagtagagacagggtttcaccatgttggccaggctggtctcgaactcctgacctccagggatccacctgcctcagcctcccaaagtgctgggattacaggcatgaaccactgcacccggcctattttttttcatctgtggttatcacattgaaattatcccttaaagactataaaaccactttattccttcagataccagaaaattaggcttatagggaatgataaccaagagacaaaaagcaacagctaaattttttttgttcttaaaaaaactgcttttcctgaagaaagtaaaataaaataaagcccagattaaagaatcaaatataaagacatctaatactcttatcagaagacctttctgcatcatttcaaaaaaaaaaaaaaaggctgtaagcctctgataagattattttaaggacagaatgaagatttcctcttgaatgatttgctctgccctttatcaaaaagacatgtgtctgtccactttaacatttctggtataaatataccttgtcctttaaaaattactgcataacattaaaatcacgagcattgctatacatcatcaacagtcaagccagagagccaaatcaggaatgaactcccattcacaattgccacaaaaagaatcaagtacctaggaatacagctaactagggaggtgaaagatctctatgaggagacctacaaaccactgctcaaagaaatgagaaatgacacaaataattggaaaaacattccatgctcatggataggaagaatcaatatcattaaaatggccatactgaccaaagcaatttatagttttaatgctattcctattaacctaccattgagattcttcacagaactagaaaaaactattttaaaattcatataggaccaaaaatagcccaaatagccaatgcaatcataagcaaaaataataaagctggaggcatcacactgtccaacttcaaaatatactacagggctacagtaaccaaaacagcatggtgggtacaaaaacagacacatagaccaatggaacagaatacagaacccagaaataaaaccagatacataccactatttgatctttgatgaacctgacaaaagcaagcaatggagaaaggatttcttattcaataaatttagtgctaagataagtggctagccatatgcagaagattgaaactggaccccttccttataccatacacaaaaataaactcaagatggattacagacttaaatgtaaaacccaaaactataaaaaccttggaagatagcctaggcaataccattcaggacgtaggcatgggcaaagatttcatgacgaagacaccaaagcaattccaacaaaagcaaatattgacaaatgggatctgtttaaagagcttctgcacagcagaagaaaatatcaatagactaaacagacaacttacagaatggaagaaaatttttgcaaactatgcatctgacaaaggtctcatccagtatcttttaggaacttaaacaaatttacaagcaagaaacaaacaacccaattaaaaatgggaaagaacatgaacacttttcaaaagaagacatatatgtagccaataatcatatgaaaaaaagttcaacatcactgatcttaggagaaatgcaaatcaataccacaatgagacaccatctcacacccgtcagaatatggctataattaaaaagtcaaaaacaacagatgctggtgaggtagtggagaaaaaggaacacttgtacattgtgggagtgtaagtcagttcaaccattgtggaaggcagtgtggcaattcctgaaaaacctgaagacagaaataccattagatccagcaatcccattactgggtatatacccaaaggaaataaatcattctgttataaagacacatgcatgtgtatgttcattgcagcactattcacaataggaaagatacggaatcaacctaaatacccatcaatgatagcctggataaagaaaatgtggtacatatacaccatggagtactgtgcttccatgaaaaagaatgagatcctgtccttcacggggacttcgatagagctggaggccattatcctaagcaaactaacaggcacacaaaatgaaacaccacgtgttctcacttgtaaatggaagctaaatgatgagaacacatgacacatagagggaaatgacacacactggggcctatatgagagtggagggtgggagaacagagagaatcaggaaaaataactggtgggtactaggcttaatacttggatgatgaaataatctgtacaacaaacccccatgatacaagtttacctatgtaacaaacctgcacaagtacccctgaacttaaaagttaaaaaaaactactgtgtaacattaacatgatatttcaaagttcactgtaagtgaagagtttacttgcatagtgtattttatgcctagatgttttatttttcatattatgtaactaataataagttatcatactttaaccaaatggttctacctgtttctctttctgataaataagtaaatttggagtaaaagtgatgccaagaagtaaaatatattgctgcagtgagcaatacaggggaaaaggaaggcagaaggtagcagaaactacaaagggggaagtgtagagagggccgcagcttaacaaagtagtagctcagtaaaagaaacacatactggaattaaaattttagacaaaatgttactttcctatccactttcttttttcatgtctttatttgatttggttgataacaaacttttctaattattaagtataggttataccatctaacctatactttaattatattcatgcttttttgcctaaagtttcattattattagtgggggatctttttgatttgatactggcatttattactgtcttcctctagttgaatccaaaatgtttcagagaatttatcaagaatcatcattaataataactatatcctactgatatgcatggaaataaatggggatataaacaaaaagttgaaatgcatctcagtgatgtatttacaattctgattataaaatcctatctttccttccatgtttagcaatcacatggagaaggcacaaattagtctggctttaaaacattgaactaaaaactaggatttgactatctgagccatagctttacagtgtcagaatatgagagtatacttcgtaaaggcaggaaggatgcatttttcaagaacttcaccaattaatttgcaatgtaaattgatataataaccagataataatacacaaccctaggtaagggggaatggaagagtgtcagagaaagaagaccctgaaataatacataggcaagagtcagaatagtagtaatggcttaagatatatatcagatgtaagaggggacttcaaaaggttcacagaaaaatggaattaaaagataggaataaagacatataaactttatccctcaacataaataccatcaagttcaggacacttttgtaagtgataccagccatttagtccatccctaaagaactgagggtcttggaatttaacatgtcagtacagtttttttacattattaactgaagaaaagggtaccctttacaaactttttaagattaggaaacaaaaagaagttacaaggagccaaatcaagactgcatgatgcactcctgctgatttcccatagaaactctgaaaattgcacttgtttgataaggggaatgagcaggaacattatcaagtcagaggactctctgatgaagctttcctgggcatttttgtgctaaagctttagcggactttctcaacacactctcataataagcagatattatcgttctttggttctccagaaagtcagcaagcataatgccttgagcatcccacaaaactgttaccatgacctttgctcttgaccagttctcttttgctttgactggaccacttctacctcttggtagccatttttttgattgtgctttgtttttaggatagttaagttttatctcctgttacagttgttcaaagaaatacttaaaggtctttatcctacttgtttaaaatttctgttgaaagctctgctctcatatgcagccaatatgggtgcattgattttggcacccatccagtggaaagtttgcttaactttaatttctcagttagaatttgtaagccgaaccagttgagatttctacagtattggttattatgtccaattggtcctcttcaattagcgtacaagcaagattaatttttttgatgaattgttgtagatgatttgcctctgcctctgcaggcttcatcttcaacactgtcttgtctcttcttttttttttttgagacagagttgtactctgttgcccaggctggagtgcagtggtgcaaacacacctcattgtaaaccttgacctcctgggcacaagctatcctcctgcctcacctcctgaatagctgggaccacagacatgtgccaccatgccctgctaatgtttttcttttttgttttttgttttgttgttgttgttgttgttgtttagtttttgtagataaagggtcataccatgttatccaggctgatcttgaactcttgggctcaagcaatcctcccatctcagcctcccaaagtgcaaggattacaggcatgagccaccacatttggcttgtctctttaaaaagtcatccatcaacacctgtgaaaagaagggggacaatacaagttttttatttgtaaacttctgatttctttaattcttcccatgtttttttaaccatcaatgattttatcattcttccaccgaaactttaccataaatttggtacttgttcttagttcagttgtagcagcacttaacgttgctctgagagggttttgttcaaactgatgtcttacccttcttagtgccttaaactatatcctgttcagacatgtagcaagttagtacaagtttattttggtgcaaaaaatttgaaatccatgcataatgttttcataatacacattttccatgaactttttgaagtctgctagtatgtgtatagatatatattataggtaagagattttgtgtgtgtgcacacatgcatgcacaaacccacagcattgcggtactatatatcactgagaatacatccaacaggacacaagacatgttaactaaaagggcgctgacctttcttatggtggagaacagtgccagtaaatatagactgtgtcttttcaacatattttgtaatcatgtttcattagtgatttctcatatatatacttatacattcacctgtgcggcaagtgggttcccccattttcattactttgtctcacctctttccttcaatttggcaaaaattttaactataagtttgtttttattatgaaatagactgaaagctgcacaaaggctagaatcatgctgatatttacctagtatgcatacctcgtatttagtctgtggcttggctcatagatttgtacagtaagtgtttgttctaatgaatgaacatagacattacacatacagtactctatgtatatcatagttatcactgtttatccagagtatttagtactggttttagagaggcaggaaacagctatgctggtgctgtcaatgtagtattcttaagatagtccattttcttggttgcttttcttgcagttagaagcggtgcagcataagcaaggaagtcagactgcctgaggacacattctgccaccagctagttgtatgatcttgggcacattacttaaccactctgtgcttccatttcttcatctgtacaatgaattaataatagtacctatctcaaagggattaatgaaaagtagttgagtagtgagtagatatgtgtacaatatttagaaaggtacctaaacacaataagctctcagtaaatattggcctattttcttgatcactaaagtggtaggaagggaatattactaattatatactagctcttaaagtttttgtctggaaatgtctcacttctgctcacattttattagctggaggaggtcacatcaacatgattaagttcaaagtgatagaaaagtacaattttaaaatgtgtattgaaggagaggataaccatttgtaactctcagtacttatgtttttgtttaatcttggtaggattagaattcatgcacagaagtcctgacctcaatgattaccacttaactcttgtagccaaagggaaattctgtttcttatgtattttttgtgtgtatttagtaaaatattcctttgtttacttcactctttcctctgttccattggatagtttttgttactacgtattaaataatcaattaattttcagtagtgcttcaccaggtaaattcaggttcctctgtagcttttaaaggggaaccattcctgaggggccaggaggctttaaggaaaatcaagtacatgctcataagctgaaaatgcaattatcaaaaattttattgaggaaactatgagtacctaaaccctatttatctaaaaataacaccaagttccagctaatgaacatcattatatcaatagtaatattaattatcataatacaacctaactggaaatcttcccttcattaattattgattgttcatatgttcttttcttgcagtagtacactgttctcgtatagccacactcatgaacaaaatatacatatgatgctcaatgtttctgtataatttagtcattaatggcacaaagatataaagaacaaaaaataaacaaatgaaaagaaagcatatgataccacactcaccttcctagtgttgacactggaggtatcatacatgagataataaaagtataagctagcaaatccaaacagacttcggtgtagcatgagtacccatgcaactgtggagacagtagcataagtggctcctgtctgttcaactgggtactctccaaatacaggaaatctaaattagcccttcttcatgaaaagaaatgcttttatataccaaactgaggacattcgttgaaactcttagagcagtcagaatatactgactaaataggcatatcataggataacatgaagttttgatcatgcttacaaattattaataatagtcacatctacagttactcttttttttattatactttaagttctggggtacatgtgcacaacgtgcaggtttggtacatatgtatacatgcgccatgttggtgtgctgcactcgttaactcgtcatttacattaggtatatctcctaatgctatccctcctccctccccccacctcacgacaggccccagtgtgtgatggtccccaccctgtgtctaactgttgtcattgtttaattcccacctatgagtgagaacatgtggtggttggttttcggtccttgcgatagtttgctcagaatgatggtttccagcttcatccatgtccctacaaaggacatgaactcatccttttctatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggaatatgcccagtaatgggatggctgggtcaaatggtatttctagttctagatccctgaggaatcgccacactgtcttccacaatggttgaactagtttacagtcctaccaacagtgtaaaagtgttcctatttctccacatcctctccagcacctgttgtttcctgacttgattcaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttgtcttgtaaatttgtttaagttctttgtagattctggatattagccctttgtcagatgagtagattgcagaaattttctcccattctgtaggttgcctgttcactctgatggtagtttcttgtgctgtgcagaagctctttagtttaattagatcccatttgtcaattttggcttttgttgccattgcttttggtgttttagtcatgaagtccttgcccatgcctatgtcctgaatggtattgcctaggttttcttctggggtttttatggttttaggtctaacatttaagtctttaatccatcttgaattaatttttgtataagatgtgaggaagggatccagtttcagctttctacatatggttagccagttttcccagcaccatttattaaatagggaatcctttccccatttcttgtttttgtcagatttgtcaaagatcagatagttgtagatgtatggtattatttccaggggctctattctgttccattggtctatgtctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaaaaaagtcattggtagcttgatggggatggcattgaatctataaattaccttgggcagtatggccattttcacgatactgattcttcctatccatgagcatggaatgttcttccattcgtttgtgtcctcttttatttcattgagcagtggtttgtagttctccttgaagagatccttcacatcccttgtaagttggattcctaggcattttattctctttgaagcaattgtgaatgggagttcactcatgatttggctccctgtttgtttgttattggtgtataggaatgcttgtgatttttgcagattgattttgtatcctgagactttgctgaagttgcttatcagcttaagaagattttgggctgagatgatggggttttctaaatatacaatgatgtcatctgcaaacagggacaatttgacttcctcttttcctaattgaataccctttatttctttctcttgcctgattgccctggccagaacttctaatactatatcgaataggaatggtgagagagcgcatccctgtcttgtgccagttttcaaaggaagtgcttccagtttttgcccattcagtatgatagtgagtgctcttattattttgaaacacatcataaattgctctaattttgagacacgtcccatcaatacctactttagtgagagtttttagctgttgaattttgtcaaaggccttttcagcatctattgagataatcatgtggtttttgtctttggttctgtttatatgatggattacatttattgatttgggtatgttgaaccagccttgcatcccagggatgaagccaacttgatcgtggtggataagctttttgatgtgctgctggatttggcttgccagtattttattgaggatttttgcatcaatgttcatcaaggatattggtctaaaattctctcttttttgttgtgtgtctgccaggctttagtatcaggatgatgttggcctcataaaatgaattagggaggattccctctttttctattgattggaatagtttcagaaagaatattaccagctcctctttgtacctctagtagaattcagctgtgaatctgtctggtcctggacttttttggttggtaggctattaattattgcctcaatttcagaacctgttattggtctattcagggattgaacttcttcctggtttagtcttgggagggtgtatgtgttcaggaatttatccgtttcttctagattttctagtttatttgtgtagaggtgtttacagtattctctgatggtagtttgtatttctgtggaaacggtggtgatgtcccctttatcattttttattgcatctatttgattcttctctcttttcttctttattagtcttgctagcagtctatcaattttgttgatcttttcaaaaaaccagctcctggattcattaattttttgaagggttttttgtgtctctatttccttcagttctgctctgatcttagttatttcttccttctgctagcttttgaatgtgtttgctcttgcttctctagttcttttaattgtgttgttagggtgtcaattttagatctttcctgctttctcttgtgggcatttggtgctataaatttccctctacacaccgctttaaatgtgtccccgagattctgctatgttgtgtctttgttctcattggtttcaaagaacatctttgtttctgccttcattttgttatgtacccagtagtcattcaggagcaggttgttcagtttcgtgtagttgagtggttttgagtgagtttctttactcctgagttctagtttgattgcactgtggtctgagagatagtttgttttaatttctgttcttttacatttgctgaggagtgctttacttccaactatgtgatcaattttggaataggtgtgatgtggtgctgagaagaatgcatattctgttgatgtggggtggaggttctgtagatgtctattaggtcctcttggtgcagagctgagttcaattcctggatatccttgttaactttctgtcgcgttgatctgtctaatgttgacagtggggtgttaaaatctcccattattattgtgtgggattttaagtctctttgtaggtctctaaggacttgctttatgaacctgggtgctcctcttttggatgcagtgcatatatatttaggatagttagctcttcttgttgaattgatccctttaccattatgtaatgaccttctttgtctcttttgatctttgttggtttaaagtctgttttatcagagactaggattgcaacccctgctttgttttgttttccatttgcttggtagatctttctccatccctttattttgagcctatgtgtgtgtctgcatgtgagatgtgtctcctgaatacagcacactgatgggtcttgactgtttatccagtttgccagtctgtgtcttttaattggaacatttagcccatttacatttaaagttaatattgttatgtgttactcttaaagacattattattagagtattttctattgttttttctatagtgactcatttgcagaagaaaatggcagaagaataacttattatgttgaaatactaaatagaaggagtgatgcaggaggagtttagctaaataaacagaagaaactatgtgcttgtatagtgatgaatttcagtaggaaaacagagtgaagaacatatgagaatgaaaggaaaggaaatgcatgatgttgttttaccacaagaatatatgctcagcactgagaatattgcctaacacaaaatagatgctcagtaaatatatttttgaatgagaaccatagaaagaaggatggaaagaaatagacaagaaggagtttgaacagaaaacagatgatgatatcctagattggtaacctggcacagatgccaaatataatggtgttggaacataagccttttttgaacatattattctacagtagaaaaacgtctcatgattcatgacttggtggtaaacaatattatcagaaaaatgagaatataaggagagtattatttgtatactctatgttttagttcgttgaggctgctataacaaattacaggctaagtattccttatatgaaacgcttggggccagagtgttttgaatttaggatttttttcagattttggaatatttgcatgtacataatgagatatcttggggatgggacccaagtttaaaaacaattgtctatgtttcatatatataccttatacacatagcctgaagattttatacaatatttttaataattttgtacatgaaacatggtttgtgttaagtacttatatgtggaattttccacttatggcatcatgtcagcactcaaaaagttttgggttttggaacattttggattttcagattagagatgcttaacctgttccataaactaggtagcttatgaacaacagaaatttatttcttgcagttctagaagtgagaagtccaggatcaaaataccagtagatttggtgtttcgtgagggccccacctcctggttcatagaacagtgccttctccctgtgtcctcacatgatggaagtgacgaacaggctcccttgagcctattttataagggcactaatcccattcacaagcgcttttctttcatgacctaattactttcccaaaagccccagcacatcataccatcaccttggaggtaaggatttcaacatatgaattttggacagaaaccatactaatgacagtgtttctgaacatttctttattagaaactgcttttggaaaaatgtaataaaactctagacttctccctcaaaaatacgtatgtacatataccataaaattttgtagaccatttcaggagttttgtgaatctgtaaaactcatccattggttaatgatgagtgccacatttttaaataatgtgaatgttgggttaatatctacccccaccccccgaaaaacatgaaaagaagagcacagaagtgccaaggaacaacacaaagctctgagatagatatcagaaggaccaaaacccagaataacctgaggtgcagtctaaaaaagtaatagaactcctccatcaggtcccacagtatagtagggtatagcccattatctttccatttagtgattataattttttgtgtccacatattcactgctagtatatagaaatacaattattatttgtgtgtctatcttgcatctcgtgaccttgcttaactcagtccttagttctaggagtgtttgacagattttgcatgattttttacatagacagtcatgttatctgcatatagggacaattttatttcctctttttctatttatattcctcttatttcctctcttttgccttactgcattggctagaaatttcagtactctgttgagtaagagtggtaacagcagacatctttgccttattcccagttttaggtggagaacattcagtctttcactcttaagtataaagttagctaaagttttttgtagacacttttatcgagttgaagaaattgccttttattcctgttttcctgaacttttctaaaattgtgaatcgttgctaaattttgtcaaatatcttttataatgactaatatgatcatgtgatttttcttcttcagctgttaatgtaatgcactacattgattcttaaggatttttttgtctatataaaggatggatattggtctgtagttttctttttttgtactgtttttggtttttgtatcagggtgatgttagctataataattattgagaaatatttcttcctattctgttttctggaagagattatgtataattggagttaattcttctttaaatgtttaataaaattcttcagtgaaactatctaggcctggagatttggggaaagaggagtaaacatcttaaatttctttaattgttacagagttgttcatattatctttttcacattgggtgagttgtggtcattcatgttttttggtccatttcttctaagctgccaaatttatgtgtgtagagtctttcacagtatccactccttcttttgatgtcttcagagtcactagtgatatcccctttttcattcctgatattggtaatttgtgtctactcttttttactttgtcagtctttttagaggtgtgtcagtgttattgatttttttcaaagaaacagctctttgtttttgttaatttttctctgttgtttttctgttttcagtttcactgatttttattgatttctgcttttttattgtttcctttcttctacttgccttttatgtgttcttaaggtgagaatttaggttactgattttaaatgtttcttcttttctaatatatgcatttagtactatagattaccctctcagttctactttacttgtgtccaacaagtgttgatattttttattgtgattttcattcagttctgtattcttttggttttccctcgagaattcttttttaaatcaagggttatttattttttctgccttcctgtgggtgacttggtcattttttagaattctgttttgatttatctatgtttcttagtatatccctttgtgtagcttttttagtgtttgctctaagtattacattttttgtgcatagccttatcagtctactggtgctaacattctgtcagtccatgtgaaatatagacactatgtcctttcacatccctttgccttcccccatttataatatagttatcttaaatattaccagtaaatatacttagaaccacatcagtgttacaatttttgtttcaacagtaaaacataatttagaaaactcaggaggaaaaggaaagcctattatagatagtcatgttttgcttattgtgttctttcttcctaatgtttcagtgtttcttctattacttctctcatgtttacaggactgcctatagcctttcttttagactagctctgatggcaataaatattctgttttttacttcatctaaagatgtcttcacttgttatttctggaggtctcatcactggctataggatttggggttgacggttcttctcttttagcacctaaaaaatattttgccactttctctggtcatcattgtttctgatgtaaaatatattgtcattctgttttacttctgcagatgagatgccacttttctctggctgctctttagactttctttgccctcagttttcagaaatttaattatgatgtgtcttagcatggacttccatggatttatcatgtttagagttcagtaagctacttaaatctgtacatttatgtttttgccaaatttagaaagttttccgccatttttttgtttgtttgtttttttttttttttagattcttcgttctttcacatgcagagcatcttttttttttaattttattattattatactttcagttttagggtacatgtgcacaacgtgcaggtttgttacatatgtatacacgtgccatgttggtatgctgcacccattaactcgtcatttagcatcaggtatacctcctaatgctatccttcccccctccccccaccccacaacagtccccagtgtgtgatgttccccttcctgtgtccatgtgttctcattgttcagttcccacctatgagtgagaacatgcggtgtttggttttttgtccttgcgatagtctgctgcgaatgatggtttccagtttcatccatgtccctacaaaggacatgaactcatccttttttatggctgcatagtattccatggtgtatatgtgccacattttcttaatccagtctatcgttgttggacatttgggttggttccaagtctttgctattgtgaatagtgccacaattaacatatgtgtgcatgtgtctttatagcagcatgatttatagtcctttgggtatatacccagtaatggggtggctgggtcaaatggtatttctagttctagatacctgaggaatcgccacactgtcttccacaatggttgaactagtttacagtcccaccaacgtgtaaaagtgttcctatttctccacatcctctccagcatctgttgtttcctgactttttaatgatcgccattctaactggtgtgaaatggtatctcattgtggttttgatttgcatttctctgatggccagtgatgatgagcattttttcatgtgtcttttggctgcataaatgtcttcttttgagaagtgtctgttcatatccttcgcccatttgttgatggggttgtttgtttttttcttgtaaatttgtttaagttctttgtagattctggatattagccctttgtcagatgagtaggttgcaaaaattttctcccattctgtaggttgtctgttcactctgatggtagtttcttgtgctgtgcagaagctctttagtttaattagatcccatttgtcaattttggcttttgttgccattgcttttgatgttttagacatgaattccttgcccatgcctatgttcctgaatggtattgcctaggttttcttttagggattttatggttttaggtctaacatttaagtctttaatccatcttgaattaatttttgtataaggtgtaaggaagggatccagtttcagctttctacatatggttagccagttttcccagcaccatttattaaatagggaatcctttccccatttcttgtttttgtcagatttgtcaaagatcagatagttgtagatatgcgtcattatttctgagggctctgttctgttccattgttctatatctctgttttggtaccagtaccatgctgttttgtttactgtagccttgtagtatagtttgaagtcaggtagcgtgatgcctccagctttgttcttttggcttaggattgacttggcgatgtgggctcttttttggttccatatgaactttaaagtagttttttccaattctgtgaaaaaagttattggtagcttgatggggatggcattgaatctataaattaccttgggcagtatggccattttcacgatattggttcttcctacccatgagcatggaatgttcttccatttgtttgtatcctcttttatttcattgagcagtggtttgtagttctccttgaagaggtccttcatatccgttgtaagttggattcctaggtattttattctctttgaagcaattgtgaatgcgagttcactcatgatttggctctctgtttgtctgttattggtgtgtaagaatgcttgtgatttctgcagattgattttgtatcctgagactttgctgaagttgcttatcagcttaaggagattttgggctgagaccatggggttttctagatatacaatcatgtcatctacaaacagggacaatttgacttcctcttttcctaatcggatacctttatttccttctcctgcctgattgccctggccagaacttccaacacattgttgaataggagtggtgagagagggcatccctgtcttgtgccagttttcaaagggaatgcttccagtttttgcccattcagtatgatattggctgtgggtttgtcttagatagctcttattattttgagatacgtcccatcaatacctaatttattgagagtttttagcatgaaggttattgaattttgtcaaaggccttttcttcatctattgagataatcatttggtttttgtctttggttctgtttatatgctggattacatttattgatttgcgtatgttgaaccagccttctatcccagggatgaagcgcacttgatcatgggggataagcttattgatgtgctgctggattcggtttgccagtattttattgaggatttttgcatcaatgttcatcaaggatattggtctaaaattctctttttcagttgggtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggacttttttttcgttggtaagctattgattattgcctcaatttcagagcctgttgtaggtctattcagagattcaacttcttcctgttttagtcttgggaggatgtatgtgtcgaggaatttatccattttctagattttctagtttatttgcatagaggtgtttatagtattctctgatggtagtttgtattctgtgggatcggtggtgatataccctttatcattttttattgcatctatttgattcttctctattttcttctttattagtcttgctagcagtctatcaattttgttgatcttttcagaaaaccagctcctggattcattaattttttgaagggttttttgtgtctctatttccttcagttctgctctaatcttagttatttcttccttctgctagcttttgaatgtgtttgctcttgcttctctagttcttttaattgtgatgttagggtgtcaattttaaatctttcctgctttctcttgtgggcatttagtgctataaatttccctctacacactgctttgaatgtgtcccagagattctgctatgttgtgtctttgttctcattggtttcaaagaacatctttatttctgccttcattttgttatgtacccagtagtcattcaggagcaggttgttcagtttccatgtagttgagcggttttgagtgagtttcttaatcctgagttctagtttgattgcactgcggtctgagagacagtttgttataatttctgttcttttacatttgctgaggagtgctttacttccaactatgtgatcaattttggaataggtgtggtgtggtgctgaaaagaatgtatattccgttgatttggggtggacagttctgtagatgtctattaggtcctcttgatgcagagctgagttcaattcctgggcatccttgttaactttctgtctcattgatctgtctaatgttgacagtggggtgtgaaagtctcccattattattgtgtgggagtctgagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagaccaggattgcaacccctggctttttctgttttccatttgcttggtagatctttctccatccctttattttgagcctatgtgtgtctctgcacatgagatgggttttctgaatacagcacactgatgggtcttgactctttatccaatttgccagtctgtttcttttaattggagcatttagcccatttacattcaaagttaatatcgttatgtgtgaatttgatcctgtcattatgatgtcagctggctattttgctcgttagttgatgcagtttcttcctagcctcgatgttcgttacaatttggcatgtttttgcagtggctgctgccggttgttcctttccatgtttagtgcttccttcaggagctcttttagggcaggcctggtagtgacaaaatctctcagcatttgcttgtttgtaaagttttttatttctccttcacttatgaagcttagtttggctggatatgaaattctgggttgaaaattcttttctttaagaatgttgaattggcccccactctcttctggcttgtagagtttctgccaagagatcagctgttagtctgatgggcttccctttgtgggtaacccgacctttctctctggctgcccttaacgttttttccttcatttcaactttggtgaatctgacaattatgtgtcttggagttgctcttctcgaggagtatctttgtggcggtctctgtatttcctgaatttgaatgttggcctgccttgctaggttggggaagttctcctggataatatcctgcagagtgttttccaacttggttccattctccccatcactttcaggtacaccaatcagacatagatttggtcttttcacatagtcccatatttcttggaggctttgttcgtttctttttattcttttttctctaaacttctcgcttcatttcattcattttatcttccatcgctttcttccagttgatcgcatcggctactgaggcttctgcattcgtcacgtagttcttgtgccatggttttcagctccatcaggtcctttaaggacttctctgcattggttattctagttagccattcatctaattttttttcaaagtctttaacttctttgctattggttagaacttcctcctgtagctcagagtagtttgatcatctgaagccttcttctctcaactcgtcaaagtcattctccatccagctttgttccgttgctggtgaggagctgcgttcctttggaggaggagaggcactctgatttttagagtttccagtttttctgctctgttttttccccatctttgtggttttatctacctttggtctttgatgatggtgacgtacagatgggtttttggtgtggatgtccttcctgtttgttagttttccttctaacagacaggaccctcagctgcaggtctgttggagtttgctagaggtccaccccagaccctgtttgcctgggtatcagcagcggtggctgcagaacagcagatattggtgaactgcaaatgctgctgccgaatcgttcctctggaagttttgtctcagaggagtacccggccgtgtgaggtgtcagtccgcccctactggggggtgcctcccagttaggctactcgggggtcagggacccacttgaggaggcagtctgcccgttctcagatctcaatctgtgtgctgggagaaccactactctcttcaaagctgtcagacagggacatttaagtctgcagaggttactgctgtctttttgtttgtctgtgccctgcctgcagaagtggagcctacagaggcaggcaggcctccttgagctgtggtgggctccacccagtttgagcttccccgctgctttgtttacctaatcaattctcagcaatggcgggcgccccttccccagtctcactgccaccttgcaatttgatctcagactgctgtgctagcaatgagcgagactctatgggcgtaggaccctctgagccatgtgcgggatataatctcctcgtgtgccgtttttcaagcccattgggaaagcgcagtattagggtgggagtgacctgattttccaggtgccatctgtcacccatttctttgactaggaaagggaattccctgaccccttgcacttcccaggtgaggcaatgcctcgccctgctttggctcgcacacgatccgctgcacccactgtcctgcacccactgtctggcacaccccagtgagatgaagccggtacctcagtttgaaatgcagaaatcacccatcttctgcgttgctcacgctgggagctgtagaccggagctgttcctattcggccatcttggctcctcccccacccgccattatttttttggacattgtttcagctctgccgactttctcctctccttctaggattccagtgacacaaatgctaaatgttgtgctccacagatccctaaggctctgttcactttttcctctatttccttctgttattcagtttgcataatttctattatcctgtcttccaattaagtgattcctccctctgttccttctgttctgctgttgagcacaactactgagcttttattttggttattatatttgtcagttcaaaaacttctgtttggttcttctttacatcttctgtttcttttctgagagtttctatttctttgctaagtgtatttttttcattcatttcaagcattttcataattgcttattgaagtatattttcaatcatggctcttttaaattctctgccatttcgatgttggcattttagggtgatctttttacattcccttggatattttccaggttcttgatatgacaagtgattttagattgaaacctggaccttttcttatttttttctgagataatttattttatttaaaccttctatttagacttcctgtaacattgcttcatctggaagtggggacactgccttatatctgctagatggtggtagaaatctaagttcttcacttggcctccattgaaacccagtgagtcggaggctcttctttactgcttgatgggggtgggagttccctgtccccatgtgatgtccactggtgggctggcctcattgctgtttgtcagcagtgaaagtcctgactctgcagtaggcttactctgacacttccccagtggggagggggagggatgccccattactgtccaatgggaggtggaaatccaacctctccacatggtctccactgactccatgtgagtggggcaccttgttaccagccagcagagatgaagtcctggctgtcgacttggtgttctctgataccacccagcaagggtgttgggtgtctcattacaccttcatgagggtacatgtctgggtttcacacccatcctttgctggtgtaggtcaggtggggacacaatttttctgtgatgtttggctggagtatagcagttgtctgaaagttttctatcttgctaaactgctgtttttttttgatcttttgactagagggagcaggcttttgctggggctttttgtttgtttgtttgtactcattggtctatctgggctgttggcctctttgcctccaagtgtgggatatatgaaacaaaaacaactcatcaatatgttgttccttaggtcctggggtccttagccagtctgccttttctcacctttcagagtcttctcttttttaaaatctattttaataggtttctggggaacaggcagtatttggttatgtgaataagttatttaagtggtgacttctgagattttggtgcacccatcacctgagcagtgtaccctatacccaatgtgtagtcttttatttctcacccacctcccaccctttcccctgagtccccaacgtgtgtgtgtgtgtgtgtgtgtgtgtgtgtgtgtacacacattttctttatccactcactgattgatgggtatttgggctggttttgtatttttgcaattgcaaattgtgctgctataaacatgcatgtgcaagtttcttttttgtataatgacttcttttcctctgagtagatacccaggagtggcattgctggatcaaatggtagctctacttttagttcttgaaggaatctccacactgtttttcattgtgggtataccactttacattcccaccaacagtgtaaaatgtttacattctcaccacatccacaccaacattttttttttgaattttttgattatgttcattcttggaggagcgtggtggtattgcattgtggttttaatttgcatttctctgataattaatgatattgagcattctttcataggtttgttggccatttgtcaatcttattttgaaaattgtctattcatgtccttagcccacttttcgatgggattggttgttttgttcttgctgatttgtctggattcctgttgcccaatgtatagattatgaaaattttctcccattttatgggttgtctgtttactctactgattatttcttttgctgtgcaaaaggaagctttttagtttaattaagtcccatctatttatccttctttttgttgcacttacttctgggttcttggtcatgaagtctttgcctaagccaatgtctagaagagtttttccagtgttatcttctagaatttgtatggggtttcaggtcttcagagtcttcttatgtttgttttacatactctttccagaactgttcagctgcccttacagaagaatagggaagagtatgtctatggttagaaattttagataacattagctctctgaccacttttggtgaattttgacttaattttaacataatcttaatgaaaatcaatatagcatgattttagcatggtcttccttaaattactgggattagtttgtatttgtaaggacagaaatcatcctattttaaattagggaggtatactatttattactattattcatcaagtaatcattatttaacagaagaattaagttgtaattatgatgtacaggaaaaataagtgcattaaagcatacttcaaagacttacaattttagttctttttatatgccctttatactattgggtttttataatgaagttatagataacaaaattatatagccataaaatctaaaatgcttttcaaaatgaaattatttttctcaatggccatacattgaaaaaatccatagcttttttttgaaattaaaaaaacgttttcattaatacaatgaatatttagtaaaaacatactgtgggcgagacattgtgctagaaatataatgatgagcaaaacatacataggtcctgccttaatcagacttaaagtgttcttctacagtaaaatatcaaaataatgaaatgaaatcttctaggaaagtattttatatgtttttatgaatagtgctgctctggaaaattagaatattatctttcgagtgtattactccactactagatgcagaaaaattgacgtcttaagcagtggtatttattactaatgtttattgaaaataaattgaaaacaaaaattatatgatgaaatgtttcattggctatataatgggctatttccatcatttctgaaatatctcttggatttttagtattggtttagagtataaaagacagtgatggccaatgttggccgtggctattaatggtttatattagttgaaagctgtagaatcatccaagaactctattagcattagagtaacaatttaccaagacaattaccacatactggaaatttttgcagctctaattcagtattattaataatggataaaattgcatttttctcaggttgctgtgggcagcggggaattatttcaatgaatatttcagcacattattttaatcatttttccaccaaatccaagtgggcaatattttatacttcttaattcagcctactaagaaaccatggtcattaaattgtaaactatttgtagtgaggtctattccgtgatttacaacccttgttaaaaacagtgtaaaagaaagcaaactgtaccattactacggtgtaatttgatgttgcctttgttactaaactccacatgattaatgcttttagtagaaagaagaaagttttaaaaaataaaaagcagagctgagtggtataatacctgaaatatgagaatgttattattttaagtctttttcacttgtagaggaaatatatatatatatgtatatatatacacaaatacaagtgtaaaatataagtatctccaaaattatcttaatttttcaatgagaccaacaaaataacttcaattttatagaaaaatgtatttccagctatgcattgttattaatagggattactttttttccctctactcttagccaattgcatgatttctggcgtttggattactgggaagatgatcttcgtcgaaggagacgatttgttcgcaatgcatttggctccactcatgctgaagcattgctgaaagctgcaatagaatatggttagtaccaatgcttcttccacaaaaatacttctggatgtgaggtgactccttgtgtttgagaattccttctttttttttcgctagtatttaatgttctccatgtcttgagtcagaaatattttgttctgctttatccttcagcatcatttaggttactgttaatcaacccaatatttctcagattagatatatttttgtagccttcaacttatttttaagagctaaatggacttcacatagttagttattaactaacagtcctttcatatatcctaacacaagaataaaatcaatttctttctcggtgtctttcaaactttgatgaccaagacccatagtaaatactgtgatcctgtactcagacttagatattttatgtataaatttgtttctgtgtacatacttatatatactgcattaatatacatatacacatgtaatatatatacatatgtatactgtgagtatatgtttatgtatgcatatacatattgtatatattaaaaaagttttatttataacctctttatatgatattttgttttaatcccacctattcctttcagcttaataaaatagaatttaaaatcttgttataagctgccaatttaaatttccagtcctccaatgcactacaaatgaagtttgaaaaagatggtctcctacttacagtatcattaattatcacactacagtagaactataccctaaattgttctttataaactgtacaatcacaaataccaaaatatttttgtagtttaataaaaatgctgctactttagattgttttctgctaagaagtatcttaggaacatttggtctacttgcccatttttaaatgctgtaacaagttaaagtgtgatggggtatatcagaattttacaaaccacattcactaaggaaataccagtaatgaacactgtccatgtgtttgttatccacttttgttcttcaattacttgtattttattatattaattttcttttatttgggagtactaagtgagccatctgtttttaaaatttaaaaacagttgataaatagtattatatcaaatcatagtttatgtcatgtaaaaccattcatgttcttaatgaattgaacagggaagtaataaaaagacaaaatgtgtaaagcttttaaaatttcttttcccagtaagctatgaattgctataacttaataagcatcaaaatatcattaaaaatagataaggatttcatatgaaactgttatacctaagataaaagttatacagtaactttatatagtaaaagtaactatggaaaaaatatgctggaaaaaaattatagtttgtcttctttgaataactaaaaatagcacctaaggataatagccctctaaggatttgataccaactcaaaatgagttatcattatgatcttgtaggagagaatcttagaaatatctgcctacctagtagtggcatgctttataatatgatcttaaaattattaaaccttcatttcatttaaccaataatttagactttttcaccaattaatcctgaatttatctcatttgaaagtggaaacatataaagacaatttgtaacagagtttatactacagtgatatcattagtaatactgagttgccaaagctttaattgtacagaattcatattatattacattccacaatctacagattacttttaagcaaggctttttttagaaaaatgtttgtatttcttcttaaaagtgaatactttgtgtgtttaatttgtaaaataatttctaataaaccagtgtcaaagcctataagaaacaaaatttaaaatctttgaataaaatctttttcaaactgatagtcatattttaataaaatagtaactattgttaatgaacctaaagtaaaaaataataccgtaattttgaaataggtaagaggtgtgatactaaatattctttatatgtactatattttaaaatacagtatttatgaattttcaatctggatcataagcaacgttcagaacccattatctatccctcttgagttgtgttctgttataaaagaaaagaggagtatgtttttattatacctattaagaacaaagatgacacatctacacagtaaaatattcagggaatcgacatggtactattggagttactccatggtcattctaaggtcagggagtggaagactaaagagaactaaaacaattttatctccaaaaacaattatcctctaaccttcctcacagttcacaagtctatggactttaggactgagtggagagttgggagtaaatacagaggatgtagagaaggtgagtgggaagctctccctggagtgatctatacgtagaagtagagggaagaatcacaaattgacgagagaaatttagtattgtgccttcttcctacctcttaatgtgcactctaacctatatagaaaatatctcttcagaagaaataggaagtacatgtcaataattattacaaagcacttaatccagtaaatgttgaaaaacttaattcaaaacagattttgtactgccaaggacccaaaagataaggaaagactgagaaaatattccaaactggagaagaccaaaaaagataagatagattattacagcacatttgtttgtttgtttttgtttgtttgtttgttgtgacggaatttcactcttgttgcccaggctggagtgcaatggcgcgatctcagctcacttcaaccttcacctcctgggttcaagcgattcttctgctgggattacaggcgcctgccaccacacccggctaactcttttgaatttttagtagagacagggtttcactgtgttggccaggctggtctcgaactcctgacctcaggtgatccacccacctcggtctcccaaagtgctgggattacaggcgtgagccactgcgctcggccttacagcacatttttctagatgattgcagttggtaaaatttgactggggtccatgatctggatggcagtattgttatcaatgctaacttccagagttggagggttgatggtacttagacaggaatgttcttgttttgagaaatacaacggagtagttaggggtaatagggtgccatacctgcaacttctcaaaaagttttcaaaagattagtgataatggatatgtgcaggagtggggtggggggggcgtgtagatgtttgttaatattgggaaaacctggataaggataaaaatgggagttttgtactatatttgaaatgtttctgttagtttgaaattatttcagatattgtttaaattttatccctgcaagttgaattaaaagaaaaagcaatttaaaaaagtatagaataaatcatttatccactgtaaatgagcttagaaacctttttcttgtaatattaggtattagtgggtttgcagtaaaaaataaaaagaatctcatatacgttgctgaaacaatgtaaatgaggattgctggaaacaaatcctttgcaaaacattttgccaatgcacatcaagagtctcaaaaatgctgataatctttgacccaacaattccctatctaggaacttgacccaaggaaatgacttaaaagacaggggaaaaaaagctatttcaaattattcgccacagttttctttggaaaatctgaaaagcaatataatattgtgggaagactggtttcaaaaaaaaaaagaatggactcaaaaaaaagaaaacagatttcatatttttaaagaaagattttgtatatacaaattgccaggacgtccatgtaaaagttaaaaaaaaatagcctgacgtctgaatattccatctgccgttaaacatttaaatgtgtttaagtattttgaagtctggcattgtatagactaacatccaaatgacttaatgttttggagttgtatagatgtagattaagagtatattgatagcacaaacctgcaaattctgactaaactactagaataaattgaaattcaactgatctcttcctctgtgttaaataatgacactatttcaatttccctgttgttaaattctactgtgaaggccgggcgcagtggctcacgcctgtaatcccagcactttgggaggctgaggcgggtggatcacgaggtcaggagatcaagaccatcctggctaacatggtgaaaccctgtctctactaaaaatacaaaaaattagccaggcatggtggcgggcacctgtagtcccagctactcgggaggctgaggcaggagaatggcatgagcccgggagacggagcttgcagtgagcctagatcgcgccaatgcactccagcctgggcgacagggagactccgtctcaaaaaaaaaaaaaaaaaaaatctgctttgaaagttaagtgctaactgtgtagaatttctgctgaaaactttggtcaaaaaattttatattgatccacatggtagcaacaaaaaagattttaggtacaaaagaacattttatagatggaactttcagaatgtctagaagtatttgaattagttatcaaagttttcagaattttcaacatgttgtctacactgggagaacaagcttaaattacttagaaagaaaatttttacatgaccatcaaagcaatccctgggatttgaaccattgatttcgtcttatctattaatgtagtaagtatactgtagttcaagaatataagcctttattagtgtaatagaagtgaaactgattttgcagacttcatgttttaataaaaatatcttgagtcatttgattttttctaatatcctaaattcaactaaacattttaaattacagttgcattttcatgtgatgggaaggaacatttagccatcatttggatttcatgacattattttcaggcaatttatttggtgcctcaaatatattaataatatattggcaatgctttcttttaaatgagcaaacaatcagaattggatataatttcaaggaaataaaggaaaataattttatttcatatttactttgaaaagctttcccttcaatttcattattaaaacttggttgacctttttcagttggaaaatatcctttatactgatggagtttttcatgcttttttagtaatactaatgagttgaataatttatgaggttgtcatgtgcaaaagattttgtgtgatttgatatactttcagcctctggtgttggaatgtgattaatgaaaacctagaggcaggtaattttttccctgctggttagtgttctaattttgcgtgtatttaatgtgttatttaggtgttttctaatagtaaaatctcatacaagtgaaaatttaattgattaccatgaattttatggaccatagcaatggaacagtataaggaaaatattttaaaactcataaactcaccttctgatctgcagaattctttttcttttgagcaaatgagctaatagggaaatgattgaaaaaggagggttttgtatattgtttatatattaaaataaaacctagactagtcaaattctggtgcatttctagcatgtcaatattgtagttgtcgaagaatggtacaaaatcttaagtttgattgtctttgttgactgtcaattattatttaggcctctgttgccctttcataaaattacagtggaacaatgtttcatcaaaacctaagactgcaagcacctccatgtctgtgatcaaagacagcatcttaaataggtctgatcaggcatcgtagaagagagcagactgcttcagcctgaggaaaaaaaaaacatggagcaaaaatgacaaagttaatcagtcatttctttggcaataaataataagatatgctgagaactgcaaatgagaacattcttatgttcctcagagatgtgtctgcttaacacctgatttatctaagcttgtgaagccatcaagttatgaccttgatgaataaaaagcagctctgtaatgaatctggaattaaattagttttgatggtatatgcatggctactgtaatgtgctattttcagccatcaagaataagaaaggcagtgagaatagaaaaatactaagacagctatacaattgttgagaaagaagctatcaagtaatctgacttcatttttcaagactttatagttcttacaacatgtgagagagatgacttgattttgtaaaacctaataacctattggttgtattatgtagagactctagtaaacatcttcattattgttcattgataactccattttagttggtgtattattaattggatctccttatttgaaatgaaataggtaatctggttatggtttaaataatttattgaaagttaatgatgtaaatttttagaaagagagagagaaagacatgcaggaagtgtctgtcagctctttttggtgtcagtgtcatattttagtatcatagccttgtcttcaccctatggtttttacagtctcttaaaataatttcaatgggttatataaaggctaagttacaaaatattcttataaaatacatttgacagatattatgtagcattttcatattaataaatgttctaagaggccacttagttttctgttgaaggttcagattgtagattttaaacagactcagaggacttgtgtaactttattaatttaaaagcagttattgaataacttctacatactatgcacgtgctacctgctggatttggagactgagacaatcagtttcttccatctaacagcacatagtttactgtagtgattcccaacaggggcaggggtaggagtgcactgctggcatctaattggtagaaaccaggaatgctgcctaaaatatcctaccacatacaggagagctccccacaacaatgacaacagcaaaattccagcacgaaatatcaatagtaccgaagtttgaataaccctagtccagtggaaaggaataaagaaaataaacagttatcatagagggatgtagtagttcctaaaggggcacagggagagacagtgacttactgagtctggttggagtaggcttcgtacaagtaaaggcttatgaattgtctcaagacttgattatgaatttgccaggttatcggggagtaaaggcagaggtcataacagaaattaccatggcatggagacataaacgacccttactcctttgaatggccttaatatttggcatttgatgacaagtcacttcataaaggtttcagaaggtatttttattttagatgtctcatattcctagataaaacaaaaaccatttgaggataagatatatctaatgtaaatggcaagttaatgggtgcagcacaccaacatggcacatgtatacatatgtaacaaacctgcacgttgtgcacatgtatcctagaacttaaagtataataaaaaataaataaataattgaatttgcattttagaaaaaaaaagaatcagatcttctatcagttctatttggaacattcacattaatacaattctttgtgcttattactcagttgctatttttttatttaatttatacttgattgattttttttgtttttgtttttgagacggagtttcactcttgttgcccaggctggagtgcaatggtgcgatcttggctcactgcaaccgccacctcccaggttcaagcgattctcccacctcagcctcctgagtagctgagattacaggcatgcgccaccacgcgcagctaatttttgtatttttagtagagacagggtttcaccatgttggccaggctggtctcgaactcttgaccttaggtgatccacccgtcttggcctcccaaagtgctggggttacaggcatgagctaccatgcccagcccgataactgattaattttaaggtatacaaacagattttaaccacaccattcatcactttgggtaacaacattgaaggatggattttctataaactaggtctagaaggatggtatttccaaatcatttctgactgtcatggaactaatttagatcattgttcagaatcttgcttcttttagactaatttttggtaaagtgtacacacaatcacatttacaagtgattataatatacaattgtaatattttcatcaaagtatattaaaaatgttatgggagctcagtaaagagggtcgcctaactgaagaaatatattttagctggagtcgaaaggatgaatggaagtcttcccaagccaatgagtgggagagtggcattgtggaaaaagggagcacataatacaacataatgtattcaaggaatggaaaatggtactaaatgatggaacacaggatagtgtggggaaatggtatgaagatgaggctgaaacacagttgtggccctgctgtgaaggggattgtcgttaaacaatttttatttggaaaatgacaaaccatagaaattaggggacatgctaaataataagtgatagatagagctaaaactcaacccaaataccagtctcttactctacagtgtgttgtagtaaatacatttggaatttccttaactatgagggcattaccgaacatttccctgctgtaaagtttacctgctaatatttggttggcgcttacagcctatcgtctgtaaagatacatcagaacagatgaacttagtatcattcccaggatatgtattctatgccatttagaaaaacatttttaaatgttttggtgttttaaaaagtgcttttagataatctgtatcagcaccatcacttatgtatttcattttttaataattaaagagacttttaaaattttctcttccttccatgtctctgggccaattgtttgcctgtctcaaaaatctcctacccccattttccatcatctcacacttttaaagtgaattgtccacattggactttgtgatatacttaaaagaagacaccaagcctctcatggaaaaccagcccatatttattgtctccatttattttccttaaattgtctgtacaaacatgattttctccctcacatttttaaaattcttactataaattctccattgaaaattctaatctatagtaatctgatttctggttgttaatgctgtgtagagcaaaaccaccattcatttttggcataatgtaattaaaatacaatataaatgctaacttgcatgacctatcaaagcctatatgtttgggatatgccatatcccaaatgaaggccatgttgtcattaatgccaccttaattctttgacttcttgctggttccttcccctaccttcatgacccaggccaccttcacaaaaattgctgctccatcagtgatcaattagggaattgtcaggtttataaatttactaaatgtgccatggggataccaaaatcactaaatgattggattgagatcaaaaactgagaatattgtcttagtgcatatgctatctgcaagatggaaaaataaacttgtctcctatttgaaaatacatggaatggaaaaaggttaaaactctagtaaacaaggaatgctagatgtgaaaaaaaaaaaaaaaagaagacactgaggtaatgtcacttactgtgcaagaaagtctccccaccctgtcagcccactctcaagttgtccagttaatcttttttttcattctaatagttgccaaactttctaattcacattctgctgctcactagccatctacccgtattggtacatgatgcaggttcctttcctttgtgcctccctccctgcctccctcctttccttgctttctttcagaaaaacatatgctcattataggaaataccaacaaaagtgccaaaaaaatttgaagaagtcatccacataaagataactgtctttatcattttcatgtatttatttcatgttagtctttttctgtgtgtattttatcatagggaccaaacgctatgcaatgtactcatatagtcacaaagatgaatagtgcatcatctctgctctttatgatatttagagagttccaaaaagacgcaagttttctatatgttttattacgtttttttacaagtaaaatgtgccctgcgatttttagtataatgaaatctcattttaaataattaaaaatcttaacttcatggctaatcaaaatcctgtcgagtaatatcccgtctaaaatgtggagagagtctgcgtttaccgtcacgtatattcttaaaatatggtttatcaaattttctttagaaagcatagaaggcagttttctacgttgactccattaagaagattattaagttaacatttcatacttatatagtgcttcacttaaattcaataatattttcttgcacttttttaattgcatttctctgtttaaaaatactgtttatgaatttcccgtttgttggtctgctctaaaaaatattgcttacctatgaatattttgaattaggaataaatgaaattccgtttttgctgtcagaaccaaattgtaaaaatgaattgcatgactttgaaaatcagtatactctattagcaggcctgtcaatataaaaagtgcattccatttccacctcttgctctaataaccttttctctgttactctgaggcagttcacataatcagagtatattgtcagcttactggagttggggaagcatgaaatgaaaatcacgttagtattgatccaattcttttgcttgcaagtatccttgatgtccttttccagtgagcaataactgttggtgttaggtagccattttcttctcttctttcttaaattccaatcaattgtttacaagcataactaatctgaataaaaatttaacacttggaataatttccatgtgttaattcccagattgctaatgctgcacatttactataccactgaactgttttcccccagcttttcaaaacacagcctacctaaagacgtaatatttatatgtagtttaaaacaaaagtctgtacaagttcctttttggtaaaattacgtaagatgctgtactctgacttttatgtaatatagtcatgtgctaaaatggaccataagtgccatgaattactgatccacgtaaggaatagcatttttgaaccaagtttattataaatttgaagctggtgtcttgggtttttaattttatagtggtatagataatatctattttggattattcaatatattctctgtcaacaaaattaaattgaagtgggaatcatggttagatccaactcattcaaactaaaatatccacaactaagaaaggaggaattggatggttgaactatccagactttatatctgtatttattaaatttgcttagtaaatactcagatttttacctaaaatgtatttggaacaacaaatagaaagtctatttcatgtgtagaaatacttgctttcataaaataattttatattgataaagtgaggcttctgactcagtatcaggtataaaagattgagaaaatgcttgagatttctggtcattctttctaatttagtgtttttattcagtatcactaacagttttgccattgggatttttctattgaaagacctgttttcttctcctttttaaaaaaatgctattttataaagaagatgatttaattttttgtcattaatcttcgttagaaaagtgatctttcctattatcgtaatttgtttcttaaggaaggacgcacttaataaagtcaaacacaaaattaaaattggaatttagatgatttacaaagaaaaatatttacttattaggaaatgattgttacagtagactgttctagtgtgtatctattacttttatctcacagatacactaaggtaagcataaaatgttttcgaacaataggttcctcagtataagaaaaagcattctttcaggtttttttgaaatgttcaaaattgtaaacttcccagtaatagattgattcatacatattattgcacaagattgtgtcatcatatctattgtaattttctgagaggtatatttatcttaaatctttttccttttagtggaaattaaacagcaccatttagagttactaaaagcactggtctgaaaaggtatttgttgctcagacttaagttttaatgagaaaaagtaatctttaaaatttctcaaagtattcatgtaattaatgcactttaaaaagtatttaggtttggaaatgaattgcaacattttattctactaaaagagtggtagacttcgtcaaaatacattgaacaagctaaaaaaatattgagaaatggcgtataatgaaaagaatttcttctttgaaaaagaatgccatcctgttcaacagattcctgaatgtttagaaacagaattacctgataatacatttaggtaaaaataaaattagaccagatttctattctgccagtgtcctcccaaagatctttttccaaagatgaaaagaagcctatattaaatgcattatctcttcttgagaaagcagttcttttccttcaaatatccaagatactaaacatatttatataattaaatatctgtatgcaaaatcagaagtacatgtcaaatacattggtgctttatgtaattttatttaatatctttaaatgaataaaatagttatggaaaacctacattacatttaaaatgtaagctatttatactacattcaatttccaaagtacttcctaacacctgtacttcatgctatcattcctgtcttcagggagcatccaatctagtggaggagctgaaggctcattcacattttaatgaatacgaacactgttataacagcatggtggaaggaagaatagtaactccaactgaaggaaaggaaactatcacttgttgaatacctgatgttggataggcattgtgccaagaccatagactcatgctttatcttgagttttttaatcctcagataagccagctttttttccccctctttacgtaaatcttatgcaacactattataagcaataaagcattaactatgttctttttcagttttaattatgtattcagtatactttttatcctcttgttttatttattttatcaaaattttaataaacatttttgaaagcttactatgtaaataatctccacacatttccattgtctcattttaactttgcaataatcctgtgaaagaaaatgtggaaaatacttaatattactcttctacaaatttggaaactgaaattaagagattggtctgaatttttttaatgtttctaatggatattagtggggaacaataacttatgaatggcaaatcaaatagtccaactctcccacttatgaggaaactgtaaagtacatgaaaagtaacttaactaatgtgcatgtaaaatgactaatatgtgaagtgtgtttatgtgttttcatttactcaacaaacatttgttaccattttgacatgtgaaattaaagtccagtagagaatccctaaaataaaaacactccaaaattgaacaatgataagatatgatgacttaattctaagatataaatgtttatatatatatatatatatatatatatatatatatgtatatatatatattatatttgaagttctagggtacatgtgcacagcgtgcaggtttgttacatatgtatacatgtgccatgttggtgtgctgcacccattaactggtcatttacattaggtatatctcctaatgctatccctcccccctctccccaccccacaacaggccccagtgtgtgatgttccccttcctgtgtccaagtgttctcattgttcaattcccacctatgagtgagaacatgtggtgtttggttttttgtccttacgatagtttgctgagaatgatggtttccggcttcatccatgtccctacaaaggacatgaactcatccttttttatggctgcatagtattccatggtgtatatgtgccacattttcttaatccagtctatcattgatggacatttgggttggttccaagtctttgctattgtgtatagtgccacaataaacatacgtgtgcatgtgtctttatagcagcatgatttataatcctttgggtatatacccagtaatgggatggctgggtcaaatggtatttctagttctagatccctgaggaattgcctcactgtcttccacaatggttgaactagtttacagtcccaccaacagtgtaaaagtgttcctatttctccacatcctctccagcacctgttgtttctaagatataaatgttatacagagatggaaataatcaacctgactgaatcctgaaggaataggcatgtaagagattttatgtaaaagaaattacataggtcggacttaaagatttgagacaatgtggcatgtatgcagacaaaaacattcagcttttagagaatatgaggtgcaaagaggccaaatcagtaaaatagtgaggttaaataagcagaagctagatcatgagctttaaaccatatgtttaaatggtacaaataaaataacattgaaaatgtattattccattgttgatatacattagatagatacacatatatacctatatatctatataaatatacctatatatataacttttcaataaatgaaaaccccattgttccacagtcaatataaataataatagcataagctggtgaaaagctgagtctacattaaaactggcttattatgtggttatatctcttttctttgtgtgttagccacacatatgatttatagctaacctattgttgtgaattacttttttctttattagtatagatgttttagagttgattataggaggatttcttaaacagaaataaaatactgtatttttcttacattaattgtttatatttatcaatagaaaagaacataaagggcacatgaactaatttctttgccttgatcctgtggccattccaggtagacatattctttgatgtcgttaggaggagttcatgtctccagtttgtcatttctgtgttttaacttatgcttatttaaaataacaacaaaactttaaaatggaaatttaaactatatcaataagagtaacaataatactggaatatagtaacaatactagaaacattttagttctgctgttacttcacctttaaaatataccttttttcacatggattcttggttattaatagaaattttatgaaaaaggaactttagatttctgcaatgcaatattctgtattacataacattttcatatacagagctttatatatatatatatttactaagaagtcagtctatggagtgctttcatgggttatttctcacatgatgtagaaaataacataagtgcggttttggatttagcttccttgagctataattcagtggcattttttctcctgaaacttttaaattttgtggtattttaatgttttcataggcaatagcatatatgtctatcctacccagctttacacataatatacattttcagatccaaggcgttctggtagtttgtggtattcgcttgttaatttcttgatgaatggctaaagaggccaaaaagtgcactcagtccaacatgtcttctgaagatagatgatctcaaataaattctcttcccaatcagattttgatttgttgggtgttaaaccaattctttctaaggacagtgtttacaagccttgtaatgagacagccctttgagaccttccctctttttgcctgtaattttgatgaatgaaactctaattcataaaggatattgtgattgaaaagcacctttagatctcatacactttaatttagataaatgtttggtgcagtaccatgaaatcaggaagtttgctgagctgcaaactgataacacttcaacaaggatgataagcttagtgtgttgatatggattagtttactatatatcttttaaagtcatgattgttttactgctttaaaaccagaggggataaaattgaaagcttgatatacatttcagagctcacctttcttctactacattttcttctttggtaaatttttattttggtaatacaaaagtaacataaagcttttttactgacaaagattacccatgatttttatataaggaaaaacttgctttattagattactcacacttaaaggcttttttgactttattgtaaaaaaccaagttacttttcatgtaaatacatatattctccggcttgccccaaactaaaggcaaatcactgagattctgagataccctgggaacttcagactttgaaatatgcaggggtaactgtaatgtctgagtttatacatttattcaggatttatgagggcttgctctgtgctaggcagtgtgctaagtactgagaataccaagacaaaaacatgtttccagtcatgaaggaacttggaggcttttgtggagttaaataagcaagcagttacaatatctataaattatgcagtagcagggtttacgaggtatggtggaagcataagggaaagagtacacaagtgctcttaagaaatcagagaagggaatggggtggtggggtgaacttgaacttcagttcagcacatgtttgtggcagaactgctgggcaccaggcactgaagctacagaaatgggactgaggacagacacatagtaggtaacacctatacagtgcagttgaattatgtgtaagctgttaacgtgcagtagggtttgttaggaaaggcaactgaaggaagtgagtttttaagggcaagtagcaattagccaggccaaggaggaaaggtaggaacataccctgcagagggaataacattagcatgggtaaagaggtatgtgaaagcatgacatattttggaagctataagtggtccaatattgctgaggaaggtgtggtgaaaacacagaactggtaatgagaggataaaaggccttggtaagccatgctaagaagtttggattttatcctccagtctaagtcttgcattaggtgttcttgactgggaggagttaatgaataattttaataggaaaatgtcctcaatttatttgtgttttataaaaatcactctgacaaaagtatggaaggcggtgtgagtcaggcagctgttgacaccctctagaccaaaaacagtgatggcctgaactagggcagtggcagtcaccatgcaggatgaattcctaggtttctgctaaagtacatggttggccaaaataggaggaggagaaggagcaagagacaattagctcagtaagagaaatgttcagttaatagtattcaggcaaagtccagaaatatagctgagaagacctcaggagagatttctgaattattaatcattgggtttccctcttttgttctcaaatgatgcaagctctatatttctgtttgccaagaagcaaacaagttataaagatagctaccctcagaagattactcttgggctggctttatatcaccaaaaatcaaatagaattaagataaggttctgaagcattcagtgatctatccctaatcttttattccagaaataataattatctatgggccagtggaagaaaaatacacatggaacccatttaattcccctcccctccaatgtagcattgatttgtcataatactatttgtctctgaagtatttatcaaaatatatgtctaacaatctatttatacatttaaggtacgcattaaccatgtgctctaaatgtggttatgtagtaggagctaggatgacagactatacctcttagccagtgatactctgtaatggtattgtgatgtgactatgttcctcaacatgtgtttttactctggcagccttttgagtccattttttcatattttagcaaacagaattagcctatattcactgagaaaaagaagtatacaaactgcaaagagaaaaaggaaaaaagccaactattttacaatgcaagttgtatgacagccagatgtacttgcaagaaaatggttgaggctgggcacagtggctcatgcgtataatcccagcactttggaaggccaaggtgggaggatcgcttgagctcaggagttcaagcccagcctgagaatatagtaagagcccatccctacaaaaaaaaaaaaataacaataaaaaaaatagccaggcattgtggtatacatctgtggtcccacctactcaggaagctgaggcagaatgattgcttgagcctgggaggtcgatgctgcagtgagctgtgatcatgccactgtactccagcctgggtgacagaatgagaccctgtctcaaacaacaacaacaaaatggttgagcaaacatcaataggcagtaatggactgttggaagttctatggtctgggcctgggtgaattgaccaaaagtattgtacactttcgaccaaaggcatgacatcatttggagagccattgtttatggtccgacaccataatgtcccctaaaaatataatacaacaccatataggactgatttataaggctcccatttccaggaatatatccaccaccccaaatgagatatgaagacattttcctagttaatgctgctccttgaaggctatatcctaatacagaacacagtatatgacaatgctttcttctaaattgaatttcagcttcaagtgatatagaagtatttcatgtctgtggtgtttgtgtgggtgtaggtggtgtatgcatgtataaaatttgctttcagttcagataattttatattaattgacacctgccaaagcagatgtttgaatgtaaatatgaaaacatttattaagcagtcaaattcttgagggattcagatgcattcgtttctaacttaacgcattaatgccaggtcaaatcttgcaatatttccagtatttcagtttttctgcttattttcatgtgttttggttttggctttttgtgtttttgtttgtttgtttgttgagagggagtctcactctgtcgcccaggctggagtgcagtggcgcgatctcggctcactgcaagctccgcctcccgggttcacgccattctcctgcctgggcctcccgggtagctgggaccacaggcttttggctccacgcccgtctaattttttgcgtttttagtagagacggggtttcaccgtgttaaccaggatggtctcatctcctgacctcgtgatccgcccacctcggcctcccaaagtgctgggattacaggcgtgagccactgcgcccaaccagctttttgtgttattatatatagcaaaataaggctatcatttcagaaaaaccagtatttatttcactaattgctaaagaaatagctattgtgaagaagcttttatgtctccatcatttctaactccgcctttctgtaactttccaatgatcatttttcccctcacatgtgaatggtttctcgtttgctgcatacttatccactttcaaaaatgatcttctaattagctaattagcaattgattagctaattaagacaaagtataattatgtaaaatagtgtgattttaagaaaataagtttggggtgaagtacagactttttgtgcaacatgcactgatcttagagccctaagacatggatcttcgagtccttagacatggtagagttcgtttctctaccactagcaactgctaggttcctccaaaatgcatgtagcttcctctgcctgtttcctcatctttaaaataagggtagatcattacagctccgcacaccccatgtttctcacagaaaaccaaacaagataaagaaggttaaaatgttctgtaattgtaaagtaatatgtaaatgcagcatataatttaataaagcaatcaattatttataatacctactataagcagaaacaatcataataacctaaatgattatatttttgttgtgattaggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggtaaattttaaaatatatttttcctatttgttgtaaataaacacaaagctactgaattcaaaatctgtctcctagtaaataaatgtgtgccaatggttgtaacaatgctcaatcacatgaatgttaaaactctactttatctcatttctaatattgaagagagaaccccaaagaaatgtgtattttattggcaataaatgaatatcatcaaatttctaggtaatgaagagcaattttttatatagaaggaataatacacagtatcagttattcacatcttacggcctatattataattgggaggtgggacagaatgacagtttcattgatttacgtgtatctccaacatgctaagagccaaggtccttttcccaggtgccaattgaatttgccatttcctcccatttgtcactctaaagaatgtctctctccactcctgttttgttctgtagcctcatattgctaagccactagcagatattctttcccctaccacctcagttttaccttgtcatgatatatgtctgagatcaattctggatgtgattctacagtgagcagatggggtatagatatcttagtgtattcacccacaaccttttttgggttttaagccactttgagaatctgatgaaagcaaatggcttcatgaagaggcacatacaattctgtacacaatgtcatagtggtcactgacctccagaaaccagtccatggaatcatatcctcaacctcaccttaaaaatgcctgcttcagagtctcaaaaagtagctgagtcttagttctatacttgcagcccacacaaggttgaggtggcaggtggcaatagagaggtggacttatatttataattcttgatacaacataacacttgttgcaaggaacatactgaaaattatctggcatggctttatgaaagtctctagtgatttctttctactggttagagagttctcttttcatcttcaaagagatgttactgttaattataaactggagatagcacattattctcccttttctagattaagaaagaaaatatttaataagtttattctaatgctagttcctagatatttctatattattcacatttctgtattataaaaactattttttcgatttaaatgtactcttaagtctgtgaccaaatgtttgcctcaaattcttaagtaaatgttcaagttttgctttcgttgtttttgtggtttgttttagtagctcagagattttatatgaggccatttggaaatttaagctaatgaaggtcattgattctgtttgcccacagatgtgttttcttttctgctggtctcattcttcatcttaaagaatacagaaaattcacaaatgttatttctgacccttttagattatgtgttgtctttcctattcatatatgctagcagagatgtttaataattgtacagttcaaattagactccctggtcctttgttcctactgaagataattaattagttagtatagatttgcatagtcccttaaagtttattataagactgcccagtaatgccagtggcacaattcaacaaagactaataacctttttatatttctcttctttaatggtagctaattattaatattaatttatttttataagaaaacatcccccaaaaaagttaagttcaaacacctaaagaacagtgaaaatatgcttgaaataaactttttaaaatcaaattatatggctcctgaccaattcactgaatcaagactcctctaatttctgtcttttaatggatttgtcattgagcatacctgttcctatccataatatacctggtcctaactcatactcttctagcgggatccttgtgtgttacagctgtcctaaagtattgatcctctgcctactctgtagagttcattttaaaaacagcagtctacaaatatactctgaaccttgaatacagtggaaaagaagtaagggatgggtgttttatgaagggccacagaaatatgctgcataggttataagaatagatttattttgtaaatgctgaagcctattaatctagactaacataatagttacaatgttacataaaattcatttttagaactttgttacaagccagaattcttaggtttaagaaatcagctattggttaaagatgcagattacatcaatacgtaactgtttttgccctaagcaattattgtccaaatcatggttatctctgttgcagaaattaaaatttgtttaataataatgtctgtcttactcataacatgtcattctaagtagcctgacagagctgtactgcctaaagaaaatgtcacccttacaggagacttaaattcaaattaaaacccaggccaggagtggttgctcacacctgtaatcccatcactttgggaggccgaggtaggcagatcacaaggtcaggagatgaagaccatcctggctaacatggtgaaaccccgtctctactaaaaatacaaaaaattagccaggcatggtggcgggcacctgtagtcccagctactcgggaggctgaggcaggagaatggcatgaacccgggaggcagagctcgcagtgagccaagatcgcaccactgcactccagcctgggcgacagaatgagactccgtctcaacaaaataaataaaaaataaataaaaataaaaaataaaaaaacaggaaatcctaaaatcggtgtacaatattaatataatcttatatttatttgctatctcagaaatattatataaagtaaaaagtgcctatttcaatctctgagataaaaatcacaggtttatcttttcatgacaacttaatgaaatggcttgcatattattagtatgagaaatgtactttcaaatatataaaagtaattagagttcttagattttagaatatatatgaaagaatacatcatttttataattgtaaaggtaaacctaaacctgctgattagcatactacattttcctgttatttacaaaaccccgttttgctgacataggcatagagataagcagatatgcagtataatttgccaatatgtaataagttaaattcaaatagaagaaagtatgctaattagtacagaaaacttagagaaagtactaatttagttaagattaattctgttcttattttaattcaaaagatagatcaatttctgtttataaaaaaaaaaaaaagaagaagagaaagaagaatatctggcatgaagtactaggagccagacatcaaaaccagcttttttcgacatataaatgatgctgctattatagatttaacattttctgtaaaaggaaaatctgtattttctgcctgttgagaactgtttaatagcagttactcttcagtacatttacattttcatgtttttaaaactattttccttatagctgaaaatattgacaaatggatatggtgagcttctctaaataaaaaagagttcggcttagggttagggttagtgttcagacagctttgtgtgcagtaacccatttaatctaaacaacaacccaataaggtaaaaattattaccaccaattttggaaataaagataaagaggtcaagagattaagtaacttgcctaaggttaagaagtaggcaaaataatatatttccttgcaaatacatagtatatggtttgaactaaaatataccaaatagtacatttaaatgtgtgtatgtgagtgtgtttgtaggtatatatcattaaagactcttctaaaatgatgtgaaaatgacatcttctgtttataactcaatttttacactggttccattacattagaagtatatgaatatgtataataattaattttagttttgcttatagatagtctatgtgtggtccaaatcaatctggtaagttaaaaactatgataaatagaatgcttttagtacaattttacttaatgttggccttttcttatgtttcctccattttgtctggagttttctagttttaataaagataaaatgttccacaaaattctatagctttaaatgtcatacaattttatgtttcacttttagttccctttcttcccaagctgttcgtctcaagaggcaagttaaatgtgtgtgactactaattacccaatttattatgtattgtagcaaatggctaatatgattataatatagaagtatgccaatcaataaagtaattattatattaataaaacctaacttaatttactttaattgcatttttagtttgtagtgattcaccaaagtgaattagtacctaaatcccatatgtgactaaagatttcaatttactaattttattttttactgaaaacattgagattggtataattcaatgaattttaatataaaatcttgattacctattttaatttgaaatttagcaagttgtttcttcaaataactattgagtaactgaaattcaagattaactcaaatttatataaattggtaagtgaaggatttaattaaattgaaaaaatggcatcccaccaatgaaacgtatttcatttcttttagaatggtagttctgtcacatatgctgagtgataatagaaatattttacatagtgtaattggaatgtatataggttccttattatttcttccaaaagttagtaattttactaatttagggaattgtgagttaatgataatgatggttctttatgctttgttaacagttctgtaaattgtaataattttttttgtttgcatatatatttgctgttagcaataacaacatacgtatattgttattagtttatatatatatagatatatagatatagatatatatgtttttattaccaacagtccacccatgttaatgtctactaacttaaaaatttcacaggcccaaactaatgtccacacttcttcacctgcaatatccttcctatttctctgttccactccctctcccatctcctcctgttaaaaaccctacccatttttaagacccatttaaaacacttatgaaatattcactggccagtcatatcatctccataatattttgtgttagcatttttttttggaaatagcattattgagatgtaattcacatatcatataattgacctgtttacagtgtacaatttagtgattttttggtatattcattcacagagttatgcaactgttaccgaaatcaattttaaaatatttcattactccagatagaaaccttgttatcatttgcctttcttcaccaattttcctgttccctctttcgcaatcctggacaaccgctaatctactttctgtctctatagatttgcttattctggacattgcatacaaatggaatcatagatagactttagtgtctgccttctttcacttagcatggtgtcatcaagccctttccatattttgacatgtagtccctttttttgttttttgagatagagtccctttccatcacccaggctggactgcagtggcgagatctcggttcactgcaagctctgcctcccgggttcacgccattctcctgcctcagcctcccgagtagctgggaccacaggcacccgccaccacgcccagctaattttttgtatctccagcagagatggggtttcaccgtgttagccgtatggtctcaatctcctgacctcgtgatccgcccaccttggcttcccaaagtgctgggatcacaggcgtgagccaccgcgcccagccgcatgtagtcctttttatggcagttattccattgtatggatacaccacattttatttatcagttcattagttgatggacattcaagttgtttccaccttttcactactatgaataattctgctgtgaacattttacaaaatttcatgtggacatatgttttcatttatcttaggtatattcttaggaggggaattggtgggtcaaataataactccacgtttaacttttagactatttaccgaagaggctgcaccattttgaattctcatcagcggcatgtgagggtttcaatttctccatatcctctccaagacatgttattatctgtcttcctttattatagccgccccaccacattttgattgtatcattcttaagacacataccacataaagccttgcattgtagctgttcttccatgttttctctgtccttttagactagatcgcttaaagacagcattcatatactgtgtagctttgaaccatgaagaaatctcctaacgcaattatttgccctcaaaggttcccacttaaaaatgttatgtaggtaaactggaaagctgagataattattgagttagtttatatcaaaagacaaaacaaaacttacgagctgttgaaataaatatttgggggctcaaattatcagactatctgctcatactaactgaattattcaaataatttcaatagctcataataagttttgttttgtcttttgttttttggtataacttaattataccaaaagctgaatttcaattcagctcatcacttgaattttccaggataggaacagctaaagttaagctaatctttattgcatttccacttctggtaaacgtgtcattttaactaaatgtctctgtaagttccaatttataaggtcaaaataccgcacctactgttactgtaaaaaaaatttagcaaatagaaaagctgttctatatccaatggattgtaatgctactttgatattttttaagtaattagtacagggagatagcaacacaaggaagaagtattcaaatgtaagtgttggattttttttaatttgggtttttcataatggtaagtttatatttctttaccaccgcccccccccccccacacacacacacacacacacttaccaagttaagaatccaaaattcagaaaagtaattatgtaaattaagaatgagaaaaatacagaaggaggagatctactaaaaggctctctgaagtgccagtcatctccttcatgacccactttgttgcccatgacacttcccagttgtaccttccctgatttttagagggcaatatattttcaagctgtttttcttcttgtaaactggttaggttgtatacatattccatagctattgttctactagttcaaaacaaaatcaggtatccagtggtgaaaacagggctggtaggtggaagagggggcattatgtagaatttttcttaaggctgaccatttctgccttcctaaatgtctttttgaatgcattcacttgctcatttacttaaccattaacatcttttgaatatctactaaatatatagaacattggtactcagattgtgatagaaaaaaaaaaaagtcctcaagagaattagctctgctaccactacctctgggtaactcaaataaccaggaagttatggcagataatgtatcttccctaagaaatgaaagtagacagttgaaataatcagcttggcagttagaccttcagtgtcctaacttcaaatatccagataccacaggcaaagttgtttatatataaattgaatgttttctacaaactgagctagatatgagaataaaacaaaaatgtagagcatgtgggaagacgaaagaattcaagattctggggaaacataattaaaataaactacagaattctaaaagctaagagtttgtctaagaatatgttctttaaaaaagaataatagtataagccagtggcacagaaaattttgttgtaactgttgactggaatacttactatgggagagagcatgttcagtgcagatagactcaaatccatctgcttaagcctaactctgtgcattgcaattctgatatggtgaatgtaacattctgtctccaacaaaactagtattttttaaagattcctccatatttagttttatttcatttttagttacagagtctaactagaagttattcaacctgatacttgtatttagggggaaaatatctcttaaacattctggattctctaaaatgcgttttgctcagaattttccccgtattttttaaacccatgtgtattttaagggaaatttaatccatatgtccctgactcactcacacttaactcatcaaaatgttgtttagtgaaagctatttgatgttcaaaaagccttatgagtctttatgagtcttttttctctctttgaatgaggaagttgctttgccagtcataaatagtatacccaaaggattcacattcagcttcaaacacagaattcacaaagctcttagagacaacattaatacatgcctatttcttataaaagctaaagtatttaaatttctaacttaatttttatatcagttaaggtgttataaaaataaataaaagcttcatcttgaatattgagcctctttgcctcttttcattattttcaaaaagtctacaggtccttttagaatgtgcaaacattttactgtaatccatatttatttccataaacatatgtccccttcaaccatgattccatcatctatgaaacactataaggtactcttaattgtaacaacatccttgataaccaaactgtgtaaattaaaaatataataaaaagacacaattcaaccatgcttattagacattgtcttagttcattttctgttgtttataacaggatacctgaaactggacaacttataagaaaagaaacttattttatacagtcatggagactgagaagtccaaggtcaaagggctgcatgtggtgagggccttcttgctggtagggactctctgcagagtcctgaggccgtacccggcatcacatgtgaggggctgagggaactcacatgctatctcaggtctctctttttcttcttataaagtcaccagttctactcccatgataacccattaattcattaatccacaaatggattaattcactcacaaggacagggccctaatgacccagtcacctcttaaaggcaccacttctcaatactgccacattgagggttaaatttcaacctgagttttggaggggacaaacaaacatatttacacaacagtaggcatcaaccataaatcatatataatttgcattttttgttaattttaagaataaaagccaccctttgttatggtcaggtgtttcacaaaccgtactcataagatctgttctttcttaatacagtgtaatagttgaaacccattttgattttctacttttttctctgtatggagaatttatcataaactaattcctctacaaatttatagtcatactgtctaccaatctggagaatggggcaataaataactaacttaccaggaaaccatatttttctatatggaggtgactaagctttcatggttgtttttaagcatgtgaatgaggatattgatcacctactgaaaatatgtgggtcatcttgttagatcacatttgagggaaaatgcaagataacaaaacaattttcctagtatcaaattatggatgttagcaacttggaaaggaggaagagtgagctcttcattatcttgtcactgccatacctaagagtgtcctggtcctctccctgaaagactttgccgcttactcaaacataaagttaaaaagagattttgccactacagttagaatagtgctatacagaaggatcaataagtctttctgcatactgaaaatattttgtttaattagtttatttccatggcttgatgttgcagagccagaatagcagctatagaaatacttaaacaattagccctaaggacaagtatttacatggcaattaatttacaaatagctagtccagtagaatatgttctatcagttcaagtcatcagtccaataaaaacaagtcaattgttttctcttagaatagaatctgattagaatagaaaatgtcaagattcacacaaagtagggacaagacctggaaggacctgttggacccttattctctgatgctagatcgaaacttcactcgggtgaatgtggttgtcccaccaaaacaaatataagtatcggatatcaactctatgtaagacataatggtgagtgcttagagtaaaaagacacatatgatcaaaattctgccctccaggaagttatagaggagaagagataatgaaaaaaatagttaacctagatatagaaaggaaaccattctaacagaaaacacgatcctagaataacatggattctggaaagcctttattagaatgggtatttcctttcttgagtcttgaaaaataagttaaacatttagagagttgttgcagatggcgggaaatgtatactaaaacattaacttctgtgtgaaactacagtagttctaaattacttaggtagaaagcatgagtcagggagtctctgaagttgagactgacaagcgcttggggagggagctttatgtgccttaaggaaccttgtttttatcctgaaggccactgtgagactgtgaaagattttaagtatgacagtgatgaatttttttaaaaaaatcactctggcccttgtgtagaatatgcttttaggatgcccagacttgaggtaagagcttgacaggaggctgttttccaaagcagcagtgatgagagcctcaagtaaattggcagcaggcaggagaaaggagaatgggacagctaccaaaaagaaaaaaaattagaaggtaatttgtggaggactgtaataactgactagtgcagggagtaagaatgaggggaatcaggcctgagaggagaggtggtctagaagctattaactgtgtgtgggaatgtgcagatgcaaggtcttctgtgggtgggagatgaagatgcgtgatctgttgggcctccaaaattttcaaaagaatagaagtttgaaatttgagagccaagttgggcatggagttcataatggaaaccagtgagatcacctaaggaaagtaagaaaataaagagagaagtagtaggccaaaatcagatgccctgtggcacaaggtttaaagggcagccaatgaaggagagcccataataggataccaagcaggaagtaaagtagtaagagaaaaggaaagaatcctatgcttacgagtcaggaactctggctcagcatttttcaaactaatgctccttgtaacacaggtcttttgaaagatgctaatgagaaaaaagaaactctatagttaaatatgtttggaaaattgtgagtttaaaaataagttgcaggccaggtgcggtggctcatgcctataatcccagcacttttggagggtgaggcgggaggatcgcttaagctcaggagttcgagatcagcctgggcaacatggtgaaaccccatccgtacgaaaaaatttaaaaaattagccaggtgtggtggtgcgagtctgtggtcccaagtactcaggaggctgatgtgggaggatcccttgagactgggaggcagaggttactgtgtgatggcgccactgcactccagcctgggtgacacagtgagactccgtcgcaaaaaaaaacaaaccagaaaaagttgcagactttttaaattgatggactttttcaagcctttaacttactaattaatgagtatttcccaaacatcttggcctaagtagaggttggactgaaactaaaggagagaataggagtgaggaactaagaaatggaaactcatgtctagagcttaacaaagaagggaagaaaggagatagaaataagagagcagagggggcaggggagggtaggactagtagcacagatagagggggtaactacctcaaacaagaggaaagatatatttccagaaactgctgaaaaacagtttaggataaatgcagacagagacagttaaggataaatgcagacagagacagttagggataaatgcagatgtagaaaaatctgtagatagaggaagacaaatgaaaaaaatttaatttttttccaaaatatgaattcttcatttattatataatcaggatgaacaaatatataggtgaacttttctagaaaaaaaaatccgtatatttaaccatcttctcgggagaatgtgtgacccagaaaaagggtaaaccccagtgctctgcactataatttctgagctctaatctttgattccttaacctacaaagtctgacattcaagtatatgtatgatttttccgtttcatctcacactgctttcccttacacatcctcatctctggccaaacttatttactgctcatttacacctacaactgtgtttttgtccaaactattcccccttgctcacaatgctctcgaagaccacaacttgtccaaatttctacccatccatcacagctcactacagatgtcactgccatcattctatcccaactgctcacttccccaccaaaaataggccggaaatcatgattgttctgtgaatgtccagaatttttttctgtccctttcttgataggaggcagcgtatataacaaataccctgactttcgaatcagatcaccaattttgaatcctatctctcatttactagttgtatgacctctaaattactccaacccagagtctcattttcttatctgtaaaatggagatgatagtagtgctatcacacagggatgttaagagaaataaatcacataaagtgccttacacagttcttagtttaaccctttcttccttatgtcataattattcttgtgtattctttaccttatactataagctctttgtgggtaaaatgtatgtcttatacactgctgtattctctccttatatgcaaaaacaatatactactcattaattttcgttgactacgtgaatgaatgaatgaatgctgaattaaatatgtctctacacatttaattacaaagagcaagcaagttatacactaggaaaaatacgatagtcataaaattatgccatttaaaaccataatagtatgcatgtaatataactagaatgatcaattacattataactctcattggttttcagtatatttttaaatttatattttctctaaaatacagttatcttttatatttataaagaaaaatttgaaatcaatttcagaaaaacataaaagatgtaatatattaatttaagtgggcttttactatgacatataaatgcaacactggtatatatcattttctatattcaattccacaaacacagattgcatactatatgacagatactgtaataggtgaacaagataataacccctgtcttcaattagcttgtgccaaatgggagaaacagacttttaaacacatatatttaatatattttaagtgccataaagatatggctaggaaactatggaaatataaaggcaagctacttaatccaacctaggggtgcaaagatttaaatcatatcctctggtttattcactcctctagtctagtagaaatttactcttcccgatcattaaatgatatcccagtgccgtaaaagagtcaatactcttccagaaggtgaaaaatgtattccatatgttgaactaaatgtaatataactggaaacagaaatctcagctggctcacttattaaatcaaaaggcagagcaaattttcacactgaacattgaaactatcactgttgtttagtactttttgtattagaaaataactccgtgctattttacttatagtatatatgctttgtaagctttttcttctaggaaatcacacattgcctttgcagaaaatgcagcagttttttttttttcttttttggttccttgtaacataaagaattacctgctctacaataaattggtaaacataaatagtaggttaaagttagagcatataagagtctttctcagtactttttaaaattatgtattataaatacattaaggtgggattttagataatagtgtaaaaatagatgatctactatgatgaacaaataatatgctaaatttcagtattcagttgctcatataagagggctccattccttccatgtctgttttagactgtgctaagttgagtttttcagatgtaggtttactctcatctcaaaacacctaatatgtgttcttcatctgtctcattttatacaataataatctaaggaaactatgatctgtggggataattagttattgttaatcttagtgttaaggatagattatgctcaagaagtcacctagcagcatcaagaggccaattcctgaaaacagtgagcttttgtgtaaaatttgagtttatagaatatttataatggatagtttaggggagagtacattgtgtctttgtgaatatgttggggaggaagtagtactgaagtttaacttcataacccttaaggcattgtattctatgagttgttaaagtatttttattttattcaagcaaaaacatcctgtaactatttccatgcaaaaaaagttcagggctggagtgcagtgtcactgtcatagctccctgcagccttgacttccagggctcaagggatcctcccacctcagcttcctaggtagccaggacaataggcatgtgctaccaaacccagctaattttttaaatttttcatagagatgagatctcgctatattgcccaggctggtctcaatctcctggcctcaagcagtcctcccgcctcagcctgccaaagtgctgggattacaagtgtgagccaccatgcccagccctaaaaaaaaagtttgaaaatttcaaaataccattgctctgaaattttatctggacagctatcaatattatttgtatataaataaaacagtcactatctgtagactttgctactatgatttttttttatttccttaagatacttcagtcacctgaaacccagagaaccatcctggatatctaaaatttgggaatctaaaattttttacagtattttttctagaacttcccccctccatgcacatacacaaatacctccatttttataatgcccaaagctttcctaggattccaaaacaaagttacaactttattatattcttcagtaatttgttttgagattaaaacatcttattatttatttctatgggggagaatgttttagggaaactgactgtaccatacttaaaaataatgagtctatggccaggtgcggtggctcagacctgtaatcccagcactgtgggaggccaaggcgggcggatcacaaggtcaggagttcaagaccagcctggccaacatggtgaaacaccatctctactaaaaatacaaaaattagctgggcatggtggtatgcacctgtaatcccagctccttgggaggccgaggcaggagaatcgcttaaaccgggaggcggagcttgcagtgagccagagatcatgccactgcactccagcctgggtgacagagcaagactccatctaaaaaaaataaaagagtccaaagcagtgacagatattttagatatgttcagtcactcatgctatgaattatttccctacaatgtataccactttataaaaataattgtaaaaatttactcccttattatatttttgtcctgatttctttggaataatattattttacattgaacataaagaatttcagattagttttagttcttctaaataatgtcaggattttaagtttaataattctactaagattagtcaatgtttattatcccaaaataacaatattttacatgttctaaaagcaaactgagcatgtagtttccaagtaattgaagctgaagaaaatccatatagctaatacaacttttaacaatattaaactaaggttaggaaatattcaagtgattctaaaatacattataattttatgtaccctaaatatagtttaccaattgaaagtcatcaaatacttctaacaattccaattttaattaaactccaactcttttttttccatacgtagtctttgctgtgctttacattgaaagttgtaaagaagcttagcattacttggaaatttaatagccatcgttgccttttaatcactagaatgcagtgtaccccctcctgaaaatgatttacaccccccccccactcccctcccctgaaaatgattaatccctgcaattgagaaaaagaaaaagcagcctctgacctctgggaactggcctgcctatatctaagcctcattctttttgagaactgtcctggagctcacagctaggccatggcgttctcttgttggacataaacaacctcacagagcaccaacttcatacagggttgtgtgatgatgatgtgagacaaaaaacaactttataattttgactaagcacagacaaaagcaagatcactgtgcataccacaaaaataccagacattcccctcttttggctaatatgagtgactgctacatctcttcaattagagctttagcatacatacatttagtcttccttccctctagataagattgattgaaatacttaatcattgaattatttctgatgcctgacagagcccaatccagagcaaagccctgctttcctgaactcttcccaaaatcacttaagtaaaatccagatcctacaatgagtcttttaacacccctaagtcaccccatggtacttattgttgtcagtttctctcactgcaatgagtaataaaacccacttgttcaactacagatgtgttcttggtggtctttggcaagaaagcattgacacatccaataacttaaaatttgtgaatattggactattagttctgtaaaaatataaaagagttttgtggccgtgcacagcggctcatgcctgtaatcccagcattttgggatgccaagccaggtggatcaactgaggttaggagttcaagactagtctggccaacatggtgaatccctgtctctactaaaaatacaaaaattagctgggcacagtggtgcgtgcctgtactcccagctactcaggaggctgaggcaggagaatcgcttgagctcggggggcagaagttgcagtgagccagagattgagccattgcactccagcctgggtgacagagcaagactctatctcaaaaaaaaaaaaaaaaaaaaagaattttgtaaagttttaccaaaatgtcagcatattattaagatttctgtgcttgaaatttttattttcatcaagataatctaaacccacaagtatttaacattctacttttaaaatatatttgataaattgtttcttttttaatataaaatgtgtactttctactgtaggtccatgatgaggtttaccatctcaattggttaaagatcttacagctctaaagagaagttattattttaaagattcattatgcttgggcggtttttgttctagttcagattttaaattagataaatgggaagtaatacccctatacttctttcaaaaatagtaatggatcagtattttttaagcattatattgccagttgtaaaaagtaaataacatttatattttccttttaattaccactttagatggtggaattttaaattattatatgcatcaatgcaataggaagaggtttgtcttatccatttgtttaacatttaatatcaatatttctatgtgtgccgaggacattataatttattcttttattgctatagtagtgattgggatgaatatatttacagtcattcctcaactcactacaccaagcaaagtttaggaggttaaatgtgtagttacttaagttatcttctagaacagaatcagctagatcaccatctcaccatcattcagagatgctattctttgtaaactatttttatttggaaagggatccgaggttttcaaataaccaagtactgtatggaagatgtgctggcttgtgattgtgccttatgtaaacattttaatatcggatccctaaaatccaaaggctcccccaaaggggattaaaacataatcccctctctctattctgtagtggattaactctgtattctctctgcggctggtttgctccctgaagactacaacaaaaagattcagtgctccttaaacatgctatggaattggaagttgtaattggagatttccaaaggacgagggtaaaaatgacacactattaatgctgaatatttcatgatggtctttcttaaagaaagaccagttcgaagcccttttataaatgcccagaaaatctcctcaacagaaggatattggagtaaaatccaaaggaagccgtcccctttcagaaacacagagaagtagagaagatatgctccccacggaaagttcacggatgtgtacttaaaatttgtaatgtatttcaataaatcaatgggtatggttttgatgtttcacgatcttttttttttcatgttctcaatttggatacgttaaattactttttaagagaaagaagtaattcaccatttttagtgtttttgaccattatttgtctccaaatgccagaaacctctgttaaactataaatcttgatagtcctctgtctttagaatggagacttttttgaggtttttagcaatgcccaacaatgtacaactttgtttccagtgtgaaccaaatcacctttctcaccttgccccaagcaagagtaaaccgcatagatttcttcagagagaagataggaaaagtggcatccaagggagcgtcctggttgcttaagggttaagggagcggttcgaaccggcccgagcgttgggggattcggaggagggcgcgggaggcaggaggcgccgccaagcgcgcgcacagaccctccaataaacacaaaggagggcctggggaatagaaacccaaatccacttgtaatcgtacaagagattcgggcgtaattacttgagcaatctagattaagattgatgatcctttaaagtggtgcttcagatcgactgcctctccctttccaaagaaaaaccttgtgcaaccgaggtggaccccgactcggctgggcagaggccgaggcccagagtccgcgagccccgggggctcatcgggggatcgagagcagtgaaatgaaagacagggctgtgcgtgggtctggcccgggcagtcccgacagggctgaaagctgacactgtcacagtttgctccttagccacccccttgtaatcgcgacagaagccagcccagccctctgtgttcccgcagcctcgggaacggcccggcattgtgcaggacggtcgcagattgggtgtgtgctgcgccagggaaagccaacttggccgcctctcccgagcccggcccggcgggggccgagggcggtgtcggcgcgagggctctccgcccggagggccgaggcctagcggccgcggggaacctaactttttattgcctttctccgactgttattgtgacgcatctgactgtatgcatttgagagaagtggaagggattatgatgcgcccttgctacctacaaatgaatagttacatccgatccccacgttatgtataacgttatatcgtgtttcgaatccaggattgcgaagaatggctccctttggggagactttacagaaaacatttaggtaatatcccatttgaattcatattccatacgcgtaattcgtgattttcaaccttaacagattgagggaattcgaagcaagcaccctggcaggcacttctagtgaagctgtttctgtagtttcaaaagttgagaagtagcactttcgcacggttttttgagaaccgttttgttcaagcgtcttacattttcatcacttttgatatattctctgtaagaaaatgactaagattttcgttcttttctacgtaagaactttatgtaatgtccgtatgcacgcgtatgtatgtgtgtgtagcgcgccttaggagaccgatattagattaatcttcctgcaagaggcaaaccgctctgaacagcggaatttatcatttagatccttgcccccttctcgtcctctcgcctctccttggggagcgccgctgctgagtggaacggcttcgcgcgatggctggtcttgggggcagtgctgactgcctagggtctctggaaaagccagtgatactcaatggagaattggggcatttgtccgttctgcacttttaagtaagttaatggcagccccttaccaaccatgtaggatttctaggtggaaattgagcgttattcggtatcctgacctcctgggttttcataccattttttctctctagtctcgttataaggtaatgtataaaagctaagtagtccttatcttacgtgaaaaaagagtttgccgcataatacaggcaccattttttctagtgcatccttaccaataaaaacctctggtacctttctgggagggagcaggaagggccacaggggctcagcctgactccccttgtccttgccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagtgagttaaagcgattccatgtacagtattggtggctttgtggcaggaagtggttttcaattttgtttggttttacctgacagtggaggaggggagcacattctcctctttctcatagaaaataaaatgaatgaaatagcatgttctctttatggaattgaagaatatattaatgaatttaaatcctgtattaccagagcatgcacattttaacagtctttctatgagtgcctttgtttgcatttgggcagatttggtagttaagccaattgcttccaagtccctggggcccagaatctcaggctctgaggctgactttgaaaggtcttgagaaatttcttattaagatcacttttaattttcaaaactttatattgtaatgtgattattgaaaagttataaggaaactggggggagagcatttagatataaattaatctccattagtacacccattttgtccatctcctgaaataagaatgggttttatatgtggatttaagagaaaagcaactgattctctgagctttgattttaaatatatatgctagcactcagatgtttaaatattgtattctttggatataatgccagaaaatacaaatttggaccatttaaatgcatatttattaaatgttattgtgtagattttaaacaccagagtattagagtagctctttctcagcattttctgagatctgttctaatgttttaactttcatgttactgtgcaatttgcaaacttctattctggggttaagaattcaacagcatgaagtgtcatgctagaaattctagcatcattttgcaaagatcttcctttattttcagaggcagttattctaaaatagtcaaagacaaatgctcccacagatccagaactttattgtttttaatttagatattgaaataaaatgttataaaatagtatttgtagactagagctgaaatccaaaaatttaccatcacctgaattaactaacttaaggcccataggtgatcagccttttcagcacttgttgactactaaactcttccaaaggagagccatgggacttcttttacttctagctgcaaatgtagtttttaaaatgagcttgaatgcactgtattttattttaaaataacttaaattttgtgttcatccttttattagcttgccctatgaagtcaaaaagaaatgttgaatttctaatgaatttattctgctaatggaacccttattacataaaataaggtttgacataaaatatattggtcagaaaggatcgttttattagttttcatacataattttcgaagtttcattatgactttgttaagttcatttcctctgaattagtcagatttttaactcagtcatctctactgtcatgatagactttttttcttatattatcaaaaatgctacaagaagagcaagctttcaaaggtagatttaaattgtttctgttgtagaaaggaattgtcttacaagtaagttagagactgagagtagattgttatcttatggacctatacagaaagagcttttctccaatgttttatttttaaggatttcattagcatatttctcaaaatatttaagatattcaagtgggtttgattttcaaaatgcatcattacatcttgtgataggaaacaatttaaagtgagacacaacaacttttattttacttcatttattaccatctaattaaataaaaaccagcaacaaattaaaatctaaatcacaaaagtaattatccagtgtatttcaagtgcatttttcaaatatataattcagatattcaagcgttattatataagctgaattcaaatttctttgaatatatttaaataacatttcaagtatatttatggaatgttagaaatagaacaagcaatatttgaaacaaaatgtaaactttttaaagttcagacactttcaaagacagataaaagtaccaggaagaaatctacctttaaatgatatctttgttagtggaaaatgtctggaagtatccagaatggcaatttaagttctgttcaccaaatcacaaaacaccaacatccacactttcaaagacaatgtgagatcacaatatttgttacaaatcaaaatatacattacagtttctttcagatggcatatccaaatcgtgtttactcacagacagatgcacctaaatcaccaggattgctataatcctttgatagttaggcagagtgttcgtctcggtctggcgttacagctgggctgtttacggagtgttacggtgtacttttcaagggagataggaaatcgtgtggaaagaagtcttctaatactagtggctttgggtttttctccatccgcttcccctactttttctccccttgtgggggtgggtgagatgatgtttaaatattgtattattattcctttttaaaggaagagattgtttgcactgcggagtggaatattaggaattgaacagaagtttacacttaataaggactttgagaagggtaataatttcggctcttgattaaatcatcctctaaagtttttccaaacttttcgggttggtcaggatctctcttgccagtcgccacgtttgtttggcagcgttttccagagctgagtgaggtttgccttgaaacagatctaagttcggtagaaagtagtggggacaccgccggcactgcaggcaggagataagttgcagcaaaatcccgttcagccgatcacccaggcaagactcgtcccagtccgactctcggggatgcttttcacactcgtaggaaaccagagtcttcatatggtaattgttcaagggctggcccggcagttcaaggtgacgatcccttaaggttttgaggatggagaggcacttctttctgcagccccccatctgcagtctgttctctgcctccgcgaactgcagcacccaggcgtcgctctccgccgagctctgcttgccggccaaggagtggcactccttggacaagagattgaaaccttccgccttgacctccgccacccggttgggtcccggccaggggatgtggggaagtggccagtgggcagcactcctcggccagatcccggtgcatttaaaggccggcgtgatctgcaccacgtacctatctcggattctcagtttcacttcgctggtgtctgccaccatctttaccacatcccggtagctacatttgtctaccgcttgagccaccagcgtctgaaacctggaccggattttgcgcgccgagaggtagccggaggcggtaatgaattccacccagagggacatgctcctcttgcgcccgtcgctcaacttcagcaccgcgcagccgggcagtgagccatcgtccacgaagttgaacacccccatttggttgagataaagcaccacttcaaattcggtgggggagatgacctcgaggccctcgtagcgattgtccatctcgttgagagagctgatgaaccgcggctcctgcacttccacttccttcagtacgtcggaaactactttgcagacttcccggatagttttggcaatggcagctttcctggcttggcatttttcgttgtagtatttattcagatggtagaccagcttggcctgggccgcaatcatgttggggcagagatccggattgtacaccggagtctcgcagtaagctgtgggatccaatgcggctgctagagctggagccaacttcggtggagaaacgggccgcaacactcagaaatggatcaaaaatgcctttcggaagtgctgcagcgttggtttccctgctgctgctgctgctgctgctgctgctgctgctgctgctgctgctgctgctgctgcttttcccttccttttatctttgagcccagccgttcttaaagtgaaagactgtcctcccccctctgcttgtctctcttcctcttttaaagaatccttgtgtgagagaaccgcatggagagatcaccttctcaggaataaaaaacaaaagttgcgctgagacccagcaaagctcttccagtagtcaaaataagcacccctttccgtatttatttgcgctttcccgtaatcattgtgtgtgcagcactgttaatcaaatggaggaaaagtgtgctgagtgtgtgtccggggtgagtgtgcgtgtgtatatgtcagaagaagctgctgttggtttgtctaagagcccagatgcactcgtgtggaaattataaaggcagggccaggcaggcgggcggccaatcgccactgggctcgtcacgacagcctccttcagctccaacccggctaattaatccccactcatggatataggcacacaaactaaaggtaggaggctgctgccggcggaaaaccactcaggccacctagacagtttggaaatcaagaggaatctctcagctttggtattacttgaagcatattgacgttttgaaaagacttggcaaagcggctctcttctgtgccgaaaacctgcttgtcttttaccgctgaaatgcaaatacaggtgtattaatgggcatccatcaattagtgatcttgacggggttttctaaaacaaaatcactaacttgcatttagagtaagataattaacgtctgttaatccttggggtcttcttaaatgcaggttgaaagtttgttctttcatgcagactactggcatatggaagttggctttagatggaggagtacctgtgtaattttctcattctggatgttcctatatgttaaaatgattttttgaaacgttatggaggtagtatgctctttttttacttatgtttttttcttttctccatttgttgaatctgaaaattattgctgagtgtgtgagatgttctacccctgtttaagttaggatatttaaaaaatatttcgtacatccctctgccccagcagatgcagtctttgcactttggtggacttgcccagcattacaagcaggacacaacgctatatatgcacttatagaaacatttgaaaaataaattgtctgtgggatggacagagtactttagcgttatttcatagtgacctgtattttagtacataaaattcaggtgagatcatagagatcaagcttcctcacagataactatcccgaaaaattgaaggtttggggtatctggcttgtttacagatgtataattaaggatatatctcctgtcttaagtgtccttaagtggtgacctggcagtagacttctaattttatactatttcgtgtgatttaattaagggaaaatggttaacatttgcaaagaaaattaacttgcagttatctggggggttttttggatttaaacatcattttgaaaacaaaaatgaaataaatcatttcatttctgaattttggaacctggaaacaggaggaggaatttttttttctagttggtggtccagttgtgtcctcaaagtacaggaaactaaagaaatactacttagtggttacgttgtggtttttaaaactaggtggatttttttaattgtctacctttaatttagatgccacgtctttccaattaagaatatttcccgtcaaatcctataactcccggtaacatgtttgtagacactttcagagtcacttttaacaagatattcttcagggctcccacttgctacttaagcttttgatttttgtttgtgtgttttgttttgcacaggcacagcatcacaaaaccacctattatttaatttctccttatccaacagtgatagattccaatttagctgaaaatagtatacattggggtgcgtggcacccagctactctatttcccaagaaccttccatccccttaagagcagggtctgggaacacccaaaaaacccctccccactttgccgtcatcgcgggtgaatgcaccactaccttttggcagttggaggggagacccatcagagccggagaacctgcagccacgacggcgaggatgtgcagtggtctctggggaaacgccgccttctgccctcacccggcgcgtgtggccctgtgccgtccgctcgccgcctctctctcgctgctccgcattcccgtgccctcttactttcctctctgggctcaagatcgctacgctttatttctgcgtgagcttatttgaaaaccttacttggtgtcccggcttactctccacgtctgctccagaccacggtctgcccacgcacccctcagcctgcaccgcccacgtccggcccaggtgtggtcgcagccaagccccagccgcgggcccctgcgccctgcgctctctcccttgggttcaggccagagatgcttgccccaagacctcgccccttgccttcttgggccacctgcagaacacccttggttgtcaaggacgtgagacagccgaggacggggaggccccagggctgttcgggggaccttaagtgggtccaacgggaaggacgcgggcctgcgagggatgccggtcgggcctggctggagccaggcgcgcaggtggcgcatcttcggggctcactgtgcagcttaattgggttaaagcgaagctaaacaccgaagcactttgtgcaaactaattggtgcaaccagcgccttttcactaacgatttgcactttgagaaagaaaaatggatggtgagaaaaggtatactaggaaactcattagatctagagtgttcaggaaagtgaagtcatttagtttaaaggacgccaggactgtgttttctaagctgcttccttaagcacccctcacacaaggagctgaaggtgatttacataacataggattcaccggtccgcgattatcactgtgggtgaactgggcgccctggaatgaataatactctagtgcaagtactgcttgttgctgcaacacagtgattttctattacactgaacacgtgaaatgaattgccttctgtagctgaatcctttcagtgatcgtagacgcccctcattgttgaagcgagaattaagctattcggagaagcgtgttttccatccccgaaatttttttatggaaatgacctatagagagggattgcaaataacagtacatttttgtgcagttcagccgattttaatctaggcttgggggatatatttattttatgggagtaatatatttaactatttttcagtgaattttaaaaaaatatcatttgacctattaaactagttatgtcaaatgattatgtagtacatagagatggcttaatatacatttatgtattaatgtgaaaagtttttttaaaaaactccagttataccagtcttgcaatattttttgttgtaaatatactcagtgctactagaataaaattgtgtgtgtgtcatgctttaggatgtaaatacttaattgttttcagtggtaggcatgcagacatctttgacatgagctaataatagaatgataattgaggaaaactggcctaattgaaggaaaaaaatctcaagaatctcatgatttaatgatagtttgaaatgcttatattgaatggtatttagaattttaatgcctaactgacttttacattgcatttacttagtttatgaggcaggctcgatttaaaatgtaccagttaggaaaaaaaaaaaaaaaagcaataaggacatagcacaccattatcataaatgttagtagtattagtgaatataaaataattaaatattgtgatccttaacacttcgaagcgttcgaaataacagtggcaaaacaactttgcctcaagtagtatttcctaaataacttgtctccacttctgcagacctgcttacttatatgggatatacaaagtaattcataaatagtgtcattattaagcttaaagaaaaaccctgttatgttgagaaatacaagaatgcaatatttctttgttttcgaaaaaaacctgatttaaatttgaattgcatgttcacaaatctcagtaattgtaacctttcatctggaaaaaaggtatctgttaaaggatatgcacatacatgttaagtgcttatatagatattgtttggtgttttttcattatctgctagctgctagtctattcacaagtattaatgaatttaaagttttatttttttaatatgtgcttattacgctggggagataaaaagaatatgaagttgagtttattacattatttatccctactgctggagtggctttgaaggctcattgtagccatctgatttctttcccccttctttttttttaaatgcacccaggctatttcaagtgtttcattctgccagacacaatatatttctttttttacactagagaaattaaagacagatatttgtgcagggttttctttatgtgtcacattaaataaagtaaaatagagagagtttttctggtaacctaatttgatggcatctatacctttcttcctgtgtgattcctggtataagaacacttgagacaaaaaatagcttgaaacctttcaaggtttcagtgatttcttaaagtaattatttcatcttttaatatcagatttatttcaaagtcaagcagaggattgaggtcactgtttgcacaatttagaccctattttatttcttcaactagaacattttgagaatcgtggttaattttttagaattgtttattcttcacttgactgataaaggcctttgcctcagttttcttcatcaccctagttcacaatcatatagtcacatttgtagtgaagagtactttttttctctacagtgttgcttaataagcttgatattggtattaataggtttttgaaaagaaaattttgagattaaaaatggaagttgggagtatacttgtaagaattgaccaccgctgcttgatttgcagacttgaagtaatactggataactagccaaaacttttcttttggtagaaaaagaaatttaaagcctggcttattttcataattgtctctgtttcctcacttcatttgcatatgtacacagaggtacaggatgttttcagttgtatctgtaaactgaaaaaaaaatggggaaagggaggttatcaacctaaagaattttttattgttcagcataaattgtgatctctaaccttttccaaacatttaaggacaatgaagttagtcattcatttattgaatactgtgtaggaaatatggattccaatagtctaatttctcacaaacccttcagaaagttactattatctttctaataaaactaaaatctttttgttagatatcagcttataattttcttgtgatattatagaaatattcagacaggataaatgggctcacatgattcttttctatataatgtatgaaaattaggtatttcctaacctacaacatatacacaaatgtatgtatgattttacatacatgaatttacgtacatttgtgtatatggctacatttttagtactcttaatatgctatctttttattgcatttagagaaaacaaaggaatcagaatcgattagtgtctgttaatccctacatctgtactaggtcatccaggactgcattgctctcattactgtttcatactgtatgtgattaagccactggaaatattcaacatgaccttgagactagaatatggtacatagataatcaacttccagtgattacatgtctaaaataacctttcctatttttaatttatagttttggagcttattttttaatgagcaaagtaattcttctaaagtaagatttattttttttaatgattagtaactggagtaataatttaaaaggataattacataaaatagaaaacgattaccttttatcatgtatattatgtgcagtaaaataaatggtttacagaaaaagaaggaaattagtttataaatataaattttctttatatctttacatataagtatagagataactatctgagaatataatacctatataatatttcatttccagttacatttcaatattttcactattgtaataatatacattttagtacaccaatatgtactatttcttgaaagcacactttttcatataatgatttgtcaaaaatatcaattctaaagtaatactaatgaatagttaatacttttacattcacatatccttatccattttattatctaaaatcccaatcaaattagaagcatgaacagcatagtttgtaagatgtagtggtgttcctgattaaaaaaaaaaaagtgggaacctagtgaaataaaatgtatagctttgtttttctgtgaaatttattttttttaagttagatatgtctgtgaaatttatttttttaagttagatatgtcgatgtgtactttgcatacagtagtattccatgatttttccatatgattgtgccattctatgaattctgacaaatatataccatcatagaagctctaccacacatgtagatagaacatttctattaccacaaaaatgtttcttcatgccctgatttcattatttttatttggaaattttatgattaatgtataaatgtctggctgttttagttttatatcaaaagatctttagactgtaacaccgttatttatttcccctagagtttactattttgtcatgcttctaattaaagacaagttttaatcaaaaaacactgacacaggcaaagtgtaaaataatatttcagatatataagcaatatgtttataatttttattttatgtaaagtttaattttcatgtatgtgacaaattaatacttggtagaagattgatttttcaaagaaactcctaatatttagtagctaacatgaatatatgtgttagatttatgaatctgatttacagcttacacatcaaaatatgcaagtaagaatgggtttctcatataagttagcaacatttgaggcatatttgtaatgtttctagctttatggcactagagaaagaaatgtcaagatttctcaatatttttactttacattttcagtaaattaaccttccctttgagtggtaggaattgaggctaaagagtttattagatctaatattacttaatatatgcacattcttgggacatgtgtataaatatacattatcctaattttgtataaatatacattattatgtaaatgtagatggttacaaatactctaaaccaagaattattaaattataggagtgaagacattgataatgatgctctttcaaatattttgtctttttacaacttggaatagtacaactagtcttttatttcttcccccaagatatacaaattatttaaatgctttctgttttgtatttttattttgcagttacaatagaaattttaatgttatgcatgcttacaggcctattaagaaagaagttattgctttcttaataatctcaaaccatctttaggaaatacactctttttatggtttgcaaaatagcccatgcatgcatgcaggctgtgtacagacacacacacacacaaaaacaccagtgtttaagatagcaaaagattgaattggcctctatacattttccgtattcatctgttaaaaggaaacaaccactaaatattggaatcttgttgccaccaggaagtaatatccacatccacaagtttgtctcataataacccttaacagtttttgataatacctgaagagactgtacctaaatggatttttaaaataacacgggaaattccaacagcatgtattcagtcacatatactacgtcaactttgaatgtcataagcttttaattatgaaattgagaagtttattgctagccattttgtccatagaaaaaatttacttaaatatttacctacattaatatgtgtgtgtgtgtgtgtgtgtgtgtgtgtgtgtgtgtgtgtatatatatatatatatatgtagaccctcactaatttaaaattgttttttacttttttgcaacagaccaagtttaaattttttgcaaccttaacctgcatttgataaacaaaatgtataactcttcagggggaaaaatgtgggatgttttgttttttgttttttactggcaatttcagttcttcatttgttttgctctccacgctgcattagcacagttttcccctgtgtgcatctgccagtgtacaatttagccacgggcatctgtagaccttgtggtgatcagtattgcaggcaaaagccatatgtgtttaaataaaaaaaaaatctctttatttcatttgctgttttaactggatggataacttttgtgcctcaagacagaaaaagaaaaaatacagaaataattaattgcctctattcttgaggcagtttcatttcccctccaatatggaatgcttgtcagctttcctgataaatgactgcatgtatttgcatagattttacattaacacaaaaattagttttatttgtggaaaactagtttacataataatataaaacccctgttattgattatgtttccaagcattgatgactttagaggggtggtagtattctaaattttcaaaagtctgatcaacctgtataatttaaactttcttttgataaatagttttacattaagatctaaaagacatatttataacattttaaagttttaaaacttcttttctagatatacttaccacaactgtttcagactcatagtagcacccatttggtaagaagattttgattttgaacttttgccaaggaatatttttaaatacatattaccaattacgtacacttcagccaattggaagactgcatctatatgaattactttaattttcatattcatattatgaaaaaagatgggtgctatattggatgtgtacagtttagctaattcttgggaagttatgtattatttacaaccaaatttaaaatatatctgagaactgtcctctccatctttaacctatttccttcaatatacttaattaatcacccagccctgaaaaaaccactctgctggagctgttagggtactgaaaacaattctacctctctaagtggcaggcagtagatgtttattcatactataatctggcatcttgttgtctagaggcaacctgctaattatgtgctatcgttgtattatccatgttatggaaaattcaaatatgttcactactgttagttacatcgcaaagcttttcgtaaaatatacttgatcctcaagaaacctactatacttaatggcaacctaaaccaagagtgtctctgccacttcttgattctgggacaccctgggtgccagctgtcacagctcagctaatgatgacaaatgcccctctctatgcagattgcagagcttgcaggctgctgtgaaaggcaaccagattacctttcttcagatagtaacttaacctttaaaactcatgtcagaatgaaatgatcagctgtgatagtttcaatatctgtatctttaaaaacaaaaatcagaataatatcaaataatgcttttaaaagtttccagtatttgtatgatttacagtgttttacccttgaatgctgtaatattcttaaataagaaactctgggtaagacatacttcacaaccactttagagtgtgtatttgaactctgcgtataaatcaggtaataggtaattgagaaaattctccagattgtttagtctaaaaaataggctgatgaaattttgagggaaaatatgttcttctcttcacctgaatgaatggtaaagcctcaattctcccactgcttgtacaagcctagcctgtcccaagccaatagttatattatgtcattaaaacttagttattccaaaatgatttagagaataattgttgctaatgattgttttctctgggtattttcaaatatgatcttttaagttattaatttgttctatagaaatttatcatattacagaacctatacttacatggattattcaaaacaataatgaacaccattaaccataatgtaattcagagggataaattacctattaaatgagataatgctttacaattgcaacattcttttcaatttacaaaggatttatatccattaattcatttgatacttaaaataattctgagctgggaaagatgggtgacaaggaacagggaccaatatttaatgagtatttaatctcatttaatcttcacaacaaatattagctcccatttacaaataaagagactgaggtttagaaaggttgcatcttaccagggtcacacaggtaattgcagagccaggtctgtctgactgtggctgccatcagcattacagtttctagactacatatgtccatagccagatataattcatagaaactgctactaggcttgcatttacataaacaacataattgatgagttttaaagataggttctttataggatgcttttaaataggtaaatactgagatacttttatgttataaattttaattttataaggataatgtattgatctatcacattgggagaaactatttaggaaagatatgtactgtttactgaatatcaaattggactaattcacctagataaccacttcattgtaaaacttaagattaatgggatatacctttataaatgtgatgaggagaagcaattatttcaataattacttgagtgaaatatttatatacttttcttttataaaggtttatccatatcatagttttactatgtaatatcagtgagctataccacccacaatattgtttttcagctcaagacacattgaaaacttcctttgatcatgaatttaagtgcagtcatttccaagaaagctatgccaatgccagttgtatttattctgtagtaaattattctttggtatagatactaaaatgtgaggaaattttttcaatgatacatatgattatattattatataaagactattttatgtactgattagtagaattatattagtacttatatagaattagtacttatagttactaatcagtacttatgctcaatttgtatttcactctacataaaaattaaaacttacagtgaaaattttactaaaatgtgtcatgcagttagtatcagggaaaaaagtaattctgccgcataagtcagacattttatatcagggcaggaaagaactctggaggataatgcaatgtaaccctcttcataactgtctgaatcttctctacaccattaccagccatggtaacaaccatagccagaggtggttatctaacctctacttttacctccatgaatgagaaacttactacctactcagatagttaattgcacttacaacagttctagtggttagaacgctcttcctaatattgaaccaaaatatttccccttgaaactttcaccttctggcccctactttcccttctgaatagtattatccctttaacaaatatatgctttttaaattcagcatttcagataccaagttgaacatactccagtctttcagctattacacctttggcatcttttaagtcacctcactgttcaggagccattctggtacatgattttcttcaagtacggtgcctagaaagtattactcctagaatggattggtacatgtaaagtggagaataatagcgaaacatgggtcacatgagctttttgggcatatccatacccacgcagataaatgctgtatgtcaacaaatatcttatttgtttaaacatattattaccgaggtcctaagtacatgacttttgtattcatccaactcatatcttgctatttttaggtattttttccgtgacttgacttataataataagttatacatcattattttaagaatcaataggcataacagttctttctaaaaatgtgttcataagctacacatagaatattcagagcaaaacaatctaactttaatgaatttaatgtttttgctcagtttaagtgtagaaggaagctaatccacttaataagacctcaggatacattgaatttactaaatactccacagccttcgtatagttttttttccaaatatttaaaatcctaatattagtttttcatagctttatcgaaatgtgtaactaagaagcctcatttgggataaagtatatactttatgtattttggcatttatcaattttgctttgtcaataaattttgtatctacaaatgaaatctgcaggtttcccacatgcttgatcaatgactagcaaactaataaactttcaatgcaaatagatgtgcttctaggacttgtagactgttataggaatcaccaacatattgatctacatattttaaccttttgacaataacaagagtttctaaataatttagcatgagcagaggtaaatacttttaaaaagtgatatttttaataacttgaagccaatgtgaaaatttgtaaattaaaccaaagtagtcacaagacccattatgctcagttgttttcttcaagtgcagtgcctagaactgaatattcagtatcacagagtgaactggtgaatgtagggcaaagaggcctcccttaagtattaaatacattgttggaaaaaacgtattctgagaattctcaaaacacatttgagaagcagtagtaaaatacaaaatgcattttaatatatattaattaagtaatttgtaaaatacaaaatacatttatgtctgtatgggtggcaaaaaaattgcattaacttttttgtgttaaagccttgaatttctttaagtgcaggcgcatgtttttatttgccaagttttttttttaatgaggatgtttcattactactttatttattactgctgtgacatctaggcaataaaagacaaagacagcctgcctgaaatttggctttcttgcagtttgtatcttgaatggggaataaagaagtccagtgcgtttacaacagaaacattctcaagtgaagagctgccccatctgtttcatctggtggcttatgcaataagaggtgttatcacatgaatctaaatgcacaagcggtcgttttatgaactctttctgtgctttgaggagtttataagttgcctactctattgtgtatcagtcccagctgacccaagtgcattctgctgggcatatttgggggataattagaactaatgaagcctggaatacagctaattctctaagtgatttattcttatgctcttctctgatccctaagaattctccaaatcataatctatgccacttattttttcctagcattgtgttgatacagctactttatgcttagctgatggacatcaaaagtaaattcggtatttgaaaggctgagaaacatgtttcaaagtaaaactttacgttacttattagtccccaggcttgagaagaatgccagttcttcaacattttatgtttttgtttaaatctcaaaatgtttatggcacttgcaagtagataatagcatagaaaatataaagcaataaaagctcattaaaaaatgtaccactgggaaatcaaacctacaagtaaaataattgaaaattattaatggaagtttcctatttcttaattaggtttcccaaggaaatctgaagtttaaaaaaaactttatgaatagctttcatgttccaaagctgtttcattaacctggcttcactgtcctagcagtgttgaaaatgatgtttctttacgtgccctcaccaagtagtcagtgattcagtggcctgtaacgctgtaaatcccatcaacttgctttcctttcctgttataactgtttcaatgagtggcacttttgttgtgcgggttcagatctggtagcttactgagggcacactagaatgaggacagacacaaatgccaacaaaagaaggctataactttattaaagccttatactcagtaaataagatagtggagccacttcagctaagtagttttataagctatgtcctatttgatcttctgttgtctagaaactatagtagaatttattaagaattgttagttttacctattgattccagtgtttaatatttaccatattctagagcccagataacaaaacccttaagggcaagtaccactttattagttagacatactgaaatacctgtactaatgtagatcaccaactagactgattatcaaccaaaggaccagttggagattcctgaatctcattacaggatacctaatccagcctcagataaattctagtcttaattgtataccctgacgtaagaagttactgtttctcatattttaccttctgcctaaaagtcagctaaacactcgaaaacatgtcttaggaacttgatgaaaagttgcaggtcatttttttaagaacatttttacatctttaaacaagacaaagaacaaattggtaaaattggctaaaactgagtttttgttatttgcaagttattctgctaggtgctttatctatattactgtatgtaccttcatcttctcaacactatgaagtagaaacttctggcctcatttcattgttaagaatctgaaacacagagaattcaagtaactcttccaagttcacaaagctaggagttagcagagttaagattttcatctatgccatctggccccaggctccagagtgtgctttcttagtcatcatatagaacctctctaagtttgtcttgtcatctgtagaacagggataattctgtgtcatagggttgttgcacaggttaaataaattaatacacataaaagtttatgtgttttaaaaagaatatttttaaacttatattacccaagaccacacagtaactagcaaagataggactcaaacccagctttttctatctccagacttctgagtttatgtagcatcatgcttaggtatgtttgttgaatgaataattaaatgaatatcatctgttctgtacttcccagtggaagattttgttaattttgctggttattttgatagcatatagcaggtactcagtgcctgaatgagtgaaggatttttcaaacaatactcgccaatataatatgttctatacattgatcactcttaaatttatatctctagccaagacctctccccttaatttcaagctggtatgttcagtggtcttctccacatcatctcacatatataagatgcatttcaaacttagattcccaattgagcacctgcttctccatcagtcatctgtacctcagtaaactgcagtgccttttttccggtttcttaggccaacaacatggctgtcatctttgactcctcgcttgcttgtgtacccaatatccagagtgtcaacaaatcctccagactctgcccatctctcaccaactttacagcttccatccttgcaagccaccatcatctcttaatttatttttggtgcccattatcctgtatgtgtactactggttatctgaggcaatatagaatgagaaaaagtacaaggaattatgctagggaacatagcttctcactaatattcctctgtgaggaatatgatccaataggaataaatgagaaggaatgttcagaaaagtaaggcggaaaactaacagatatgactatcttaaatgccaaacacaagagagttgtaataaaaagttagtggacaacagttcagctaccacatagagttcaaataacataaaaagttctttgtctttccacatccgtatcaatggaattgtagagacagaagcagatcacaataggattgaagagtaaatcggaggtggaaagtgaggtagacaatacactttcaagaaaagtaggattgaagactattctaagtgaagtaactcaggaatggaaaaccaaacattgtatgttctcactcataagtgggagctaagctttgaggatgcaaaggcataacaatgacacagtggagtttgggaactcagggggaaagggtcagaagggaatgagggataaaagactatgaattgggtttaatgtatactgctcaagagatgggtgcaccaaaatctcacactaaagaacttactcatgtaaccaaataccacctgttccccaaaaacctatggaaataaacaatttttaaaaagtagaaataaaggaaatgcaagagatagtatggtaattatgaagtgatgcaagaaaaaattttaaaggtatttgaacatatttagggcatagagaaagaagccatagaggagaggttaaagttaaaatgaaggactaaatcatggaggtctctctatctccaagatcagtagaaggaaatggtatcattgtcttgaggctacaatgagagatggcttttttccttgaagataaactctacacaattattaatattgcattttattttattccatatgtatttgtaacagtggagggtgagatgttgggtttaggataaacaggtggagatctgaaaatgtagcaggaagaaactgttgcattgtggaagataaatttgtagatggtggtttttaaagttggtggattatacaactaggcctcagttttctcttggcacttaaagcactgggactgaggtaagcttcaagaagggacttagatgtttaaactgtcactaaaaggaatgggagataacgatgctgaatcctgctttacctggcaaccctagatgaaggagaaaagtagatgtagtaaaatttctaaatagataagtgactgagatagcttaaacataggcagaatagtttactaagcggaatatggacacaggcatagactgctgaaatacaaagaaatcaaagaattttaagattaaggtacagaatagattgtctatatgaatactgaattctctaaaagtgattataagattctgggtggagagggaaagaattttggggaaagaagacccatgaagagtagaatgaatgctgttaagtgaatggaacaggagacaatctgagtcaccagagcctgcacaaaacaaacaaatgggcctaagaggggttgctgggattttggaagccaaaagataacttgatgaaatcctttgtagcctaatgctttgaatacttttgagagatttgataagcagttttatcatcaacaactaatgatatgggagtttatttaaatttattcctggagccagggaattcatagactcttattttaaaagaccctaacattccatatgaaagtgttttttaggtgtctgcccaagtgataatccactttagtatatctgtttccaatactaccaaagtgtccatcaggatattttggtaggacctagtcatatgttttatttgaagtatgtaaaactgccaaagatactttactcttaagtgttttcatatcatataactttctttagtttcccagtagagtgaggaagccctccattaggaaccagaaagcttgggttttagagcttgctcctttttgaatagaatatacaatctttattaatgagcttagtttcctgccctgtgtgatgaaggcattggagtagatgatttcccttctaaaattcattcagttctctgtattatttaactttgagatgagtacaaaatagcagcagttttacctttaaaggtgtatctcgtcatgtgcaacatataccttcctgaaaagttagcatatttttattatttgaattatatttaaatatatctgtgaatttattcttcaaaggatccttacaataaatcttttaaaaatgaattcattttataaatttaatgatttctttataatgtataatttcaaatttaaatctttagttattaaatatttttaaaaacaactctatatatttgtctttatgtaactttataaagggtataatgaatatgaatataaggaatacaaaaccaatgataagtaagaaaatagtaagaaagtaattaatcactttaaatgaattcatgacttcagggtactaacagaatttggaggtttgattgaaggaccaatcattgttgaggaattacagagacagtgagatatgtcagaagactagatgagagcaaaatattagagaattttgcttggcaccttctgatcaacaatggtaacaaaaatgtgattaagacttaagggaaaaagtcaagtctgcctcaaatcctgtgggtaagcaaataagatctaaatttttgaaaaataaatctgtagtctgataaattaagatgtattaggttggtgcaaaagaatcgtggtttttcccattacttttcatggcaaaaactgcaattacttttgcatcaacctaatatattgtaagccctagagccatcgctaataaaataactaaatagatgtagttaaaaaacaagtgaaggaatggcaaaagaaggcagtaaaggaggaagaggtgaacaaaaaagatatgaaagatacagaaaacgaaaagcaaaatatcagatgtaaatccaaccatatcaataatagcattaaatgtaaatggattaaacagtccaataaaaaatcagagacaggtgcagtggctccgtaatttcagctctttgagaggctgggatggatggatcacttgagcacaggagtttgagaccagcctgggcaacatggcaaaactccatctctacaaaaaatagaaaaattagctggatatagtggcacattcctgtagtcccagatactgaggaggcttaggtggaaggatcacctgagcccatagagattgaagccgcagtgagctgtgaccacaccactgtgctccagactggacaacagagtgagactctgtcaaaaaaaaagaaaagaaaagaaaaaaaaatcagagactgtcgactgaattaaaataaaaataagatccaactctgtgctctctacatacaaccagatgctgttaactatgtgttttgacccagtttaggttcaaagatacagataggttgaaaataaaaagataaaaaaagatatgcacacaaacagcaaccataaaagacctagagatggctacaataatatcagataaaatagacttttacactaaataaagccactacatacaaagagaaacactttgtaatcaaaaaagattagcttataggggagttataacaattataaatatatttgcacctaacaacaaagcccaatgtccataaagcgaaaacagatagaattgaaaaaagaaatattaaattatccaataatagttggaaacttcaataccccgctttcaataatgaagacaataactagatgtaagattgacaaggacatatgctcctcaatttacaagggtgttgcatcctgacaaacccatcataaattgaggagtgtattttatatgtatcatttttgcaccactgtaaagtcaaaaaatcataagtcaaaccatcataagtcagggcacatctgtaaatagaagactcaaacaacactataaaccaaccagacctaatacacatctgcagaacactcccaagaacagcaaaatttcttagtgcacatggaacattctccaggataaaccatatgtcaggccataacacaagcctcaataaatttaaaaggattaaaataatacaaagattttttgacacaatggaattaaaaatctttctacagttgacaaactgaacagcaaatactttggatgataggcaagattcataaatgatatagaaaccatgccatgtgacttgaaagaactgaggctagtgtacccaactaaggagtctaatttggatggtagagatggggatgaagtaggatataatagtttcctctaagaagcctgtcgtttatagcaaggagaatattaatatgtatacatgaccttccagaggacacaagtaagataattgggtggaagttacagcacaaaataaggaagaatattataactgtacttttcagttcagtaagatataggcagtattgtacttccctttttaaaaaaacaaggtctcattatgttgcccaggcctgacacaaactcctgggtttaagggatcctcccacctcagcctcccaagtagttgagagtgactagagtcacatgccactgtgcctggctctactttcatatattgtgttccttaaattggatttttaaagtcctatgtagaaaagccaaacaaggccaggtgtgggggctcactcatataatcccaatactttgattggctgaggcaggaggttagcttgagcccaggggtttgagacccgcctgagcaacatggtgagatcttgtctctaaaaaaatgaaaaccttagccaggcatagtggtgcacacctgtggtcccagctattcagtaggctaaggtggaaggatcacttgagcccagaaggttgaggctgcagtgagcgatattgtcaccactgcactccagcctgggttacagagtgagattctgtcaaaaaaaaaaaaaaaaaaagaatagaaaagaaaagaaaaagaaaagtcaaacagtggtttttaatagctgttcttctagcaaggataagtttaattcctgcaatatgtcttttctcaaaaagtcaaggagaagccttaataactggagcagcttggtgtgcaggcacctctaccgctcccaggactggagctagaacttagatattgaatcaggacatctcatgtctttctcaacaaaataatgctcccttcccccaaacaaatttaccaaactctaaatatattattgcacaacttccttatggtttggaaggaactttttcctaactttatcaaatctaaagaaccatgaagcaactctttctcctaagtctatgcttcagtcataagcactgtgaattacgcaaatagcttagttagatatgtagatgagttaaaaatagaatctgcaaaacaaaatgcagattgtacaaaaattaaggatatgatcaccagtccaggatcacctccaataggttatctcataagctgtgaacattgccacttaaagtgattcactcagggcctaaggaaccttctgtaggagaaattgaggaagtgcttatactctgtatgatttcatatacacatacaaaaaagtggactgaaaaatataaatctattttgccagatgttcttaacatttatatttatctgcattaaaacaatgtttttgttactggagagtggaattttcaataagattttaataagaaaaattatttcatttgctatattctctcagaacataaattacactgtagcagtaagttagactttctttcatactctggaagtacattttagcatattattcttccagtaaactacctgatatctatagagtgctgaagaagttagcagccagattatttggtttacctacaagagattaatttgcatatcagcaaggtctgcataaatctgggtgcagtatctttcagtcttttctctgttttgtaacacttgacccatcaatttagatagtaccttgcctgaagtacaaaaatgaggaagacatgtatattatctcttttaatgataggcaaatgaggaatcaactcttacaggtgtctgggagatttcagactatgtatttataatcttatttaatattatataaccaaatatttttatgcctttccactaattttctaccaaatgcttaaagagagtctatttagaataaaaaccacttgaatggattatttatattaagagcttactaaacattctttgtaatattggctattattttttaccttgaatgtgttgcttaaatttggactttttctcaaacactattggtattttagtggcaaaattatttaatggtagatgtttaacattggagatcttagcatgtattgatttgcacaaaaattctattctttaaaggtcatatgtaccaaatttcataaaggaaatgcattggagatgcttagtagacattttcttaggcactaagtattacttgcttataaggatattttactgtttatgtataggttaaatacttcacttgtaatgtccatcttgtaaagaaagtcctctctgtgttgaaaatctctcattgctaatcttgtttttttatatgtccagtaagagttaccaatatatctttcatgagctatggcaaatcattgataattactgttcaatttattcctccctaggcaaatgggttcctttgtagtacctaggacaagggatccacaggcaggagtcctctggcattgatgactgatggaataagccatagtgacacatagctactataccacatgagagcatcatgatttgtttattttagaactggttgtagcaatattagaggatgaaatgattttcttaaagcactaggagagtggggactacatcatcaggataacttaaagaaaagctgctcaaaaacaaagtgtcccagtctcttcaataaattgtattctctccttgactatttaatttatgcaaatgcacaatgaaaatatttttgcttcatatctgaatcttcataagaaaatgtatatttaaaaataataaaatcatatttttcagttatctacattaaatcttttattcatgttatagtttaattacatgatatctgtcttcaccaatggaaatgtaatgtgctaaatgctccattaattttttccccttataccttatgctcagttatgcctggtacaaacgacatatacttttctgatattattgatgaggtgttcatgacctttctgttgagatttgtgtggtggtgctgtttaaagaaagagtacttagtggaatttgtgtgaccacaccaggcaattgaagaataggtattatttctggccttggttctataacccaagttaattataatcactttaagaagaaaacagtcttgctatagcaagctgttttgggttttctttttctaaatgagagaaaattgatgtgatgctttttacattgcattttacagcaaagcataagatctgtttacctggttgaaattcaaattgttttattatggtgtcaattctttggttttggcagcacttctaaagtgtctattcacaaaaagactcccatagtgaatgaatgctagtgttgacaccacctaacaagcagggattatgtgtttacagaagaagtaatatgataggtcaagtataagaggcacttctcaagagcacttcagcacataatgagtgactgactagaaagtgcggagctgccactctttggcttggagtccgtgttgatgcctgcctctcttctccaaagctctcttgatcatgttcagctgctctgttctcatgtggggaataatagtagagtaaagctgcttttctgtctcatttttcttgctaatttacacattcaagccattttttgtttgctacccttatttgctattcccttttgtccaggcactgttctcttttttgcctcaggcctaagaactaatttgagcttctataattacttcatgttttacacctgtctgcgtatcatgcacccgcttgtctctgtacttaagctgtatatttccttgcagaaaagctagttttcatatacaaggactcctaagtttctcccctcagactgcctacagaagaaacacaattaaactgttgcgatatcctcagccatgcagctgacctttgcagttcatgaaggacaaatgaacgctgtctgctcagacagtttgtgttaagacattgttgagcagagagcctgagctttgttcctcatgaatgaagcaatggttgtagtcattttaaaatcattaagactctgaatgcacagtctcattctacagtgtttgctctacagctgctcttctgctttaatagcagcttattaaatttgggtcaagcgtactctgaagagtatcacaatgaagaaactgttctaaaagttacctgtttaaaaaaaggcaattgattagatttttaacttaagtgacagctgcaattcattgcctattctttgtgatgtcctgcagcccaagcagccttttgtaatttgggcttcattttgcaagagctttcctgaacaatccagggttgctttccactcggagcctgcttcaatccaattaggagtttaacaagggtcaaattaaagagactttacacttcatgtttgcatcattagccataagactgttatgtgagtgcatgactgtgtgtcagggaagagggggaaaggctgcaggatgggacagacacaaagctgtcatccaccgtgtggtgtgctcctttactgatggaggctcagcaggctagcaacaacatttccagttgtcttttggggttgctgccttgtcaaatcagctggtatatagttgtttggaggttacaggtgctagctggggctgataaagaagagtgttttttgcctactcttttctcttctggtagtctgttgtgattggacaaacgactgggaagacatgaagttgaaacctcttgagcattcattatttttgatgagatgacaactatctaggttcatgttctcactcctcgtgctctttcctggctcttcttttttttttttttttgaaaacataattgttggttctgtaaaatattatcataggaaatggaaactaatttttaggagaatagttagaggctttgcaaagaccagttacctgttattcaggaaaacagagttcactatagtattttcagaattgtgttacgtagaatagcattttgctccactttgtccataccatcaagatatatttatatttagccatattatgttactgtttaaagaaaatgacctgtttctaaaaagaagagacaatagaattctgctaatcagcagttccatgcgtgggatatcgctagagaactgttgctgtgccccttgagcaaagctttgtgctgctacacacaaagtaaagatttatctaaaataacactttcattgttcctttcttacctcctcaacccattaataggtactttagtatcatgagagttttcatagtttaatcccctttcaaaagcttttcagaataaaagctctaaatggtcctcagtattaatttgatgtgacttctgtacaatatggtttaaaactctcagaagcacatttttactgcttaccctttttcatcagagcaacgtgtggaaaataccagctaaatgtttagtggagtctctattgtgagccactgttgttgctttctgataacatagattttcaattaaaaaattattgtcattgtgatatatatgactgttaatcctcaagaatatttgggctctccatttttaaaaatgtaaatgtcttcttgttatttttcaaagctgtagttttataaagtctctgatttgcaaagaattgagagtgagtaataaagtcagcctggtaaatagtaatcaggcttgattatatgcactcagttacatctttgtttatatgtagaccacagtagcttcaaacacaagagcttccagcactaataaataacctacctcaccttttttatgtgatgcttttgaatacacatttatctttcttaaaacagttaatatatggtaaatgtaattcttgctgtctgtaaagcatttgatgatggaactatacattccatgccaagttccatttcctcgactcctcctgcaactgcaaagcctccaatatgacgggggcggggaacccctattaatccttttaaattccagatcccctctctgatttttttccacattgtcagaggggatgtatgtatgtgtgtgtgcatacatgtgtatatacacacgtgaacatccttccacagagaaaaaggtatttatttctaaaaatatttttgaagcacctgctagtgctagggactgagccagtgaaacagcagagagagctcaaacaataccaccttgcctgccggggctttagtggagtggagagatggacagaaatcacaggaaacaatgtaaacttacgactgtgaatgtgctcttattggggaatgtgatctggtcagcaagttcagagacagttttcctaagcaagtgaccttaggctaaccttttgaaaacatcatgctataaaaaatttttgtttattttctttccaaagaactgaaaatatttctgcatatgcttcgaactcaacaaatttacaaacataatgaaatttgtgctggtaatatattaggtaaaagaacatgtagaaaagggcatctggaaggagatataaataattataatttctaaggaaagttttaggctcagttttaagttacatttatggacaggaatgagcaagtgacttctaaaactattcctttttcttcattatattttccctgggtttttttttttcttttctttcttccacaaagttttttccatgatttatctgcttaccgtgtggaagcagattggaatcttccactagtgaatgaacagtgtgctgggaccagatcctctgggggtttgtgggtctgtacattcagtgacctcactatggtagcttgaaatctgcttatgacagtaggatctatacaacagaaattggtaaaccctgcaaattctcctcccctccctgcaccagcttgtttagcagcacatccgtgcttatgtctgatacagtacgtgggatttgggcctgcaaatagatttgggaaaaagagtccataacacagcttccctccatagctccaaaggagctataaatggaaactagaaagcttaaaatcaagttttggattttttttattaattaagttttatgagttttaaaatttagccaattatatcatttatcttttaagataatagccacaactcctccccatggattaagtgatgattacttttttaaatgattgtcttttgcatgtaaatgtttactagtttccagtgtaatcacaggcaatataaattcgaaggtatatttttaaactgcacactaatgacctttatcaatcagtctttatttttttccttataatgaattaaatgttgttgtgctttcaaaaccaatgtactcattggttttttctaatataaaagtaatacttgctaaatacttaaatattatagtgtagtcaatatataatagtataaaaaataaaattaaaattactgataatcaaacagcccagagataagaatttaaaatactatacattttcaatgtatctgtctacatataggtagatatataatttttatagatcatagtataaagattattttgtaacccacattattcacacaaaaatataatatgaacatatttctatatcaataagtattgatctacattatttcttttagtagctacataacagttcattgtatgaataccatatattaataataactaatcacctacaggtaaacattttttgatattttctctattttaaatactgtataattttgtaaatactcttttgtatacttgttcatttaccaggatacatttcttaaggtagcattgctggtattgagaattcatggtttgtttcattttgtttttgaggcatctatacaaattgcttccaaatttcccttcagaaattttgtactaatatgtaaaatagcatattggattatttatgttattgctcctttgtcaatataggtattattattcttatttatttttgttaacctgattaactgatcatcacactggttttaaagaatctaattttaaaactatttcttcgtgctctatagcttgtaagcttaaaattgacttcagtatattaaatgttattgtattatttttcaattttgattattccctaagagaaaggaacaaatacatgatttgaagtgtgcaaaatttatgtaaaaatatgagaatacagttttacatgaaagacctgataaaatatatattatgctatctaggaagagaagcaattatgaatattcatttacagttggatatttgagatatttcacattcttcacatccattcatgagtgaatatttgttttagaggaaacattttggattttaaaaccagaatgtggagtatccctttgtagaatgttgccagctaattgaagttacaaacaacaaaacaaccaaaaacactgcaatccaagcaaagcgtatctgaagcaaaatttggcctaaagcctgccagtttacaaactctgcgttttgtggctttcttcctatgtaatataatacacatctaaccagttcttaactaaaactgtttctcttcctttccctgaaaccttagtaacacctacctgtttagattgagcatgcccaacttggaggctgccacagttgagaccgttttgtctcatctcacacccatcccacttcactcttggacttcacttgactttatctgcagttgctgtttttgagtatgtaaagataaaagataaaaatcttttcatttacttatttttctttttttctgatattgttaatatttaagtattttatattgtaggtaggagggaactttttttttcctcttttgatacacggtctcactctgttgctcaagctagagtgcactggcacaattatggctcactgtagccttgacctcctgggatcaatcatagctgggattataggcgtgcccccatgccaggctaattttcttatttttttgtagagacagaggtcttactatgttgtccaggctagtctcgaactcctgggctcaccaaacagtcctccccgcttggcctcccaaagtgctgggattacaggcgtgagccactgtacccagccaatatgtttttcatgtttaaatgcaatgttgcttattttttggtataaaataaaaatgctacgattatcggaacctcatttgtatctcagtaaattactggcttgtattaatttactgcttaaagtaaatattataaaatatatattattttaaagaatgtgggcagaaatcagaattcaaaataacatttttaaaagaggctatgccattagcatacatactgagatatgcatttatttaaaacatacctatacttgtttggaatcatgcttactatgttcatatgaatccaacattgaggtaaaaactggctttttaaaaaaaattagttgacaatagacatatagagtttgagtttagacctataaatagctaactattatttcaatgatacgtatttggcctttgacctttgttgcttaaagactagctcacgatgctccgcagttaatgtaaaacttagttaaaccatggcgacctattccggagtatgagaattggaagtgagaaatggaagtaagaattctgaactgggagtgtaatcagctgtcactgtttaaatagtccagttttattatttctccttcaactcttcattttttcatgtaatgagcgtaaatacggactttttaactgttatattagggatacatctatgcctaagctgaagcctgaagctatattttaaatttgtgattccatcttagaaggaataaccagagtacaattttgaagaaataggttaaaaatgcattcccttaataactacagttttctcctcgaaaaggttaatgtagtaaaataaatactatgagaggtatccatgagttttaatatctggaaatcttttgtgtgtgggacattttaaaagttctttgtgttttaatgaatattcaattaattgattttaaattaattagatttaaagacagaaagcattctactttagtctgcatgttcaacttacagatttgattttactcataaatattttgcatataaaaacaccatttactttcaattaatcttcaattcaaatttaaataactgataggtttgagaaatcaaattcctttaatcacttaacaccagatccatactaattcatcagattctcttatatatttccaacttcatctattaaatttatttatttattttattttttgagacatgttctcactctgtcacctgagctggagtgtggtggcacgatcttagcttactgcagccttaaactcctgggcacaagtgatcctccagcctcagccttcagagtagctgggactacaggcacgtgccagcacactcagctaatatatatatattttatttttgtagagaataggtctggctttgttgcccaggctagtcttgaactcgtggcctcaagtgatcctcgtgccttggcctctcatagaactgagattacaagcgtgagccacctcaaccagacccatccattaaatgtataaatctgatttgttactatttacggcagtagtttaaatacttagaattttttttttaggtttataagtctgccttatgttttttaagtgtttgagaaatcaaatgtattgattcagcaagagtaatttgaaattcttacaaagaactgtgatagcaaaatgctatagttaaaacagcccaggggtcaggtgggttcgtgttctgtccgtccctcactcattcccaacaacacagtcaaaagataaatcctaagtaaattaccccacaaatttttgagttagaatttgtgataaattatttcattgcaatttttcaaaataaataaagcctcaacatgatttgtcacaagtcatagagccagttagaagaactcaacctagggctcgtttgattcctaggtccatgttcttaactccaaaccatttctcaaattatagaaccattgccatagagtttgaaggtattttctaagtcatctggtctaattctacattataggactcctttcttgaacatcccttttaatatccatccattttgaatgtttatagcaataaggacctcctgttaatttttccccttctggctactgtcccccttgtcccccttaaagctatctccaatgacttctttctttctttgtcttaaaaccacttaacataggctttgcttccaacacttctctgaaaatgcttttgttaaggtcaccaatgacctcccttttacaaaatccataggccaatctctattctatttacataatttatcataccctcatcctgaattgaaactgaccttcccttccaggatgccctactcctgttctacctcactcgcttctccttttcagtcttctttgccaaaattctctccttttcttcaaccacctaatgttggagtgtcccaaagctcagttcttggacctttttttttctttttacaattactctcctggtaatcttatggcttaaatatcctccatatactgaaaactccaaaatttctatttctagcctgactctctttcttgaacttcaggctcttatattcaaatgcctacctggcatttctgcttgagagtccaatagataaaccaaacttactttgtctagttttgaactcctattttcttttccactgcccttcccaattcccaaaatattgctgtacctacagtctttcttatcacagttcctttcagctctttcaatccagttgttcgagccaaaaccttggagttaatttgacttctctctttctctcacacccaacatatacagtctcttagcaagtcacattatctctacttcaaaatatatccagaatttaacttgtcaccatctccatggctaccatgtagataagcctcttctgggtattctttaattttgaatgcaccccgtacaatgaaatactcagaaatggcctgattgaacgtgttgcaatggaattgctctatcccttttccatcatcataattcattctaggattgtaaggatcattttagtagtcatgtcatggtgttgactggagtcaaccaaagttccagtatttcttttatattaattgctgctagataggtatcaccatctaaaataattaagtgactatcacttgtggagcacctacatatgcaactttgtttcattattacccttaaagataggaattattatctcaattggtagatgaagaaatagagactcagaaaagctaagtaatttgcttaagatcacagggctagaaattggtagaaacggtagtagaatccagacctgtttcactttaaagccaatccttggaccatcacatatgaagggctgcagatgagaaagaacatgatacactcaaggatttgaaaaacatgcaatatattgggaaagtataagggacagaatgctggcaagaatcagaccagagagggaagtgctcagttttgagggatattataagccatatttgaggagtttacattttactgacaaacattgggaaggtactattaaggtatttcaagcagatttacttttctaattaatgattactctaatgttagcatgaagaatgaattggatgacaacaatgctgagttttaatggcctaaactagagtagtagcagtgaaaaaaacagaaattgatagatcaggtggatttcaggagtaaagtggataacatttgtgaactgactggatgtgggaggtgagagagaggatgactgccaggtttctggctgagtggttgataacattcattcagaatgaccattggaggaaaggaaggtagtgctggaatgggtataggagatgtgataactttacttttggaaatagtaaaaggaatctaggagacatttcagtggtaatacccagatgacatctgatctaggatctaggggagtggaggtctcagctgcaggtaaatctgtgaggtaaatctgtgagacatcagaacatgggtggtaactgaagtcacagaactggatgagttgaatggcggattgtttggagattccatggctaaactggggctccaatatcagagtgtctagcaatcatgccctaatgggaaaggaaggggagctggacatgagtgtctactgtgtgcctttcaatggatatgccttttacctgcagatggcctgatgccttattgtccagccctgaccaggagtccctcccatgggtaactgtttataatggcggatgccattgtgtctcttgtctgacctgtgtctggcgtatgcctgcctgaccgtggctatggttctgcaaacccaaccttgtggttcccccttgcatcctagggaaaagccagctggtagctggctggtagctggttcttctaatgaaaggcacaaattcgatacaccgccacaacaggaaataagttcagaaagctgttacttatagatcctgggcagggaaggcaccatgagtcaggagggaagttctctgtcccaggtcatgtgaggcaggtgtgtagagtcagagagagagagagagagagtgagcgagtgagtgcttgcatggaaactagcagtatatgtaagggaatgggggcaggagagtcactttaagttcgtgggcaaatgtatgaatggtccatttgaaggaaatggcaaaaaagctaagagcccagtctgctaggccagagagaggcctctaagtttttgtatttggccaccggcttaagccatttgtggtgttctacttctagtacctaggcagcaacctttgctgtgttgtttccattacaaagatgccagtcttttaaagataggaaggagttgtttgcaaatggcatttaaagaatagatagagagttagtgggaaaaaattaggagagtggtagtggaagtcaagaaaagcgtttcaagaaggatggactgaccggcgaacagtgccaaatctgaaggggtcagctagatagggactgaaaatagccattgaattgaataaggcgacagtcactatgaaaagggttgtttcagcagattgtcaagggcttaaggatattaagtatttttcatttttcaagctaaaaggggagctcatttcagtttattaaatttcatcttgcagacttcaagctaacttctacttcatgattttgaatgtcaatagatctgatctgaatatgaaattctgaggaagatttttccttatagccactaactgtttattaattattctcaacatacttttgaaaacatttgaaatgggtttgtatcagaggtgactccagaatttctgtgtagaggagattaagactgtgagcgtttgaatggagaattgaaagaacaatccatggaacttgtgtgtttccatggcctatattacaaatcaagaaaaacagtgaggtgttctagagaggtttttattcacaacttaaataagtttaaggaaggacacatgcagcctcatacaaccgctctttcttctgtcattcttgacatagttttgcatttttgtagcatccatgacatgaaaataatattaaataccttagtgtccatttatattttgacttaatttttcagctctgttgttctgacctatctgggtaaaagtaatctgccttgtgttgtaagtgttaacactaagggcctgccatgcaccagccacctcgctgggatgtgtgaggatgatgtttagatagttcttgcaccagattttttaccgtattacacgttactgtctgttttttgactcagaaaaataaaatcaacttgcaaaggaataaaaaagaaggaagaaagggaaagcaaggtgggaaagaaggtaaaagagggaagaaggaagtatttactgagcatctgactaggtaccaaacattatgctagaaactttcatgtatagtatctcatttagtccttacaattttgttaggcactcattttacagtggagaaaactagagtttgagaaagtccagtaagatttattaacttatctaaaagctatgtaggaagtaagaaataaagctgagatcttattaatgtccagaatgcttgccaccacacatcatgccatcttacctggaaaattcattttcctcattttaatattttagtcctattatgacttcttaatggattttcagataacataataataagtagaaaacatgaaaataataaaatatggtggattataagtacatcattcaagtttgctattgaaggaaatgtatgtttcttttaaaataatgtgatccatttaaatatcagcaatcccaagtaaaaactcaaataaatactcaagtaaaagcttgggctattcctgaaaatcattgttagttttgagatatatttattcacatagtcagcctgcaattgtcaagcaatatagcacaggaagcattgttcaagttgctgtggaatacctattttattctctgcttacaatgactggactttaaagaatttttaaccacataaggacttttaaaataatgtatttattggtgattatcaatatataacagtatgttgcatatataacatacaactcagaacacgtaagtactttaaagttgacttaaacctacaatgaaatattaagtacagaacctattacagatttttcgagcaaggaacccatttgacaaagaaagaaaaaataatcactagcataattattactggatttgttatccacacatccagtatctctcaaccctcatcaggtgttgattgcaatgtatatttttactctaaagtattctatgcaagtagatatctctctatatatgcagttagcaaagatagtcaaatatactgctattagtaaggcagcattacactgtatcatattacctatgttaatacactcttcaaagaagttatataatgttttaattttttaacttctacaaatattttttaaattatcccatatcttgttatttgtaatataagaagttaggtattgtgtattgttaatatagcagttacctcatttatttacctgagagtactgtttgcaaataattaggagaatgacaaaaaagtatggttggaaattgtattatctgtcagtacctctactgaaagttgtttttaatgtccagtggagatgttttgatatttataattgactctactttgtttgcttaaagtatgttttgactaagctatgcagtgactatttgaagatagatattctattcaggaatttttaaaacctcaatgtctaaaagaactcatcaaactcacccgtcttgaactgtcagtgaaagcacatgcttttaatttctaacacacattagttgtgtttgcactacaggtacacaacaggaagtaaaatcgtgaacccatagcttcccagtatcaattaaaatcttggctgcatgaaacagtattttttgaggattacctgatggttgaagggttcattcattcctaaatattctgtatcctgggattaaacctgaatagcagaaactgtcaacctggactttcatgttggcccctgttctggttaaaatctttggttgcatggaataggcttcattcaagttacctcaagcaatagatgctataggtatatatggtctggaatttaaaaatggaatagctgagtcagctttagggaccaactgctctgtttgtctttcataaaccatttggtctgctaatctctgagcgttcttttcttcttctcaacagataatcttcctgtgcttactcaaacagctttggttccttgtactttcagcttgcctgagtcttatcttggctccctggcctctcagtacattgtgatatttcagcttcagttcctactgccacacagttctttctgcatttcctttttctagctctctacagaaagaatctgactcattctactcctattttttagtcaggccaaaccacggactattggcaaacctctggattagctgtcgttgattcagcctagaggaggtaccttgcggtcctcataggtcgacctccttccacaaaaactgtggctgagcccatttctctcagaaggcagctgcaggctgtcttgtactacctcatggtaggattgatttttctaagttgtgctttgggaaatattgtaagccttgaaactcagtgtaaggttattgttgaagacattattgattatactatacaggtttttttaaaactcttggcataaatttatttctagctttagtattaggaaataattgtgcaattattcctgaactcgtttgtttttatcttcattacctttgtggtgaaattattacttttttcttttttttttttttaagatggagtcttgctctgtcacccaggctggaatgcagtggcgcaacctcggctcgctgcaacctccacctcccaggttcaagcgattctcctgcctcagcctcccgagtagctggaattacaggcgcctgccaccacacctggcaattttttttttttttttttttttttttttagtagagatggggtttcaccatgttggccaggctggttttgaactcctggcctcaagggatccacctgcctcagcctctcaaagtgctaggattacaggcatgagccaccgtgcctggcctattacttctttttcaacattgcctgttgggagttcacaaatttgtgccccaaacacaggaagtttaaatgattctgtggtatgcttttttagtcttattatccaacttacacctgaattcattttctgtttttcacctttttttaaatatatttctaatttgaattataatttatatattcctgtaagtcactttatatcttttcagaagtgaggtatagatgtaaagtatataaattataacacattcaggaacatgttcatgtttccagctagtttttagttaaatgtgagcaaattttaaagaaatggacaaagtattggaaaataatagtatgtgacatttttctgtatttaagtaattttaaatcatccagctacttttttaaaaaaacctaaaattcccattgggtttagaactatctttcaaatataatttgagattagaaaatctattttattacacattaatcattttttgtcataactatttgtaacatattctttgtcatggagaaggtagtagaagtgtaataaaattaatatacattttaaattatttctacataaacccgtttctaaaacagcagcctctagccctccaacaataacatactcctaaaattatttttccccagactctacttcttggctactcctttagaaaaaaaaaaaagaaactgacatcaattttatataaaagaagcccttgaggtggaaagttgggaagactgcatgagtttatagcggacaaaatgtcgcttacattttgctgctcagtagtttgatatactcatttgctgatgtgaaatgacgagggcttacaaaacagggttttgttttttagctgcctgtagacctagtggggcctaacagaacccagtcagcaggtcattaactctggagaaaacagcttgcattaatatgctctaatccggtataattagtcaaattactgcacgccgaccagcttgtcatgtgttgtcagacttggcatgtacgctgggttgcctgggtccctctggaatgccaccctcaatcagaaaaaactgctcatttgtagtgggtcttgaactcttgatgcaaaagcctactaaaatagtggtcatagaggaatttttattaatttttgagaaaaaaatattttcatcaaaaataatttagtactttggtgattgaaatggaatctgttcatttttgctgttttctgtaccatatctatgtaatactccaagaaaaattaacattagtgcaaacaaaaaagaggtcgaaaataaataattaccggttgatcatttatcattccaatatatggcagtgtgcatttgtaggtgtttgtgtatgtgtgggtctttttccagtagggtaagaggttattaaactctaaaagggctacattagcataaatttacaagagctcttgttctggcggcatgacaaaaacctgtgttacctttgcattaacactgaattgcttgttgtgcttttggcaatgacagataagtccgtgtaattccccattgcaacagaaatgatgctccagattccaaacgcatcctgaagatgtcactgacaataatcttcaaagaacgggcagtgaaagtgggctgtatgtttgtaggatgatatactgcaaatgacaggaagaattatgtgagtgaagacgaatctgtaacatattattaagcaatttcacgagaataacagggataaaaggataatggatgagggtgtcattattaccttcatgtagagggaaagcaaaagcaaaggtagagagacaagattaattgaggaagggtgaagcattcattgctcatcagctcttttgtactctttgctcctgaaattccagactgaggaggggaaaaggtgctcagagctgcattttaatgcatctggcaaagagtaggatactgacaaggcactttttagccacctccctttttatcaaaatacacataatgactgttaccttttgaatgttccaaaatcacagcaaaaattcagcagaaggttttattctttgtgtatatatgtatgtgtgtttggcagctttgattattaattaagcttttaaaacccaaaattataaaataccaaaatggttttttccatgcattgccaaaaaattgctattttcaatttagagaatcacgttctgtgatgaaacatttcaaaatccattatattattattttgattagtctgaggacattgtgttaaaaaggcaatatattttataagcagtttttactctccattttctaagtacatttccctttcatgtagtaactggttttttttttttaaatttaaatatattttctctttgttaaatgaagggtgtgagtaattaaaagcttaaaatactaaattctccatttatatcttttttaattacctgtttcttataacttctcattgggccaattactccaaagcacatattatatcacacacaataagatgcaattataacatagcaaccactatccttctggttgcagaatggtggtaacacaggtgttttgctgtaatctaagaaaccttttggggcatgaaatcccttctgattataatttactcatgatacggagttaaccttaaacattgtagaaactttaaattatatatatgtttctgtgtgctggactagtagaaaaataaaatgatcatattacaagcttaaatatgtatccaatggagatactcactcaaagattaatttgggaacaagaagcctacatttcatccttgtctacatagcaagttcctatattcaggaaaggtaacaaaggattaagattcaggagtcagtcagaattgagacccatgcaaggctgatagccagataataatcaagagtgtaatgtgtatcatacacagacatgcatagcagtaatgctattaaatgctacacgtatataccatctagtaatgctatattttattgcatactgtctctctgtatgcctataatgttttatccttgtcattttctgattagcagaactagaatttccattttagttctataaatgggaaatttgaggagcagaaaattaaatgagtctacccaggtaattttatagtaaatgatgcttctaagaataaaaccatcttcagatacctcatccaatctacattccatttgctgtttgattttttaatttgttattcatgccacattctgttttttgatattttgctagttttgatatgtgtcttttaaattatcttaaatgtttcttcactaaaggagcatcctctgccttatcttttctgtagagtaagggaaaagaaactaacatttcccaagtacttaatatgtgtcagacactgttctaggcactttgtatatattatctaacttaacatagttataatagctaagtgagttagatatcattatcactgttttacaaaggacaagcaaattcagagatgtccagttatttctccaagctcacaactgggaagtgttagggattcaaatctaaattttcctggttccaaagatcatgttctttcaattactacatactcacttactcttgtctatcctatatcttaacatatacagtcaaaattatactgtctttttacatctatcccatgttttagatctccaaatgtctgtattcagtggcctttttctgcccacatattccttgatttctgcataacatttgacactgagcttccgaaatcctaaacatgcttccttgccaagtcctccgctccccttccctggccactcttccgtcggcctcgccctcaatattctcccatccccaaaggtatgtcctttcagtcacctccattctctgccatagagatctaattccttttcgtgctttaaactttcactgtgtacagataatcccaaaggtacttctctagtcttgtcttccttctacagctctatattcttagctgcctgctctgttgattagctcttagtatgctttgattatctcaaccaagctcataattttccttttttctaatttccttttaacttcccaattttaaaagatgtcgtgattctaatcacccaggccttattgcccatttgaattacttagaaattctttagctcagcatcagaagcctctcccacctctttagcctattggagtttatctcccatctccatctttggcagatcaaccatccttcaaggcccattatcagatatcatctttagtaagaggctcgccccaaaccaatcaaacgtgtgtatttctcacatctttgaatctccaatcaatttgtaccttctactatatattttattgtagtttgtcttttattatttctatagttgtctactcacttccttagacagtaaacatcttgaaggcaggaaccattgtatcttatacacatagtacttggaataaccttacaagatacttaataaatatttgttgaattgagttaaataaaattatctgacagtctcaatcaagtatttttaaaatattttttcttttacatgaaaaagcctttactatgttgaaatttaatattaaccttttgattatttgacactcttgaatgtattttctttcctaatttacatttatacattgcaatttattatcataatagttaccatttaatgagcatgtacttcccttggtactttgttaattccggatatatggaggtgagcaagtccctaccttcatgaaggtcactatttccttgagaagatactgctcttttcatatgacatttcataccaacagtcctttgtagttatatgtatgatatatggaaaaaattaaaaagagaaattagagcactttattatatatttagatatatcttaatcttaattatattaaatccttataacaactataaaatgtaggtactatttatccccatttaacaaatatggaagcagactctgagagtcaaaggtactttttccaaatcacaaaagcagtaaaatggcagagccggaaatggaattaaagatggtttaaagccaaagtctgtggttttccactgtgccacatggctctgcatatccttgtcttagcaaagagatgttacatgacaggagctcttaactgtaactcctgtatttgcctcaaactagaggaggcagggaacattagtcataattatgccagacgatggttagaatggtattacttgttaaacttagggaaagcataccccctgcagttttataaaaggaaggaaaatatctttctacttttgtgcaaaatgcccaatcaggttgagcacacatggttgccctacttgctagcagcagtcacaagatcccaattattgatataatttgggtcagagagaatgttttctgcatcctaccgagctttgatttggggcggtgtggggggaaggttgcaggatacctcatagaggctgacactttccactgcatgtgctgctgtgcagatgattataagagagcaattcttcattcaccataagtccaaatcaaacgtagaacatgacaaatagaattagttcctctcttccctttgcattaagcaaatttgatgcttcgttgtgaaaggaaaaagcaagcaaacatcaacagattgactaatacaattctacttagcctttcaagcaatctctcagactgcctcttatgcctacgtgtctctttatttattcttttcttcttgttttttaactccaaacttcctttatcaagacttcttttgtcttcctttcctgtaagctgtttttaaatgtattctttgttttggggaaaagtaaaaattttctgttggtttcacattacccaaatttcaaaattctagtccacatactcatacaaaaaaatgatactcctaagttttagataagttaggatttctttattcaatttcttgcatctattagatgattctaattttatgtttcaacttataaacttttaaaggtgggatcatacaagtccctttcattgaccttattactacccatcatggtgacatacccaaatgttcatatactagtgcttttgattataaagattttctttttattttcagattttctaggcattcatgaaatattagtttcatttattttttaacatagttttggccttgtaaatagcattcagtgtaatgtagacatgaatatttcttacagaagaaatgaagagtataattcatttattttttttaaattttaaagggatacataataattatgcctatttatggggtacatgtgatattttgatacatgtatacaatgtgtaatgatcaaatctgaataactgggatattacctgaagcatttatcatttcttgtattgggaacattttgaatattctacctattttgaaatatacaatacattgttattaactatagttactctgctgtgctattgaacactagaacttattccttctatctaactgtatgtttgtacccattaaccaaactctctttatccccacacctccttcccatcctctggtaactattactctactttcttcttctttacagcagtccccaacctttttggcaccagggatgggtttcatggaagatcattcttccatggacccagggcatgggtggggatggtttcaggatgaaactgttccacctcagctcatcaagtattagattttcataaagagcatccaacctagatccctcacatgcgcagttcacaacagggtttgcgcctgctggcccatggctcacctcctgctgtaaagcccagtaccagcccatggcctggaggttggggactcttgctctataagatcaactgttgtatatttgtctttctgtgactggatttgaagagcataatttaacctggtgatttgattaggtagaagccaagcctaaggtgcctactatcctagtatcactatagtcaccatgtataataatacttcagttaaaaaatgccttgagataaggcaaccatgtctcttcctataccagcgagattctaacatttcctctcattagcactgagaaagtttttataggataagggactggagagaggttgagaaggaagatgtgccagtgctgatgctagcgaggaaaaggttagagtatccagggttacaggagcatggtgccaaggacgtcatgccacagaaactctgagggacaccaaccaagtgaccagtgatctctctctcttttttccaactagcttcaggaattgattcccctatttctctcttccagtactattatagattactttcacccagggtttcttttccttttgacctcaaagaggaaaagaacacagtcttctggcgtctcacaactgtcctctccctttagccctcagactcctttaaacttctattggaaaattctaagtctttatatcacttcattttgagagcttcttcttgaaacttatgtatgacatactataaatgaaacttttttcggacatatctttactgatgaggaaaatttttcattgaggaaaaaatcttttattccctcacatgccttctttgtccatagagaagaaaattccactcaagcttttgttgttcttcccatgggaaggaaatttctgctctcattttccagagcattttcattgctgggtgttggaggccttgttttggtttcaaatcacactgaattgatcaagtcttcccaggataaccttgcaataagggaggataatattagatattaattttattaatatttatgaataattactatttaatattatagtcattactattaatttttatgaaaagttcctagttttacatctggttattgttcccctgatgtacatttccttagtcaaaaaccctgcaggaaaaggcaaaatgcgataggctttaagcagcaaaatttcacccacaggttctaattctgattccattattattacaagtatgaatattcaggaatcatttggttgcaagaaatagaactcaaactagcttaatgtaaaagatcatttattttaagcaataggagtagctcatgaaatcccatgacaagaacaggcagaacctgaggagagactggaactgaggattggaaagccatttgtctggatgtctccccttctgggccacgtggttctttgtctctgcttctgcttcatcgttgtttctcctcacagataagatgtccctggatctccccgctagaaacccaaaagtcactgcagggacattacagagactgcaattcactgctgctccattaccaactaaagttccactttcaaattccaaggagagggaatttggttggtttgcctcggcaacaaatgttcaccctggtctaaatcagctctggtcagaaagaagtagggacacacctctgagagtatgggaaagcttttttgagaaagggggcatggttggtacatacattccaaaaagtctctcccctttaactattttggttcctcctttcctcagtatactattcagaaagaagaatgcgcaacccagtttggagaaagataggaagattcttaaatatgaacccatcaacagggagtcagacagagaggagcaggacattccatacagatagaaggaacagtgagtgcaaaagtacagagaggcgaaccacttctgagaacagcagggattcaaggggatgtagagcagtggtatgaggggaacccagagatggatgctgatactcagcagcagcatttgctataggatgctgggggtggttggctgggcacggtggctcatgcctgtaatcccagcagtttgggaggccaaagagggtggatcacctgaggatcacctgaggtcaggagatcgagaccagcctggccaatatgatgaaaccctgtctctactaaaaatacaaaaattagccaggtatggtggcgcatgcctgtaatcccagctacttgggcagctgaggcaggagaatcacttgaacccgggaggcagaggttggagtgagccaagatcacaccactgcactccacactccagcctgggcaacaaagcaagataccatctccaaaaaaaaaaaaaaaaaaaaaaaaaaaaaaatggatgctggggatgggagtcagagtctggaggcaggggcattggtaagggttgccggaggttagaaaaccactaagatggggtccccaccctcccctgcgacggtaccagtctatggccttttaggaaccagggcacccagcaggaggtgagcagcaggcaaggaagcactgctgcctgagctccacctcctgtcagatcagcggcagcatgagattctcataggatcgtgaaccctattgtgaactgtgcattggagggatctagggtgcacactccctatgagaatctaatgcctgatgatccgaggtggaacagtttaatccccagaccaccccaccccctcaccccctggtccgtgaaagattgtcttccgtggaacgggttcctggtgccagaaaggttgaggactgctgctaagagacttacacagctttatcagtgaaaataaaaagaacagatgtgagaaatactgtggagctggaatcaacaggattagccaccagttggacgtagaaaggaaatgacaagaatatttacagatgagtcccaaatgtttagtttgatggctttatgaatagtgttgccatccactaagataatgacaaaaacttactattattatagtgaccaccctttctgagtacccattatatacaaaatactgtgccagaaacctttccatccactatttaatcactctattgtccccatgattgatattattttcactgttttatatataagaaatgaaagtcttcaagaatttaggtatgttgcctacattcatgtaactcaaggtacagagttaattctcatgcccatttctgacatcagaaccaccgtgcacttgggtttgtttttcttaagaaagaagaacagattttaaggaaaatagaagttcagtttggacttactacattgtgtttcctgtgagacattcagctggagaggtctagtggacatttgactatgggtctgcaacttatgagcagtctgggctggacccttcgatttgagagacagcagcttaaagtgggaattatgagagtggcagaaatcactcaggaggaggaagctgcccaatgagttactatgtaaagcatacgcctgcctctcctgggggttgtttgacatcataaatacactgacatacaatttttcaaggcattcactttcaattttaggaatcccttctatatcagttattatagccctgctttttagatttgtactttttctctctcttttcaaaaatatttgccagggatttgtcttttctgagaaccagtttttagacttcttaaattttcacttttaaattttctaatgatttttctatttattttagctatatttccctctgcttttttcctttgattttttttctgcttttttaagatttaaattgaattccaaattcatgaagttttctttatagttgtaagcatttaaaagtaaaaacttacattggctttctattttcatcacatttcatggtaatgttttaaatattcaccatttcctaaatgctctattactgtgttcatgcctaagacaatgacattaacccaaatgaatctaattggtaggatatctttggtaataaggtctttcttggggcactggaaagaggataatgtaaagcctcacattgctccctctagattctataccacatgttacccactcaactcagaatccataaggaagagctgtgctacagactcaaagaaaaagaaaaagattcatcctctcttttcgagtatgtttcaaaacaccaagtcaaatcttttggttaagttccaaaggaaaaagtcagcaatgaacattgtgatctgagtgaggataggagctcggggagtgcctccaagcccttgtactgcctttcccatctgtttttcactttctcccattcccccaagtacttagtagagttttccattaagctccactgaactgagccattctcagcaaaataactccacaggttatttattgcggttcaaataagttccaaatcaaattctgtgtcattgaatatcatttttaaattccttcaagtcagattggtatattacattgagtttgtcatatttaaccaacaaactaaagctaaacattttccaaaggaaaaaaacaaatgctgaaatacaccacttggattttatttaatattatttaaaataacattaaactagaacatgtggacataaattctataactaaacttactgatttatgtatcatagaaaagtaataaaacaactctcttctaaataaaggcttatttacacaatgttaaatggtcagaaatacagcacttaccaggatgttccttgtcagcacacaaggtattgcaagaatagattacctggatgaatgattcagaagccttttatctagagagtcaatataataaagataggacatagtgtattctggtccccattgtggatcctttttttaatttagagaactaaattgatgtcatttacttagaagaatgctcaataacaaaatgtattactttatccttttaaatgtcctaccatttttcagagaatatttaaagcaaactaatgcatatcagaaataagttatcttgttactgtcaaaggatattaaatgtagttgcttaatatatttacttaccttgctttagtgcctggtatatcaaaccattgaatgtcaatcaagatatgcattaaatcattatagagattagtggtaaatattactatattattaaaataaatttgaggccaggtgcggtggctcacgcctgtaatcctagcactttgggaggccgaggtgggtggaccacctgaggtcaggagtttgagaccagcctggccaacatggcaaaaccccatctccactaaaaatacaaaaaattagccagtcgtggtggcgcatgcctgtaatctcagctactcaggaggctgaggaaggagaatcacttgaacccagaaggcagaggttgcaggaagccaagatcgcgccactgcactccagcctgcatgacaggagcaagattccatctcaataaataaataaataaataaataacaaataaaaaacaaaaaaacttgagaaaacattcccatatttagagggaagtgtactctatatgggaactctgaggcaggatacttggtatcttagtcttttggggtcactataacaaaataccttagatcaagttatttatagacaacagaattttattgcttatagttgtggaggctgggaagtctaagaacaaggcaccagcacttttggtgtctggtggaggctctctgccttatacatggtgccttgttgctgtgtcttcacatggtggaaggggaagagggtttcccaagcctcttctataagggtactaattccttcccaaaggccccacctcttagggattacagattaggttttagcatatgaatttcagagggaagggagagacacgaacgttcggaccatagcacttggattccagtctcagctctcccagcatttagactttttgtgaccttgatgaaataagttaacagttctaagtctttccttcctcgttggtaaaatggggatacaaattcttgtccagcctatcaaaaagtgattttgtgatgcttaaagttgaatatttgaaaaatgtgtggtatgtatatagttatatattaagaacttctacattttgttttgtagatattttaaattattttgctatgaaacggtccaatcagtagaaaaaccaaccaatgtcatgtactcaactgcccaactttaacatttcataaaatttgatatatttgcttctgatcgtttttacaaaataaaacattaaaaaaatacaagtttttggccagtggcccatgattgtaatctcagcactttaggaggtcgaggcccgtggatcacttgaatccaggagctcaagaccagcttgggcaacatggtgaaaacccgtctctactaaaaatataaaaattttggtgatgcacgcctctggtcccagctactcaggaggctgaggcaggagaatcacttgaacccagtgtccttggagtgtcacttttccagctggaaacctctgtggcctatggtgccttttcccaagttttgcttgggcccactgggcttgttctgcccactcagcctggcaggctatgctaagcttgcactactggcccagatcccatgcctgccaagggcgagccaggcacagagtggtgaagaatgtgtgagcgagtgcatggtccggccaccgtgcacagccaggtgtgctggctgtggcagggcaggcagctccaggcactggcacaggtgctggctctgtatgagactaaggctggaacaggcatactgcaagtggcttcaatgatgggcaccgggaaatgcagtggcgacaagaagctggtagacaccaggaaccacagagccccaaagagagtatcacaaccatggctcagggagcccctaggtctgggctccctgaagggccccagctcttctcttcctctctccttctctcttctctccttcttatctcccacaacatggcaagcaggggccatgtttcagccctgtttgtgttaacagctctttcggtcatccagactaatgtccagcccttagcagagaggagacccataagaagtgtggctgagtcaggttattttatgggctcagacgggaggaagtacatggtgattggtccatgggtgaacgtgggcatgcctggaaaatgcaccatctgatcggccgaacggtcatcaatgaagtcttccctctgggttgtggatttcacccggaagtggcagtcaagcctcccggcttcaggccattcctggcttgaaggtggggtttcaccagggactctcccctttctgcccaggaacccgtctgcctcctgccatcagcatgccatccacagcacccaagctgtttatgctgagaggtgcctgcaggtgcatgtcgggttgccttcagctacccccagcctccctcctgagctcctgggtgcccaaagtccagacggggccccaaggcggcggagggctggcatgtcattgccaccccaagtacacacacacacccggctgggtcacagcagtgcccaggctcagccacagccttgtactgtaccagaacgtgctgggagccaggagaggccagggaatgggaacaggcacttctgagcctgcgggagctagggcttccagggcccctgagaacatagggatgcccaggtccagagccacagctgggcggctgtagctcagtaggaggcggggctcccacctgttcctggctcctgctgcattgccgaacacacaacttcatccgcaccttccgcgcatcagccggaggcttcccagcagctgttctagtcaggctgcctctgccatcactgggaggtgaaagttgcagtgagctgagatcatgccattgctctccagcctgggtgacaaagcaagaccctgtctcaaaaaataaaaaaaatataagttttaccccacaatggttccattttgttccctctttccctagaaactccacattattatatggatgcattatcctaatatgatcatgttcaatttaggcttcctactcaattttcagtttttcatatatgcaacaattttaccccaagcataagtacatccattatgatgacatttaatagaagggccaggccactcacatagattttcagaaacactgaatttagtcatcatcaagaaaatctgtaatcaaactctgtttgtctttttttgttctctttctgtgtgttgatgccaaacagaaataaagaagacattcgtttaagtgcatttacactgtaagaaagattgctcattgaaaatattgatttttaattatatctttgagataggtaaattaagaaccagaagcaattccacaacttgataaaaactacaattgtaggcaaatttggatgacaaatatgaatatttactgtattgggaataaggttaatattttaaaacaaggttgacaggagaaaaattgtcttagtttgcaaaaggaaatttgtttctttaagtgaaaattggggtcagtaggccacagctcttcttgcttttacatgcctgaaatgaattaaataatgcagtagcaaagcagtactgagcagactaatgacaaaattatacattaaggctcaaaatcattatacactagaaatacatattttatataagaaaacatgaaattttaaatgcattcccacttcacctccattatcttaagagagaaaaactaagtcatatcttcttatgttcattaaggaactcatggtctttttctagggagcaagggtggttactggattctgtttgctgattgtgatttcaatgtgattaaagacttattcttcatacagtagatgcagtatccagccccatatgctattcaaagtgagtatggtattattttatagagggtaaatctaattttgagttgtttacccttctttggattcctttatgtgaaataatgatagtaaataactttgttaaacatgtacttactatgttctaggaattgtgctaggtaccctacacccactctctgattcacaataccctttgaggcagacatgattttcaccattttatagatgaggacacaggctcagacaggttaaataagttgaccaaagtaaccaggctagtaagtggcagttattagatgctaacttcatattttcagtagtgacattttcaggaatgtattgcaaatatattaatattcaatccactatcaaatttcatgatttatgacttttaaagtaagtgtgagtgggagtctatttttagaaatcaaaatgaatagcactttaagtacactatgcacttgtgtacacttatacacatggagcattgtgtttggctcttttggtttcagtgccaatgccagtagttaccctatggaaaatgttagtgaaaaacactaaagtgtagtagaaagtacattttattatataagtaccgttttatatgtgggcatatagtaaacaatcaacctatgcatattacatataactttactttgaaagacatgtaaatagaacagagtcatactgtgacatatctatatgatgctcaaataaccatctgattcagagaagttatttcattagaatgtggtttttattacaacctttcactctttagtccctcgtgtcaagttgtatagacagggcccaagctgtcatgtcctcagtgggttgtatttatttataatggtacatttttcccagcatcacaaaaggcagaaaatttgttattgccatgtgaaaatactcattttgtaccattattctctttacacatatttgtcctcagaatatgggaaataaaattagcactactgctacccggtaatctttacaagaggattgtttttgaagataaggaattcaaatatcaataagctgaactgaaaacaatattaaatttccaatgtgatgtggcttctgtttggatagagatggagctggtctatgtttctttactctgtgttcatagtatcaaagtaagctttgtatctgtttttctgtaatgatgacatttacacttggttgcattaatatgaagtaacatggattgcgtgtgttagtaggttctttttaattactgtgtaaaaataatatgtaattgaaacaaaaagcattgtttccaatcctaattttttttcctcaagtccatcctgtcaagctgcaagcgtgaaagttattttctggtggtgtgattagattggggctgaaccctccagctggcaggcctgtctgtgactggcggcggcctgtccccagtgcttgtcatttcctgacatgcctgacaggatggggacagccgccccagacaggttcattagatggtgttttctacagctgggctaaaaataaataaataaataaaaagtctgtgctttgtaaaagcccaagctgtaggggcccttcttgttggtttaaaccagggccttgttttgacaaattttgatctgtgcagtttttagattttctgacacatttttgtttccttcccctttggcctgcactttgtgctctctgccttgttgctgcttcaaaatcctaacatagtcttcccaagagaaaaagaaccaccgttattgagggcttaaaagaaacaatagtgtaatacttcataaaatagcaatacttaatctatttccatggtgatctgcacaatggaggaaaaacaatcttgggacttgtgataagccaattacaagaaaggttaagagtttttttagtgccagaaacatgccatctacatgaaaacataggatcattactaacagtctacactgtcaaatacactgctctttagaactgccagaaatttaagctgtcttcatttttgagcttttaggaagctgacagagttttctgcctgtgttcataggcttcgacgtcagaaagagaaattacggaagactgtagaatacttgctaattaaaaccagaaataaattcaaaaatcagatttagaaatatgcttctttgtcaatgatagggcccctttaagactaacgatttgccaaaaatggagtgcatttgaaacatacatttctacagagtcatgatttatcattctcaaccccaaattcaaacttttagaactgcagaattggaaagaaaaaaaaaaatcttcagccaagaaattattattctgggttgcacctgtaattaaaaagtagctattgacatctgtgccttagagacttgccgtagtcttcctactatcatagttgctgatagctgctttccattaagagaaacattttatcttaatttttagtagatagaacatgcccaaatagaacatatctgaccatatttgtctaaataatcttagtgttgctgttagctatatttcctttcacatgtaaagatacaaaatataataatgtttgtatctcatatgctttgtcattggtgtaataagtagtgttgctgaaaaaaaatcaaattcctcattcacagaaatcctagcccttacctttcctttgtattgttagctttcactgctttagttccccgtctctatgacaactgtttaaattgggatgggcaactgtcatctggagtattactgagagaaaagtgttagtgagcacacagttcccatagatagagcatttcaatataatccaattttaattgagctccagagactttgatgtgctgcagaaggttgggagagagctattccagggagaaattaaagcagcccagcaaggcttccctactccagactgtcaccattttaagtaagcattagcatcagacttaacctgcccctatggaacatctcacttcttttttcagcttttcactgatttattttgccatatgtaaaagcaaagcactttcatctttttatatatgtttttacacccatttgattaggcttgaaaagcttgtactggacctgagattcatcttatgctgtctgttggactttgctttggcggctcataaaagacatagaaagtagagtagggattagcttcaaattgtcagctattatatattaaactttcttttttaatgctgctttgtaagaccctattttggagctaaaaagttgaaggaagtgtaatttgtatttagcttcgatttgtcattgaatttcattttaatgcttagattcatggtcatttattagtggctacgatttttatttcaaaatgcattaaaatatcttttcctcatcacatgaaaagtacctttcagggaaagctggttcagagcagctgaatacagatacatcaatccttaatagagaaaccattaaccctttattttttttaatggagagaaaaaggggtatttttccatatatattcaaagagccttttaaatattttgaaatataatgttgaacatgcattaaatatgctagtaataataaaaatgacatcaaatcacaatgttaattataattaaataagtactaaatactttgattgtgcagtcaaaaagctttgttacaggtatgataaacttaaggaaattatctatttgtgacatacttgacatttctgatctatattggcaccttaaagaaaaacacgtatttagaagttaagtaaaatatgacaataattagaaattagtttgagtctatgcatcattctagatacttctagtaccagaagtagattgactgtaaagctaatgaatcttcagccagggccccttactcttcaggccttggggatgatgggagttgctgataatggtacagtggtttcagtttactaagttgcattaaaagatctcagaagaatagaacctaatttctaaggcactagtaatttgttgagttttttttttctaattctaaatattcatgtgcatagcttattataaacaatgttgcagtgagtgatctggtacatatttcatcttgcttttctaggagtatattcacagcataaattcatagaaataaaatcaccaagtcaaagggtatatacaaatacaattttgatagatgctgccaaaattttcttgatatgttttattatttgtgcgcccactagcaatgtagtgagaacttgtttttctcacagtaagctcagtattagcaaacttttggatttttaccaatctgatagattaaaaatatagcattttcatataatgttctttctccaacaatgaatcaatttaatcatgttttcagtcaaggaaagccatttttactattttctgtgatttatctatttgagcttttttaaaaggaaaatgtcaccctctcaatgtctgtgggaggggattattgataaatagtatggtttgtctcatgcatgttatttttccatattagttaacataaaaatttataatacgtataatgaaaattatatgcacatataggtatgtccctttctccctgctcccaacctaagttaatttctcattcctcaatggaatttcctcctaaatattagtgtcatttgttctgaggataagaattttttttaatttacctgcatacccaagaagaatttttctgctctagcatagatcaactgccctattacctcaaattctagcttattacttataatacagttagctaaatatattaacactctgtttgctacataaaattctaaaccagaagggctgcatcctttataaattagttagccaatgtggatgtctctagtatatatttttatttatttactaaacatgcatattggagaagcatacactggcactccaggcagctgcattcattgagtacttgctgtgtgccacacactatactgagcaccagggaaaacattccacattaaggtggggttttgactgaaacacagaaataacctctatatatggagaaaataatattaggtttatttatgttatcagtggagagcaaagttttaataacactagatattttaatttatattttattcactggttatcattcctttaaagttgtcaggtgtagataggttaattgtttttattggtaacacattttctttgtggaagttcatgtttatgtgagtgataacaaacagagtgattgccgtatctaaagtctggactgaacttcttttctttttcataatactcgtaaatctgccagtaatcctaaacctaggaaatggcagaaaactcctagccactggagccagaaacccttgagactcctttcatacctttacctcagcacaaaacaaaacactctagccctatctgtctcagaactgtctgttcttccttccctcttcctacctgctgcaactctcttaagtcagacttcctctacttcctactggcttcattcagatttctagtttagcctcattccaagtcattctccatactgcttccagagtgctctttgcaaatgcagttttaatcttataaccaccttcctccagtgctctcaatggcatcacattcctcattagagctgccatctattgagggctaagttaaaatccccattccagttcatcctttctgcagtgagtgctctggacagcctcttgcctgtagacatgtgacctctgtacttggagtggaaacacctgagataagaactttacataccgtagctcatttaattctttcaacaacccagtaaaatagaatcatcctatcaatcttacagataaagacacaaatagaaaagctgggctccatgaaaggaggggccgtctctgtcttgttcacaatgtgtcccatcacctagcacaatatctggatcctagtacatgccgactgaattttttttgatgaacaaattatgtgttatgccaacaggctttgcctaggatcagagaacttgctcatgatattcaaatgaaacaaataaaaggcaaattttcagcaaactagtattttgcttcaaatagctttacaaaaaaagaataaaaactcagcagaagagaaaaaaataatcctggggcattccagaaatgcagaagaaactttttggttatatttaaccctggaaatactgttttcgttgcctgcaagtcgggtaatctctaaatcctctttttacccaattatagatatttgtgaaaggtactcatttgccagcaagggccatttactgggctatttacagttaaactgagttgcatttcttgaagagctaattttcctgtaatgtagaaaactggcggcagaagcaaaaacaccatgggaaattcagtaggtgcattgtgtagttgaagcatgaaggtgctttaaggtgttttttgtttagttttgttttgttttgttttttatgttaaacttcaaatgcagaagacagaacacgcaaaaccgtttagtaagtggtaaataagaacaaattccaggaaataatcagagctgattggagcaatgtgacacacagaaccagagactggatcagagaataaagtacactgaaaaggatctgggctggggtcaaggcagagactgctcccatcactcctgactgagggttcactaaggtctgggtaggggaggatcgtgaattcatttgttcaacacatctatgtagcacagcctttctgctaacctccccacttgatacttgctgtgttatttcatttaatactcacagcaaccctgcaaagtagatgtaatttgtcccattttatataagggaaactgtcacaagtgtattgggaaacttgcctgaagttatacaaactttagagtctgtgtgtcatcctccaagtccaagttctttccactacagcatggcatacagatatataaaaaattactttagtctacaaaactaagtgctagtaaagtacatacttattgctacatactggtaggatgagggaatgtggcaagggtaacattcatactgccttaggtagatacacagtaaaatagacccaatcaaaaggacttccaaaatgcaagtttgcctgcatgaggttatgtttcattctaccacttctcttcaggagacggtgatgctgagggagctgtagctttaagagaaagaaaaataaattctcatgaaccccaagcatgcacctgtgaatacccaggggcacttgggttttcaagtgaaaatatgcttcacaaactcggaacccatattttatgatagctttcagttgctaattgtcactgaaaaagaaaagtctttaaaacctgaaaaataattcacattcatcttttctttctggtccctgatgagcctactacctacctggcagatacttgataaatggtaaatattttttgaataaatgcttttttgagcagtaagtttttaatatatcatagaaatttaccaggtagacaaggaggagaagttattctagaacataaagtgtggaaatgtttgatatctgcatttgtttttttttaatttcaatagactttacttttttagaacagtttaagtttacagaaaattgaacagctaatacagagagttcctatatatgtgtgtgtattggtcctgtttttttccttcttcaaagaacagagacatgaaagtaacatctgataataacactttatattagaaaattgtcagctgcaagtaacagacactgtaaactggcttcgtaaaaaatagatagatgatagatagatagatagatagatagacagacagacagacagtcagtcctggattctggtggtctccaaggttgattcagctagtcgtggatgctgtcaaaaacccaggtgcattgcctgtctttactcagtgatccttggtttgtcctaattcttacgctgatagcaatgtggctccaacacttcaaaaaatcaacataagctcagaaatattcaaaggaatgagagagcatctcttccattggctccctcacagcatgtggaaacttttctaaatccgatatacccctggaactggccagggggtcagtgtgtcctggcttggaagtgatgtaagagaagtcaatacctgaacatgattggagttgtgtcaatcagggaaatggggcagggggatagggttggaataggaggagtggaatggtttctgagtaagtaagcagtagtgtctactatagagtttcttttaagaaagcataataaaatacaaatggtaaattttgatcaggccttctgaaaaactggaatttttttcagctccaataaaccacattttttctgtctccctcaatcatagacacccattgacatagcaccaattactctgtttatacttctgctactagagaataactatatatagaccctgtatatatacagggtctcctagcttaatcattaatagaagttaatcagaagaacaaaatcagaaatcagactctatatataccctttaattcaatcattcaacagattttttactgagtttcgacaacataccaggcattgtgctaagtaatagagatacagtaatgagaagaaaaaaaatggtcaaaaagcttatagtctagtggaggagattacattaaaaatgaaattatacaatgaatttgcaaaattacatttgcggtaagtgctgtgaagagaacttgtctcataggtgctatgagagcgtaagatagggtgattttacctagctagggaggtcagtggcaaaaatagaagcaaaaagagaccttgaagatgagtagaagtgaacttggcaaataggggagggaagatatttccagagagggaagaatatgtgcattggctctgtgacaggaaacaacatggtaggtaacaagggactgaacaaaggccagtgtggcttgacctcaagggcaaagtggaacctgattcatctggagcaggagacctgttgtgtgcaccactaaccccatcccatctcttttgttgttggctctgcttcctcagaacttctgctgccttatgatttctgttgactgctttctcgctgtgttctagcttcttcccactgtcctcttcaggccgtctctgaatatcttgaattcagatcattaagagagatcctctgattggaccagccagccaaattcatgatagcatggctctgatggttttaacaaccacagactgtagctaccctacttagataaccgcaggtggagtatcccttgtcgcaaatgcttgggatcagaagtgtttcaaattttgaattttttcacattttggatatatataatgagacatcctggggatgggatccaggtctgaaaatgaaatttgtttatgtttcatatataccttatacatgtagcctgagggtaattgtatacaatatatttgaaatacttttgtgcatgaaacaaagtttgtgcattgaactatcagaaagcaaaggtgtcactacctcagccacccatgtggacagtctgtggttatttggcatcattatcattcttcacactgaatttatacgctactgataagcaatcattttcttacacttattcatacataagtacataacagtaaaaaaaaagacacactgttaacaccgtgtaaaaacaatgtgttcagtgtaactaagcggcacagcagcatcacagaatacctggatcagctgttaaacagcagcaacaacagtcaatgcaggctttcagtctctacctaccatgctgggttttgattagaaggtaggaggttgtacagtaacccccgtgaggacactgaataaacagtgcgtcacatacctgcgttatgactgtgacctgtcacgtgaggtgggatgtggaattttctacctgtggcctcatgttagcactcaaaaagtttctgatttttgaacattttggattttgtgttcccacattagagatgctcaaggtgtacttttaatattagtactcatcgtggttcaatccagggtggtggcataattggtaataaacatggtacaaaggaacttttcagaagagggtgtcacccatgttccatctagtccataacaaattgggaatcactctggaatgttttaatatagctggttttaatcattatagaccatgtagattaataattcttttgcatatgtttcttattaaataaaaatcaagaaaagtattcataattcattagtgtgttaaattactgccatgtgctaggctctgtgctaagtatgaagaatgcagagacatacagaattcctgccctcagtgagtcaataggttagtgggagacaccaagaagtcaaccaacaattatagtttggtaagtattataaaaaggtgggtacagggttcccagtgggagcagcaggatctcctagcttaatcattagtagaagttaatcagaagaacaaaatcagaagggatctgccagtcagaagaaatatcatttgcaggggcacaaaagtgtgacagaacacggcacactggggagcagagaagtgttcaggatggttagaatttaagagctaggaagaatgcacattgtggctaaataggggattttatactactattaataataacatttgccactttttaaatacctactatgtaccatagtatatatgcttcatatgcataaattgtactatgattttgattttcatgacattaggatgcaaatttttaaaaaatgtttgaagctataatggattaaaattaaaaagtgcactagggccgggcggggtggctcacgcctgtaataccagcactttgggaggctgaggcgggcggatcacgaggtcaggagatcgagaccatcctggctaacacggtgaaaccccgtctctactaaaaatacaaaaaattagccgggcgtggtggcgggcgcctgtagtcccagctactccggaggctgaggcaggagaatggcgtgaacccgggaggcggagcttgcagggagccgagatcctgccactgcactccagcctgggcgacagagcaagactccgtctcaaaaaaaaaaaaaaaaaaaaaaaaaaagtgcactagtatttgtaatacatgcagttttcttcaggttaacataaagaaatgttaactagagaaaaaaatatttttaattaagtcatatttgactattgctacaatcattactgcaactctaccctgtaatcttgtttcattctggctgtatctaaaattttaatatgaaatacttttaaaaagagaaaataatttgtctcgacaatttataatatttgtaaaatcagaccctattacctaattagttaaaacaaaaacctctaacccagaaatccaaatgatctgaaacagaagaaaataaataagtctatagagagaagacatataaatataactagtttaaaaaattagcaatatgcagaataatacatagagaagttaatgtattcagtatagaaatgaaagtaaatactggaaactagaaattcgtttattttcagtagtatagagttctggtctccccacctcatccctttgtaaaataatagcagagagaaaaataaaagattttagactatgccaaatttgagaaaatgaggaaacatagccaaagatacaatatttacacaagaacattcatgagtaggacaaaaatgaagcaactgtgccagtatcatttttaattttgagagttttaccatgatttgagagtatgtgtttgaagatgaagtagacacagaggactccagctgcaactcagtttgtttgtaaattaaattttaaaatattttgctcaacaaaaattgagttccttctctgtgcaagttctataaggaatacaaaaatagagtacaactcagtctctatcctcattaagtccattttttaggggatgtatataataagatagatcaatttaaaaggacctgccacaatgtaagagatgctattggagaaatacaaataatgctcttttgagtagttcctggttctttactaatgaatataaaatacaattcacatagatttgaaacagtattgcacttctctagtccaaatagcgtctaccttgcagccacagcagtgatttctaaagtgccagtttcattgtctcacctctttctttgttaaaaatcttatagcagctctccattattctcagaccagagtccaaactctaatgtgagttatgagatctcgccccacatcctgctgcccactcaccctttgttgttctaattttatttttcacctctctgcttcttacaatatatgcacacacagtctgtgtccgttgcccccccacccccagcactgtgtttatgtatctttacatacatgtttacatatgtgttgttccttctgcttggtacttcctttttccccactcccctgccttttcccattatttgtgattttccaccaaactgtgaactcctagagatcagggactctgcttctcctgttcaccattggttcctaatggtcagctgataaatatttgttaaattaaaggaacggaagaaaaataaaattgataaaccatgaggacacttggtagaaaagagctgacctaattatgggctgtttataaaataggaagccttcttgcagtttatcactgcttatagtgagactggtagctggtgtcccaaatagttgggcttcgtagttaagagttaagtgctatgattccaataatgtctaggatacaaactaccactaaagaaacaataaatgtggcttttagttcagtaaaaggctatgtgctgtggtccagattttctacatctgttttggtgatgtcatcaacaaagattagaaccagaggtctgcatgggtgtgtgtgtgtgtgtgtgtgtgtgtgtgtgtgtgtatgtgtttgtgtctgtacacatgcacaaaaaggtagggagtaattgcagtagtaggctgacatttgttaagcatttcctgtgtgccaggcactgtgctgagcattttttgaaaagagctattaatatctcattcaatcgcacaatgaccccatgaagttaggtaccattatttctccccatctttagataagaaaaccaaaacatcaaaaatcaatgaacttgcctgaggtctcacagctagtaagagaggcagacccaggggaagccttaagtctaaggtaagcaggtccataaattgatgaattagagaaaaaaaatcaagattattaaatcaaaagttctctacggatgggctgcctatatttcccccaattgtaggatgttttgacaccccccccccaccgcatacccatatgcccatgtaccaataatggctgtgtttataatggcatataataacattcctaaacacagccattatagcaacattgtttaattttcattgaggatgtattttctggaaagcttcatttttccagcttcatttcttgatcatttttgtttgcctcacagttaagccatttccaatttttcccgttttcagttttatattactgaattattttcatcaggattaattcttttccatgtaagttttatggagtgacttggttctgtgatcaatcttttggtccatattacattttactgactatagtgcctgcccttgacaattttattttgatgatagtattcattattaattgaataaaaggctaaagtgaaactcttctaccagatatttgaagatttctttattgtgtaggagtggtctatagcagttgttctctaactttttttcaccaattttattataaaagaattttataaagctctataccacattgcacatgtttaaattaacagttacaattttccataattttaaatattttaaaaagacgtgatatccagtatgttctaaatattactattttaaaataaaattgttatattacttttcagatatatccagtagaataaaataagtagagtagtgattgattactattatcatctgttttaagatgtacaaataagctcttttttcaaatgaacattttatataatttctctctttgaactcatacttcctttcaattccttcccccaaatttacctaatctaaaatatttgtgcttgtgagtcttttttgatcactatgttatactactctgcaaaaagtgtatatacttactgattaaagctttagttttttaggttcctaagaccataacattctaagtatttaaattttttattctgaaataaattgttacaaatattattagcatacagtcatacaacagcataaatatattgtgaactttgaaaaataattaagcataaaaaatgaaattatattagaaattcatctcttaatgggatgaatagttaacacatgcacatatgaatattacttattgctacaataatacaggaatcaatattagagctacttataactttcttttttatagaggtgttgaaaaatcttgttcacataagtaaacagcatgtcgaagttgtattatagacagtgttattcagtgttttctactctttccaagttgtgtgctaaaaatcacataaggatctattgtcagaagttatttttaattatctctcaattgacagcccatttagatccaacttctcctctttgaaagtaaagaattgggaaaacatctgacttgcaaaaggatttttttttcagtccagtcactgggaacattcactttccaatgcctccatcaggtatttcgaatcatccaatttgatgctcctacccctcaacagatcttatactccagtcaatacaccatagagaaataccattttttattttattttttaagtgggagaatggcaatgtgtttttcccatctcctttttggagatgggaaagagaacctgtactatcttatgtttctccatttctttggtagggaaatagcatcaccaagacatgtggtgagaggtgggaagggagtgttccatagctgctccccacatcctcactgcatgtgccacacagcaggtatcagtcagacatggtcttccaggtggtcattttggaagtcaagcctctcccagtttgtagatcgactttccttcagggccttggaatcttctccattcagctgacagtttaaaaagagcatggatgatctcatatgagtgtggacctgaaatttcttttgaactattcttcttgaatatatttgctgtaatcctgagccattgccacaaattccaaatttatatgaaattataaaagtaatagggatttgtaactttaaattgcaccacaacaagctctttaattaaactgttgaggctgcaagtgtggattgaacgcgacaaccttaggaactctaaaaagggtttgcccagccttctgcagcattttcaacaattcgtaacaggaaattcaactggaaacaaaatttagatttttttcgtattcaaagaaaaaaaatttgtaatacttgtgctaatatatgcattagatgatttgagatcagcaaagctatcactaaacaagtatttttttaagttgcacaatatttagcttccttaaaaagaaaaaaaggtgaaacttttttcatctgtgatttgacagtcatttacatgtttctgacaacatatacatgtccgatacgcatgagtgcacagcagccttgtatttttcaacatgatcatcagataatatgtggtaagcacatatttgagtaggtggtttacaagggatttctatgacatttgtattgtattactttctatgtaccttactttctatgtgctttctatgtactttagttcataagtgaactaaaattcataagtgaatggggcagacttcagggtatgagcctgacatgaactttctcccttcacttcttttggatattaagcagttagctcagtatagttcagtggtcacttaagaaaatcacaaagttccataagatttggggtcaagatgctttaatattcttgcttatgatctgtatgatgtatcaaaaattatgtttattcagttctcaaaaatgaaactggatgggatagtatttgttgattagatttcattgtatattaaatactttgaagaaacaggcaggcacaagctagatgatatgggaagcttggcttaagaaagaaaacaaaaccacaaacctcaagtatacatgaaagtacttaaatgacagaaaaatatcttggactataataaaaagcaaactgaaagaattattatagaatgtccttaaacttatagaaaattatgtaaccagtaaaggtataaataaagaagacgattttatagtatcaggccatatttcaggcctgagcttgatgcccagatttttatagaaatgtaccataaactcagtattcaactgactgtgattgatattcctttacatttatgaaagttatacagattgattaactcatcacttgcctgaagcagcatcccctccggtcattctgcccccatcccactgcattccactctatcctccacatgcctccctagcgctgtgcctcaaatctcactctgccaccttcctgctaagcttcaggactttcccagtgcctgtgagcagagcagggtaacagagccctggggtatagtccaaggaagccacagtaatcacatgtatctgagtaccagtgttttatcttaacaattcattcatatttgcagtattttccagcctgtgctaattttactacaaaactgttttaaattgcttaccagaaataaaattgatgctcaagaaggggttccaaatgatattctttgacataccttagtatacattttcccatgtgagaggcgtaagtccataatatcaagtcaaaattgcttagcctaaagcccttccataactcctctggagtcaaggaatcctttcattgtaaaggtagtgtcttctcagaatggatctaatccagtcgaaagttccatggtagtgcaaattaaactactaaaaaagagaaaccagctgtatttagattactgttttggttcttgattaaagtcagcagggttgtttggtggactataccattaggacataaacatgagaagtctgaaggccacattggagagagcttcttctggtttagcaaaggagtcaaaatgcacatactctgtacaatttctttagaaccttccccatatgtactatttctatcagtttcccattgtgatttattaaacaaacatatatggagcacatatgtgccagacactattttaggcactgtgtatcgaacagtaaataggatagatgagagttctattctcctatttgatgtcacagggaggggacagacaaaaaacaagtaagaaaattaatcattttcatgtgcagaattaaacagtgataagataggctgtgtgttgggatcacttgaggtcaggcattcaagaccagcctggtcaatgtggcaaaaccctgtctctactaaaaatacaaaaattagctggttttggtggcacacgcctgtagttccagctactcagaaggctgaggtgggagaatcgctcgaacccaggaggtggaggttgcatgagaggagatggcattgttgcactccagcatggctgacagaatgagactccatctcaaaaaaaaaaaaagagatagagttacatgataactcttaaattgtgtgtcagaaaaggcagctgagaggagtagatctaaaattattattaatttttttttttttttgagacggaatcttgctctgtcacccaggctggagtgcagtggcatgatctcggctcactacaacctctgcctcccggattcaagcaattctcctgccgcagcctcccaagtagctgggattacaggcatgtgcaaccatgaccggctaatttttttgtatttttagcagagatgaggtttcgccatattggccaggctggtctcgaactcctgaccttgtgatccacccacctcaacctcccaaagtgctgggattacaggcgtgagccaccgctcccggcctaaaatttttttaaataaaaatgtattatggaatgaaactctttttaaataaagaaattgtaggatcatcttattccgtgatcagtcttgaaggtaacaagcagggaaagcaggaggtggtttgctataaaaaaaagaaaagaaaagaaaatgaccctaggctctatcaggttttcctagcagggaattatggctagctcagaacatcgtctttcatcagcccttttaggatttcagatgcttaaatataacatgggttattgtaaagtaattaggtaggttttttgaaaagcatataagaacatacataaaaataatttttcttcccatgtcccctttggtaagggctgaacacttatttaaatgatgttgccattgttcaaaatagctttggacctttggatctgtctttcagaatttgcttcctaagccatttagaagctactagcaaaatcattttcttttaattttgttatctctccttgtcctctttgcatttaagctttactgatcttaggttccttttttcttgctgcagagggtccctaaggaccattatgctcccaggctgtagctaagagaatggtgataggaaaactgagtttgtgtattagctgggatccagtcaggggagaggaatcagagtgcaatttagataggaaaagtgtgatacaattatcatataaattatgccaggagattgagtaacaagggactggctagtaagaaataaagataactctaaagaatattggccaggcgtggtggctcacacctgtaatcccagcactttgggaggccgagtcaggtggatcatttgagatcaggagttcgagaccagcctggccaacatggtgaaaccccatctctactaaaaatacaaaaattagccggatggtaatggcacgcatctgtaattccagctacttgagaggctgaagcaggagaatcgcttgaacacaggaggtggaggtcgcagtgagccaagataacgccactgcactccagtctgggtaacagagtgaaaccctgtctcaaaagaaaaaaaaaagggaattgatgaagccatttatgggaggtgtcccaacagaaacactctgctacagaacggctcggggtgagggaagtactgagaaaactgctggtcactgggtgctgggagcatcatgcgtcccagagccaagtgctggagaacaggcgcctgccaagtgagaacaccagaacagagaagaaaaaacacccttcctcctgtgtggtctcttcagtgccctttcctgacaaagtttaatgctatgacaggtagcaaaggaaaaatattttaaggacacaggttcgttttcacagagcaagcaattaagggtgaatttgcacatggaaggccataaatgaataattggcacagtttataaaatacagttttacatggtgcacttaaggagtcaaactaacatactttttggagctatctgcttgctataactaacgtaaaaactgataacatgcttaatggaaataaatgcttggtcaaattttcattacaccatagctccagaaggaaaaaataagtcaaaatatgactctgtgtgtgtatacacatgtgagatattaatatatctggacctagaaatatagatacaggtatctttctgacataatgctatgggtataagggtgccaacacagctttcatgggaagatctatcattttttctgatattatattcactttactgtttgggttttcaaatggccatagtatttttagtaccttagtgaaataattattatagttgaagatagattttgttgttgtggctgttttgtcttaaaatgtttcctacttgacaaaaaaaagagaattaatcctgtatcactatccctttcctttttaaaaatcatactggtctatgaaaatcaaatatggaaaccattatagccaactaacaatttataaatataaattgtggcaagtcactataacccttttgtgaaatgtacaagaagaagttttgcatttagaaatcaaaaaccaattgtcacctgatgctcaacaacaaggagacataaattcatcaatggaacttaatagccagggtcatgtactttatgttctttgtctctgcttaaactaaccatttccaggtatcattatcactgtttttcagatgacaaaaaccagatggagttaaataattgtttttcaaaatactgtagttggtaaatagcagagccaagagttaagtaggagtctgaatggctccaaaatgtttcagatttaaatagacgtctgactgcctccaaaaacctttcaatgtctagagaaagacaaaaactgaattaagggttacaaaatgggattttcaaaaaataaagaccaaaagattatacacttacatattttatgtatatttcctagagaaaggaagtgtaaaaaggaacttcataacttgttttcaaatgtatatatgaatataatgcatgtaaaatgaatataatgtatgtaaaactcagtaactgttttcatttccaccaaagcaaatataagtgcggtagagtataccacagcaagtagaaaagtccctctgaattgttaatacacgttggtgtatcaggaaggaatgtgcttgttgtagatttgaggacagtagcttaatcaaatatagattatatacatggtaaccagaagtccagatgtggatgcttgctgtgattgtttcagtagctcagtattagagccaaccttggccttcctctcatagttacacaattgctgctacagtttcagctatcatatctccattcaagcaggaagggcaaagtggtatgccagctatatatgactcatttcatcagcttttctcaaacatcctcaactgcttttggttttgatctcattaaccagtgcttggcctaatgtccttccacaaagttacaagggaatttggggaagcagggaataacattgtcaggactggcttagaccatgggtcagccaaactctgccctgggggccaaattcagctcatacttgttgtaaataaaattttgttggaatacttccatacccctttatttacacattgtctatggctcctttcatgttacaatggcaaaactgagtagttgcaactgagaccatatagcctgcaaagcctaaatatatttactctctggccttttacagaaaagtttgctgacacctggattaaaccaatcatgatcctttgcctggggttgaccatatggacactttgggggtagctgggcttccattaagcaaggaaggggagaaaggatattggaaagaaccaacaatatatgtctcacaggtggtcacctggtccaattaattatatacaagacccaaaagtgataatatattttcggttttaagtcacagagtctccttgaatatgtttttctactccttcttttcctcaagacccaactaagacactttagaaaggcagaaattttgcaaatacacagtatcaaattattgacaatgttgtgacagacagtgaattcatttctagttttctgacttttactaagttactgtcagagtagatcttaaatccatattttattgattgacacttccctttaaactgtttattttaggttcttgcatacactgagggacttcacggaaaatggatgttcagcgagatacgagctgtattttcaagacgttaccttctacaaaacactgctttggaagtatttatggcaaaccgaagtaagtccccttaatattttgaaagaaaatgtgctcatatttacatattattcatttacatggtatgataatgtcttgatttttcctactgtatttctgatgtgctctagcttaaacaaacagaaattctttttaaaaaataaaaaaagaatgaatttgtttgaaatgttagccctaggtttctcatggataaagttatactgaaagctgatttttcatgaagattcattagctttacaaataaatcatgataggcacttgaagatgacttgtaaaattgatggctaacttatcctgcggttttctaaactctgttttttttcttcttaccacagcctcagttatgtttaatttccctgatcaagcaacagtaaaaaaagttgtctatagcttgcctcgggttggagtagggaccagctatggtctgccacaagccaggtaattatatcatattacatattatctatggcttgttaacatatttcaatctcaatattacagcaatgtaaatgtggttataacattataattatttcagagaccaaagaattttctttctctgaaggttatttgtagggatagagattatgaaaatagctattttgagaatgacagaatggttagggcagatttttatttaatacatataaataacaaagtaaaaaacttgattgcttatcacatagctagcatataattaagacattcttgcttgttaaaatcttacaggaaacataccaaaagcctgaagatcataaatgattaattgctatgtaatagcatataaataatgtttttataaatgccatatataaatgcttcttaattaaaacaataaaaccctgagagtttattaagggtaatagtcattaattatggtatagttgtaaccacatttcctagattttcatcttggtattttagaagaatcattttgaaatcttatattattaaaagatactaatgtaagtagaaaacataatcagtagttacttatattgctgatatcagtttgtcgtttttggctcgaaataactgaataccttactaaaagtggcttaaactataggggtgtgtgtgtttaatataaaagatctggagttaaggtgctgccagtattggttcagaggttcagtgatgtcagaaccctgttggctttgtattcacaaaatcaccgctacttcttcagctactacatcttcacacaactgcattacagtaggaaaaagacacaaaggatttctctttaagcttctctgttttaggaagaatgtatttctcagaagcctaaagcaatctttatcttaagtccctttggccagaatacagtcaccttcccattcctaaaacaatcactgccaaaaaggtgtgagttctgttggcttagcccaatcattccctaggttttatggaaaaagatacctctgattctttgccagctcctacatgaacaaaagaggatttccgttgatgaagaacaaagggagattgactttaggtagatacaacaatgtctaccacatagactgttatgtccttgagaattattacacagcactgtatggatggaaaggaaaactaatctttgtctatcctcccttaaataggctacagacaactgaaagacagggactgtgttttatttatcctttaatctacaggacctaacacagtgcctaattgcagcagtgctttttaagtgctgtttagctggggttaccttgtattgcaacttatctattctctttaagcttacagtgtaagaccaattcactgacacgtatacacatgctcaagatatttgctagtagaatgacaagattaaactaagatattagtagataatgaagcacttatataaaatacaggtcaaagaaaaatgcatttcatctatcaaagaaaatgaggttagttctgcaagacttgttcttattgaatctaagctgactcataataatcattacttcctttcccaagtgcttacatactatttgtttaatcatcaattcaagaatttactcaggaattgacattaagaacttacgaatgggcctaactttttcctatttaagaataatctcctgtcttctggcatatttctcaatgaccatgattcctgaaagattactaatagaggtttctatatggcatgtataatttccctcagtattctttgacttgtctggaccggaattcatttaaaacaatcagaagctcttttattttatttcttacctatgatgagtattgtttcccttttaaccacatttggtctctttttgacgtttggaagatcattcttttttttttctttgagacaaggtctcactctgtcacccaggctggagtgcagtggcgtgatctcagctcaccgcagccttgatgtccccaggctcaggagatcctcccacctcagtttcccaagtagctgggaatacagacatgtgccaccatgcccagctaatttttgtattgtttatagagatggggtttcaccatgttgcccaggctggtctcgaactcctggactcaagcaatccacccacttaagcctcccgaagtgctgggattacaggcaacagtcaccatgcccagctggaagatgattctttataagaaaactgaaaacaaaaggcagctcagtagttttggtctctctgtaattcataatgccattctatcttcaaacgtccttttgttgtccttggcttattttcccccaaaaagctcaactaattattagtttcctaataatattcttacagactcagttttatgtacttccctagatatacatccttagaagtaccaagtggcaatggggaaacactgcatctaggcttaaacctgtcacttagctgggtaacaataagcaagcctcacacttagtagcaattcaataaatattggtggaaagaatgaataacactactcaagcagaatgacattcttatctaccataaaatggggaaaatatctttacaagagatattctgccagagatattttgcaagatatctttgcaagagatattttgataatcttttgtgctatgtacaagacaatgcctattaagattccatgtgaatactcatgttaataatccatgagtaacagaaatagccttaagtctgttgttcccaaactaaacacgaaggagtcctgcgatatcacagtgaattctcaggggtgctgcaggtcattttttaattttttagggaaaaacagcaacatttgtcagataccacacaaactatttgctcgagttagttccaagtttcaacttagaatgattagatagggctgcatctttttcagtgacacctctgagaaactggtgtttggtggctactgtcttcaaaaacaagagccatatgaaaaatcagtgtggaacaggaaatgagtgtggtggtgtcagatctgattccaaggtttcagaagctgtgcagtttccaacagacatacacaccccattagtaaatgtggttatttaagaatgaaatataaatatttctctttaagtttatgagtattgtattttcaaatagctactcagttgttaagatgttaaatatttattgagttgttagagctaactacttaataaacagaattgtaagatatttctcttggtcaaggagcactatgaaaaattatggagatactaagggtgccatgaattgaaaaagtttgagaacctctgtcaatcagtttaaaaacccagtagctttatcatacttttctaaatacaactgcttttgttatttttagatgaacacattgaacctggaaagtttcataatttggaccaatgatcatggtttattcccttaggctgttcctatgtcccttcttctggacccatgcattttttcaaagttcccagttgtttatattttacaccattgcagggatagatattgtacgggcagaggctgtgcatgtgtacacactctgtgtgtgtgaaggcaagtcgaagaagttcattgatagacattaagtcaaatgcatgtaaacaggtacctgactacctacctacctacctaattaacatggagcagatttgctgtattgtttaaaagctacttgatttatcttaagtatagttttactttttttcttgtggatttgtgactcatttgcagctgtgatttgacaaataaggttgctttcaaattgttttatcctgagtaattaagtgtatcttctctataatagaattctcaaatattgctaatttctacaattaaaatatattttctaattcatctaagaaggataaaccataaattattttaagttgattatcaaagcaatatattagttaatattggattttttaaagttatgaattaaagagactatgtttgttatgctgtgcttaattgctaggaggatatcattggccactcctcgacagctttataaatcttccaatatgactcagcgctggcaaagaagggaaatttcaaacttcgaatatttgatgttccttaatactattgcaggtaagatgtctcattctttaatctaataatatgtttatgttcatcaaaatcatggtaatgtagcctgatataatacatttttctctttggaattcaaatgcatcattagagtaaattttgaagcactcacattaaattttatcagaaactgtgcaagctcataccaaacttttagatgcatttattgttgaagaggcttttccttgctttccttctgccatttcctttgctgacagctttgtctgaaggtttattagagtcaacaaaccattgccagagtgtctggaaataataatgggaaaagtaatttcactactttgtcattctcagcaatagcagctagacaggagaataacaacaggattctgcctagtacagatgtcacctggaatatggcatgattaggttacagcatctttttttcttaaaatcttcaaataaaaatacaaaatcagattacattttctaaattatgagtaactgccatcaacctttgcagtaccatgcttgcaaatcaaaaggaggtagtggctttgttttctgctaaatcagtggttgtcagtggttaaacatgtctatgagatttaagtacttcatcttttttcttaagttaagctccaaaagcccttattcatgatgaattacaaagagtttacttctataaaccaggctctacaaaaagtttttgcaattagatgaattcaaataaccacataaataaaggtgcttaccataattattgttttgttatgaatgaatgctcacaaccgtgtatttagagctgtgtacttctctgaatcattactttaaaaatataactatgtaatattactcttttttaatctatcatacataagtgtgactaaagatactataggtatatattaaatgcgggtaatatagatatgtattaaatagacaaaacttgatttgtccacaaaagggaataaagctatttgatatattaaaatgctttttcactttaatcccaatacattcatgtatatatatgttcatatatacatgcatttattcatatgtgtagtacatacacatatatatcttgaataaacctgtttactccctcaaagataaaagaaatgtgttatactatttaattagcacattatttataaatagaatgaatttaaacatctgaaatgtaaagaacttaatttcatgagcatatttaagtaaatagcatggtgtagcagaaagaacacaactttcaacaccaaagagaagagggagagaatcccagatctgccaactttctgtcctggagcataagttgaattttaacttttaactctatcgtggacttttaatattttaatagcaatatttaatatgtttacatctgttttaataactggtatgtttggtcttatatcatcttgtcttatacttttttttaatgtcctcttgctttttatattgtttgttctctggctttacgaatgcttttttgctcagtgctcttgtgatttaaaatgtaagcaccttgttattaattcccctagagatattacatttttaaaagccttataaactatttttcttaatttgaactcaaaaatcaattaacatttttaaatcatacctaagacaaaaacttcaactcaattttatttctcattcattgcttatattcgcaaatataaattactagccagaatccagattattattaacttcacactctggggtctacgtctttttgcaaattaagaaagatttcaaactattgaaattatgtgttcatgcagtatattattttcagctatatggatctttacctgatttttcgggatgatattctctgtacgttcttgtgtaacagttttccatattccctgtattaggtttttatattatctgctcttgagagacctatcaagacagtatcattagacaccattaggtgattttttttcccttggctgtgctagctatttggagctgttggatataaaactggagggcagggtgatatacctcacttgtagttcagtttccaatgtagcaggcattcatattaaatggttttcctattctaaaatgagattttctccaggctctggatggaatgttttctagttcattgttttaaaggtctcttctagtctccatcccttcccactgcattttactcatgtaaggtcagtttcccacagtgtggtacagtaccacctataactaccacccacttcatgcctgttactttctgggagtctctttatctgtccaactctggaaaggttgctgtgtctaaatctggatagagataacattgtcatgccttctaaaagttacacctgagcagtatagagcctaatatgcttttttctatttgggacaatctttgggtttctgagccagagcatgcagactctggtgggaatttaaaagcatcttgctattattgtttgaatcgttgaagtctgttttatttataacatgaagattatatgggccactgatttttttcaaaaattactgggtacttcctttgcaattattatgactaaacatgaaagcctgactattgtaagcaatgggataaaaattaacaatagggactaggcacacagaacacttacagtctagatgaataagtgaaatacacgtaaataagacattttaagatggctgatagtaaatgctgaatcattgctatcgtgaatgctgcatgagcttagcagaggggaggcattttaaaatgtgtttggggagaaaaaaagagaagagcttcacaaatttctgctagttgtatatatatggtgtattcagtggacagaattatcataccttctgtggagtagagaattatatataatattggagccttagagaagagccagattataaagaggcttttaggagtcagtatagtgttagagtagaagggaatgcgatgtggagttttagaaaaattaaactgataattatgtatggcataaatcaaaattgagattccttagcattagtgctataaggggagtagtaatagtaaattgttactgaatatttactatgtaccacatattctatttttccctgactacagaagcaagtaaagtatggtttctgcctttgaaaagatcgtaatatagtgaggaagcagacgtataccagtaattccactaaaaagtattggaatgtataaaattgtgtacaattttataatgtataaaaaagtattataatgggagtatatgtgaagccatttgaggtagtcaaatctaggagccattatttataactaagagagcagaaaaagcttcccataggtgacatttaaattgggaattgaaatatgattaagagttcactagaaagtaggcagagggcattccaagaagaaaatgtgaggtgaagattttggatgagcatatggcagcaggtatggcaaaaagagagtaaatgacactttgtacaatatcattatacaaaaaagtttcactgtcatttgttctagttcagtggttatcaaagtgtagtcccctgacctgcactattaccttggagacctgttagagatttctgatcctcagactcctcctcaagcctacagaatcagaagccggcaacctgcctttcagcaagccctctagttggttctgatacaaaaagtttgagcacaattgcattagccatttaagacctaattatcagggcaagatttgcatataaaacatttaaaacatagaagaaagtacaggattaagtgccattcagtgtaataaaagtttagagaagtgagagattaatatgaaatagtctactcgaggaaaccttggaaaagatgagctttaaatgaactctttaaggattttgtcagatgtagatgactatccaggcaaaataaaccgtaataagtagaatgacaattgaaaaaaattatgaatatgaatatcctgaggtactctccctggatatattcctattaatttaattcttcctttgctatcatcctgaaattttaaataggagtgccagtttaaactgagcaccagcattaaagacatgggtgatggttttcttagagaagcttcagtaatgccatgactgaatacttgttagggcagcaattagatttgcctgttttcctgattggtggacagtgtgtatccattcatctcttcttatcaaatcacccttcagagttctcttatgatcctaaaataaagggtgctctaaagatgttaagttgtaccagtatcactttaacgaacacgggtcctaaaaataatcatactattttataacactgttttagggatacggttattgttcaggaagtatttatttcatttgattgattgaaacttaagatttatcatttctagataggatgttagtcttctttttgacaaatgtaatttcttaggtaatctaaagccaagacatggttggcttatattttgtcataatatgttttaaacatttttatttgatatcaagattcagaaaaaaaatagtattgttattatgtctttctttcatttttcctattgaaacattccttggccgggcgcagtggctcacgcctgtaatcccagcactttgggaggccgaggcaggtggatcacgaggtcaggagatggagaccatcctggctaacacggtgaaaccccgtctctactaaaaatacaaaaaaattagctgggcgtggtagcgggcgcctgtagtcccagctactcggaaggctgaggcaggagaagctgaagcaagagaatggcctgaacccgggaggcggagcttgcagggagccgagatcccaccactggactccagcctgggcgacagagcgagactccgtctcaaaaaaaaaaaaaaaaaaagaaacatttctttgttaataataagaactcagaaaaaatagtaaataatagtttatgactattgaataatttataatgtgccaaacattgttctaaggactttatatatatttgctcatttaatcctcacaatagccccatgagttaggttctgttcttatccccattttacagagatgaggtagagagtagctaaataacttggcccaagtcatagggctaataagtgacacagtcgggattcaaacctaggcagtttagctccagagtcttcattcagttactacagcgtactgttccaggatattcctggtaccatacaacttcacctccagtcaccagctttaacttattagctgcttttaaaacctaaataattaatgatttaaaacaattttgtaattttcttttacatttcatcaaattaaccctttgaaatttatttactgtcatgacttttgtagatactgatattctagtactagatctgggcctggaattactatctttaatgtagaagctggcactgttttcagttaagctttagatcaagagaaaaagactctgagacagagatttgcttgaggatttttattgaaaagcccttgggatcaacatctgtgggggagtgaagaagttagaactgggcagaaggaggattcagacctcagtgcagttgtgacaaaggcttcagtagatcccacagggtgcctggggctggggtaaccgttcaaagttgtcttggcttgaggcaagggagccaggtcttcattacctccactctgcaatcattggatgcagactcctgggaaggagacatgactggattgggggctttcttctaatggtagcaattcttcgagatggacatagctgaacaccaccagccatgaacaccaccagccatcattgctcccagcatccaccataccagcagttctcagacttcagtgtatccaaagcaggattgctaaaaccctgatctttggttccctactgccataagttctgattcagtaggcttggattgagccgcaagaagctgcatttctaagaactccccatttgatgctgatgccattgatctagggaccacactttgagaattactgccctatatctatatctttaaaagacatacctaaaaataattttattaatcttcatatagcaccgtcagtatcacacatgatgactcttatgatagggcatccttagcattttatgtgcattttatcttcccaatgagaaaaaaagttttgctcagtaaatacccatgaaattaagttacttaatatttatttttgtaaatatttgcaggatgttgtgatctattatgtaaattcactagaattactggacgagggattctttaaacgtcttggattaaagagaagtgttacagaattggaatctggttgacaagatgaaacaatcttttctggcttcacatgtttaaaaatataggtcaatgtgacctaataaatttcatattttctataaatattatccacaaatattctataaataattctaagacttagattaaaacagtaccaaactgtacattattattacactctcagatttatcttttttcccaaaaatattattttagtatgaaatgcaaagtacattttatgacccatttcttaaaagtgtctcatacttgaccaatttcacttttctcctttctagatgcttttaaaaataagattctgtataaagcacatggtctcagtatcatagtattaatgcattatgcagactttttacaccctcctgtggtatgtgtacatgtgcataattgcatataaataaacacacatttactgtatgtaagttttgtaaagatactttacatagaagtatcttgccaaaagaagcttgccaaatatcccggaaacgtatttaaaagacatctaaaatcccataaatgtgttcttaggctttgttttattctatttataaatttaatgaatgttcattatagaaaattggaaatacaaaaaatggtaattttaaaaattaaaccactcaaaagtctaaccgtaaatatcacagttgacatttgggtgatttttctgtttttcattctctgtgtgtggtgtgtcattgggaacctgtaatgtatacaggtttgctttctactttttccatttcactaaatattctttgaaggcatgacttttaaaactacatgagagtccaacctagaaatatggcaaaatttctttaactatttttgaaacacttgatttttttcaaagaacattaaattttagatgattgtgtaaaataatcttaatgatacttagagttctactaaaaatgtggtttcaactttcagttcccaaattgacctgatttctgtttgttttctgaaaaatacaacctatgccttattttataccttgttagataatattatgcaaaagatattaaagcctgtaattcttgcattttaaaaaataggagagtaaccgctaacacggctttgtgtaaatgatcccctgttaaacttgagaattttttttaaggattttgagttgtttttcatatgatcagctaatgaattcagcacaacttctccaaccccaacctttttctcctgtttagcattttccacttttttactctgtgatgaacaagccctccctggttaattatgtatatatttagcaactgcatgtgttgggcttattattgtcatctaattagatgtaacttgaactgcttgcttctagaaaaatcattaaaaattctttcctaatgacctagagatgacaaaatgtctgtaaagtgtgaagaagcagacaagcacaggaacatcgctcttaaagagtgttaatccagatgctgccatcatctaattaaacaatattttgctgtcattaacattttcaccaaggaattgcagttataatttctttgtcagctgtctctagatcactttaccttcaaaaccaaagtgccatataaaaacattaaattggatggtttaattaaaaagtttttttaatgaagaaacatatccagtgtttctgagatctcatttactgtttcacttttattatttgagtagattagtgtcataggcttgcggtatttaatattcatcttccaagataaattcttataagcatagttagcaaaataaagtgtatgtgtgtgtgtgtgtggagatagatagatagatagatagatagatagatagatagatagataatctccacacacacaaatatatatatttacttaccactgctggaaaaggaaaggaccctaccaattatagcaccagtgtatttactaaatatcaactatcctaaagaaaaaacaaaacaattagtaattaaacatctaggtatgccagagcctcatgagtattactttggaaataactcattttttggatgatttaatgaacagtattttttttcatttcacaaaggtgttcagtaaaataattaaaggagtaatactaattcatgattaaaacatatcaatgcaaaaccccaaagtgccacttcatcactctttttttccatgtaacattaaatacattgtgcatttttaattcaaatcaaatacatatatgactgtccattttacaaggctcttatgcagaaatttttattaaaaacaagcattaatgtcatatttatttataaagtttattatatttattagaattaaaataatgctataaatctctgctaatttaaaaattactaaaattttctttttagcacttattttcaaaggacctctcaaagattattgaaagtgaattacaaaaaaaaatgcaggacagaataatagacatgaaatatggctattggcatcattcattttgtgtatacgtgtgtgtgtatttttaaataatgcttttcttctttgtatttttttcctaaaatagcattattttttttttaacttttattttaggttcaaggagtacatgtgcagattttttatagagataaattacatgtcatgggtgtttggtgtacagattactttgtcacccaggtgataagcatagtacccaataggtagtttttggatccttaccttcctccttccctctaccctcaagcagtatccttttctttcttagaaaatcatttctattaaaaaggctggtgtcttcaaatatagtctacatttttatgctgtttgcattgacacagtacatttaaatactgtgtttatgtaaattggctttttaacagttttccttaatatataaattataaaacttcatcagaaattattttaacaattgtggttatctgattttcatctatcaattaatttatttaagtaatatatgttatatctagataggtagcatcagcattattctattaaaaaaatatacactggaatacttgcttttcattaaaatctacagatttttaagtagaacagctcccccaagaaaatggaagagctctaaactctgccatggacccatttaggatcccagaaatagctctgtctagccaatctgtactctttgtatatatacatataaaaaaagtactgagccctatcaggtgtcctaggttagcatacatatgaactattagtaataaattttcaagtttagaattgtacagcttttattttacaatattggtactgttttagcagattattgtcatgtcaaaagactttaatatggctccgaactcttgtttaatctcatcattagtattattcaccatagacttaaacacaagcaggttcattgattgcttgagctacctagctgtagatgttttcttctcgtttaatgtagacattcacaatatcattctctctcatatatacctctacgcctttgcataatcctcgtcttctaaagataatgttctgcagttttcctttacttgacttatatttgttcatcttctgaaatttgggtcattttattccatttttatcacatgcatatccattccatcaacaaacatttattgggcagatggcatatgccaacacacagagattaaaacaaacaaacaaacaacccagccctgacatttatgagtttacagactggtggagaggcagagaagtaaacagcaatgtatatcaggtgtaatagaggtctgtatgagaactgtggtgaggcaacacaggggaagccctaacctagctgtaacctcatcccagtaaatgcaaagtggaagcaacattctgctgccattacccacacctatattacatacccacacctatattacatacccacaccagtttatacatttaaagcaatatgcagtttagttgtaaaatgcaaagcttcatataataaacagataaaatagtcatcaataaagtgttttctaaatatattaattaatttggtttggtgcttgcaattacagattttggttcttactcagattgtagttctttttttttctatttcacagttatgttttccaaatgctgtaagagcagatatcatttaatgtaatttcctgatgatgaacaagataatatctgcatatctatgctactgtgatagtacatgtggtgtgtgcaaccatggcatactggatgaaactcatatcactaaataccagtgaaatagctgttttgtgtgaattttaatggaaatttagaaaattactgataattggatcataacgcatttttataaaaaataattttgttcaacaaaagttttcttaggatcctgtttctttaatagctattctcttaatttcacctgatcatgttttttcagtttcagtttatgagggggggccgcagcttgctcccctaaactttccccattcccactgtgcctcaatatcatacctgaaatatttaagtcattctaccaaaacataagcagacatattcaccctaagatcgagcagttcttcgctaaagtgaaacaacataagacaaaaaaatatttcatgaacttaaggagtgaaaaaatgtatgattgacatctgcctctgtagtttctcatcctagcttcagagtacttctgtccactcgcaaattctctgcattcattcttgatataagtttaacatagtattctgtgtactcataatataatttctagatatatattcattataatagaataccatcacagccaggtgcagtggctcaggcctctaatcccagcacttttggaggccgaggcagatggatcacaaggtcaggagttggagaccagcctggccaacatggtgaaaccccatctctaccaaaaatacaaaaattagccaggtgcggtggcgcgtgcctgtaatcccagctactcaggaggctgaggcaggagaatcgcttgaacccgggaggcagaggttgcggtgagccaagatcgcgccattgcactccagcctgggcgacagagggagacaccatctcaaaataaataaataaataaataaaagataaaatagaataccaccacataagctgcagatgtgcaggtcagtggggtgacttcctccataattactttcagggcctctgactggcaaggctctgcttccggggttgcaatattatctacatcagcagaagagagatgagacacacatgcaggaagtttcagtgggccaagtcttgaagagactttgctcacattctgtagatgagaactaaatcctgtggccagagctacttgtaagggaggctgagaaatgtggtgtaacacaggaagaggagaatcaattacaataaccagccagtagcctctatcacagtcttataaatagtaattctagttacgtcttaaaacaattattgagtgaattcccttgaaatgcattgttatcagagttaaagatacggttcaataaataaaaagttattttcttctgaaattcagtagatgctttgtaaaaacagaaactatttcataagcattttgtgtgtacaaatttttatttctgtttttctttactaggacggacatataatgatctgaaccaatatccagtgtttccgtgggtgttaaccaactatgaatcagaagagttggacctgactcttccaggaaacttcagggatctatcaaaggtaacttttaaatatatagaagtcagctttcttcataaggctatagtctaatagtatttctgtcagagtatatatagccagttaatgtttgtaagaaggtgaaactgattatcttgacttacatagtcagtttctaaatcttaccaattcttagcacaggaattaagctacaagaagataaactagtactagcataggcaaaatgaaatgggtatttgagaaacagcagatgtagagagagttttctcatatatcctaggctttaaagtcaaggttaaaaacctaaaattagtagaaaatatgatggcaaatcatttatgtgatatgttccttagatggtaagacatttatattgaccataaaatacacacattgtagggaaatataatactgaaaagaaagtcagttaattttaccaagtgtctgtctatatatgagagagaagatatggcccaaaagatggcaagaaaatggtgcataacggtaatgagaaataaaaggcaaaatttttattagctcacctcatttgtccagaggaaactacagtgtgatactaaactgtttgaaattcagtgaagaactgggaactaagcccaaaaagctgctctatagtctaagcttacgccagaggcctgccttaaagtttatgtatgttagccatagtaaagcctcagcccattgacttggaatgtatctctgttttctatcagacttgattgtctgatttagcaatccacagaaagttgaaaggtatttgtgtatacatttggttttagggggcaggtttaaggggctaattgacaagagcagcataagccctgtgatttagggaaacaacattacagctgatttaaaattaatcccacagatggtttttaactcagcatgcctgcttctgccccttttctggcctttgaaacctagacgtacctaagttgaagttctatattgcactagttactagctctgtgacctaaagctagtttctcttgtcccatttgtaatatgagaataataatactgtcccatgtcaaatagttgtacagatctaatgacatgtacatttaaaaattataacatagtacttggcacatagaagcacttcctgagtattaagtattattgttacacatggaatatttcttagcctcttttgaagactgtttgctagttttttcatgttcttatgcgtcattcagtatccaattcttttattttatataactccctattaaattttagttgatagctcatggataattttagctgtggtattatagatgttaaagggacctaaaagatcagttagccaacatcttactgagagtcacacaactggtagaaataaattgctagcaaatgaattctaatacgcttgcaaatatagtaattcttccaaggtgagtcaaccaaaaattcttaactatttaccatattcaggtaactaaattatttaagataaggtagatagaagcattgtaattcatgcagcctgcccttcaggaacaaatctagttatagattatctaaataataagatcagtcccccaaaaaattaaaaataaagtacaatattttagagagacccacacaagagataatacatgcaggttgagtatcctgtatctgaaatgcttgggaccagagtgttttggattttggatctttctggattttgaaatatcaatatatacattatatacttaccagttgagcatccctaatctgaaaacccaaaatccaaagtgctgcagtgtttccattaagcatcacatcagtgcttaaaaacttggatttggggcatttgagatttcagaattttggattagggacaagattaggaacaagaactctgcagctagactgcctacattcaaatcctaattctgccatttaccagctgtggagctttagacaagagtattagtttctctttgtcttaatttcctcacctatataatgagacatcaataataatagggttgttgtgtggagtggtggatgggttaataagcataaaggacttagaatagtgcagggacatcagtattagctaatgctatgtatatgacaataatagagtggtgaatcattgatataggccatatgctttgaattgtgtttcaaataatgatgatgaatatatgctactacatacatattggatgagaatatttgaatggcatgcatgacttgccaaggttgaagtgtaattttggggtgtaaaacaaaaaccaaactaacttattgatgtgaggatgaaaactgtcaaactagttctttgacaaaatcttgtctgcatgtattttatttaacataaattgaatagccattacttagacattataaaatatatatacgataaaaattcagagtatagattctcaggtagcatattacaacctcgtacgatgactactattatggctattgtattatttttaaaacaaggaaggaagttctttttatttaaaatcaactgggatgttgtgtttaaaggaaacttatagactgaagctcctttttttctctccatttatttattctttcagttgttcagtcaacaaatatttatcacacatgtgctatatgtcaaacactctacaagtgaaagagtgtacaggagtgaataaagcagacatactcccagccacttgaagggagttcagcccagagcaaaatgaaaactcagatagttaacagtaatatgagaggccagcatttacaagataggtatagtagggactgtgcctcactggggagtacaggctcagactcactaagacatttggactcaaatgttcttgaaacactggcccagccaaagaaaatgtggcactcattatgattagtatgggttatagaaggcatctggtaacatatttgctggtaatcatagatttttttcatttatccatgtaggaaaaaatgagttaaaataaatgaggaagtcactgtttctacagtaactgaagatataaacatttcaaggttttgtttgtttgtttgtttgtttgtttgcttgcttgcttttgagacggagtctcgctctgtcgcccaggctggagtgcagtggtgcaatctcggctcactgaagcctcctcctcccaggttcaagcgattctcctgcctcagcctcccaagtagctgggattacaagctcccaccaccaaacctggctaatttttttgtatttttagtagagacagggtttcactatgttggccaggctcgtcttgaactcctgaccttgtgatctacccacctcagcctcccaaagtgctgggattacaggcgtgagccaccacgcccagcccatttcagggtttttatgctaatctgtgtaatgtgtatttcctttggcagagcttttccttttgtgcctcacatgtgctcctctaattttatatagtgttaagtaaataatacaggtaaacagacggagcctaaataaattaggcaatgtgactacaaactgtagttttgcaagcatgtagttcttcatgctgtgaacagttgaatccatgagctcttaaaagataggtagcttttcttccaattttactatattctatgctttagcaatttgttctttctattctgtcaccctagcatgataggaaaatgttagcaaattaaagcctcttgatatgttaataaattactcgtgcattgttcccatgcttcattgaatttcttaataggagcttcttacaaatgagctagaaacctgagactatcctgtataaaatccatcaataaacaagattttaatgtatgaaaatatatctttttatatgcctaatgggaaaatgacatttgaagtataataatataattggaaggaaaaactactatagtgcaatattatcacaatgaagagatgtccactaagaagcacatgaagttcttgtagttataatcaataccgcaaatgaaaattttaatggagagtttcttactcttcagaagctcaaggaaaaattgaaatacttgaatgatatgaccaagaacattctaaaagatctctaacaacaaaagtagttgtttctaaacaaacactgggactcctgatcccagtaataattcttagcagtgaataattctagaatttgtttcaataaacatgtggtaccccaaatactttttatattccttactatatgaaagaattaagaaactatgaaatgtacaatgccaaaaaaataaatatttattttctttctttataccaccacattacacaggcttcatgaaattctgtgttgtatcagttgggaaacttctgaatgaaagtttcagaaaacacagctgaaagtggcttgaacaatagtgggaattgggagaaaaagtcaagaggttgtaactggaacatgaaaagaatgtaggcttcgctcaaatatttgtttctgtgtcacatattgtgcaaatttaagatgttttctaaattctctgaacttgttttctcatctttaaaatgaacacaatcatacttacataatagggttgttgaaagattttaacaccgtaaagtagttaaggcacctagtataatgcctgacacagaagtggcattcagtgagtggcagtgacaaagcaaatttccataattgtcatttgagagttcactatctttggtatgattgacaaaaacctactgaaggttatttgattcctctgatttattttttattctagtaagattaaaaattaatgccatttaataaaatattttaattcaataaataattctgttttatcatctatttgagttatcaaattatcaaaactgtaacatcaaaacactaaggttatattaaatgtttattagaactttaggtgcacatttatttagactgaaatattttatatttataatattcttacttgttctttggcccacttaattgaacattcgaagagcacaggagcaaaaaaaaagttctttatcagtaagattttttagacctctcatttgattagacatcacaggttcaagttttatttattatgtgtacaggttaggggctatgtttattgtttgacatgagggtcaacagatgaaacaatctgcctttgacctatcttttcaacaccaaccaacagtaggtttagagatttcctccccaccccatttatataggtattccttatggagatgtaaccttatggtgaaatctatcttacaacatgatatatgctagggcttcagttatttacatatactcatatgaactcgactcttaaattacagtggttacatgactttgatgtgaagcacagtctctgctcattaaagtgtaaatagaattttcctatttcccagtcatgccctctgataagtgaaatagtttcatcacaaaaccaagtcctactaatattgacatgaacataagacatcacatacacacacccattcatcgagtggaaaaaatatattttgttaacacaggagttgtttgactgacagatgatgataagcataaccattttcccaaattattatgccacttaataaaaggaagtgataatgccttgaggctttgaaatgtgataatgcaaatggatgcactgaagtgtgaatactcttcaaccatccaccctcaatacttccaaatgtctatctaccacacagaaaagagtttatattggtaaggtggggaatgcatgactcagcaatctagagcaagttgggtttgttgttgttgttgttgttgttgttgttgttgtttttgagatggagtctccctctgtcacccaggctggagtgcagtggcatgatcttggctcactacaatctcaactagagcaagtttctgtggttattttatctttctttttcactgtaagttaacaacatctaaaatgaaattaattccatttacttgatcataatctacctaatgcttaattttaaacaacaaaatatgaagtatgggcaaaactactaggtgtgttagtggtaggatgatacaaaactaaaagataaaagtgtaaatgtgtaaatataattatataccatctgccaaataaccctgctgccaaatttgaaataacttgtttcaatgtatgttgaatgctgccttaacatataatccacactatgttgaaaattgttttcattagacttgctaatatggcagtgctgagggacaaggtattgactggcagtgtttggatactgttttaaactcatgagatattcatttatttaaattaatacttttattcattcactcattctttcattacacaagcatttattgccaacctactctgtgccagacactggagatacaaaggcaataagacttagttcatacctttaagaagttacagtcattgtttacccagtgacatattaagctgttctccttctaattgaaaaaatggaagaaccaagaaaagtgcaactaaaaaggtagacttcacagacactggtaaccagaaacagtgaagtgtttttgtgtttgtttgtttatatctccagtgttgcttgttggagacataatagggtgacagggagctttatagatttatacagaacttccaaagcagtcctaggctctgtttgcttatactaaatgtctctttatcctcttttcttgttccttcccacttagccagctgaatcaccctttcagaaaaagagagggaaaaaaatcctatagagcctgttttgctttgaaaattttaggctgttaaagaagaaactgaaaacagcaggaacactgtttagtgtatgctcttagaagaatcctacctatggaaaggaaaagagagcctgctttatgcactttaatttcaccagccacatgtcacctctgtgtctaaaccacagcattatcatgcaaaactaggccaaattcagtctcctttaacctttctttccagctgaaacaaaatattaagcagttagaagtgatcttgaaactaatttgtagccccatcattatccttctacttaatacctggaaaacttctagaactaacacatgaagatttaagatgctctactgtttgtaggtgaaagtatttacttttcactaagatatataaaactaactttcttaggaactatcttgggataatgataataataatagccaatattttgcatgtgtttattatatgccaggcattgtgctaagcatcttacatggattttcttgctttaccctcacaacgctatgatgagttgcactggttatatagattgcattttcttccattcgttacctattatttctccataatacataggtaggatattctttaaaaaaaaaaaaaaagctagtgattaatttctcttctagatgccctctaccttttctaagtgccctggcagtttttatacactatcaaaaaaaaagaaaaacaaaagaaaaaaaacaaggaaagaaaaagaaaaaagaaaaactctccctattatccagtaagaatgagttcttttaaaatatcctgcacaatgctcagtcatgtcagatatgaggagaggagtcaaaagaaatgcggtcagtgagccattccacacctccaaagttttcagtcctatgtgggactagcattcctgtgaaagtgcctaaagctggatgtggtggctcacgtctgtaatcctagcactttggaaggcagagtcaggaggattgcttgaggccaggagtttgagaccaacctgagcaacatagccaaaccctgtctctacaaaaaattaaattaaaaaaataaagtgccaatagatttttttttttttttgagtttcgctcttgttgcccaggctgaagtgcaatggtgcaatcttggctccctgcaacctccgcctccagggctcaagcaattctcctgcctcagcctccccagtagctgggattaaaggcgtgcaccaccacgcctggctaatttttgtatttttagtaaagatggggtttcaccatgtgggccaggctgctctcaaactcctgatccacccgcctcggcctctcaaagtgtggggattatcggcgtgagccaccatgcggccaagtgctaatagattttgctaatcaaattgcaactttagatcaaagatgatctttcttcataatatactcaattccaccctatgaaaaactataaaaagaaacacatttaattaatagaaaaatgtaatcttaacacttctctttattatcgtttcatgacttcaggttctgttccttaataatgtatttgaaaattgtgtactgatttgctgaagttcatctgatgacaaaaggccatattaagccaattaacagtataaaattgcaaagggaatgtttaatccacacttacaagaacgtaattttaacatattttagagaaacaaattttcaagtcatttaaagcattcttatttagaacaacccaaaacataggaaagacttggattgattggaaaggttttgtttgtttttgtactctattttaattgattttgactttactatgaaaatttttaagcaaagaaaaagtaccaattcctaataacaatacccattaaccaatacctacatgttataattattgacagtttagcttttattggtttactgaagtatttttaaataaattaaatatatcatactttacccctaaatatttcagtgtgaaaaatagtattttcccatataatcagatcaccatgattatatctaacaaaacttatgacagttccctaatattatctaacactgtgcctataatcaaggttttctaattatctcccatgtgtcttaaaaattgttttgcttaagccaggattcagtcagcgaccacacagtacatctgattcttctgtcttatctgtctaaaggttagaatagctcccagccaccctaacacccccaccttttttttcatgatattgactcatttaagagagcatgccagttatcttatagaacataacaataacagccaatattttgcatgtatttattatatgccaatgctaggcttctgaatttgtctttttgttcctcgtgttgtcatttaactcgctgtaactagtaaggttttgatgtacgctgattcaaatatcaatgaagattgataatagaagttttttgttttgttttggtttggttttttttttttgagacgttgtctcactttgtcacccaggctggagtgcggtggtgcaatcttggctcactacaacttccgcctccgagattcaggcaattctcctgcctcagcctcccaagtagctgagattacatgtgcccacctccatgcttggataatttttgtatttttagtagagatggggtttcatcatgttggccagactgatcttgacctcctggcctcaaagagatctacccaccttggtctcccaaagtgctgggattacaggcatgagccactgccctggccaataatagaaatttatatttggaaatatttggtcaataacactagccaaaatataaagttactatagttaatttaaatttatcaaagttaaaatgttcacatgtgaaatatatttctgggtcatataattctaaaagccgactaaaattatctctatgagataaaccaaattcatgattaaacagcaaaaaaagagtatacagggaagactaaagtctccacattctcactgcccagagacaactgttgatatactgtcatatatattcttcaaaaaataaattatacaaagtagaattacttgatcaaaactatatgattttttaaatgttaccaattttccccacaagaaatttatactgatttatttgccaatagcattatgagatatcatgttttccaatactgagtattataaaacttaataatttttgacaatctagttaataaaaatagtttttgtttgacattttaacaattgtgagtgtacttacgacttttgattacatatagtagaaagtcaacttatactggctttaatttaaaataaaaatttgattagcccatataactgagaaatccagggatgggtcagttcaggaaaactggatccaagtgcccaccagaattatcaggatccacacctctgttacttttctacattggcttcattctcaaacaggcttccctgtgttacagtaatgatgtctttgtaaccccgctagaaaaagagagcttttcccagatagttgcagcaaagtttcatccgatcaagttgaattacctgtccatttctgctgcagtcatagtgccaatgtggataaaatattatgattgacaggtctagatcccatgcccacccagggagtcaggtagcgaggtcagctcacctgcaccaggtagaccaagagtggggaaggaatggttcacaaaggttgaaggcataatgaatgctaaacagaaaaaaagaatatatatccattacattgtaggaactggtactattttttcttatatatattggaaattggcatttattattctgtgaattgcctattcatcatatcatttcctcatttatttaattagattgttcattagcttcttattgatttgtaagagcacatttttaaggaaactagctcttatgtgctatgaatatttttcactttgttatgtctttcgatttttgcataaaatttttttctaaaatttccacatggaaattttatataatattatataattgggtcaatcagtcttcattcatttagcatttattgctcgcttaaaaaggttcaggtactgtaggtgtgagaataaagagatgaataaaagacagggagtttcttcgaagggctacactactgggttaaaaagatgagaaagttgcctattaccagatggtgtcatgtaaggctttacagatgcaatttgaaaaacctccaaaataatgagttgaagttccttagataaaaagggagcccgggaatttacttgagcacagaagtgtctgtaggtatgatttctatgttgtcataacagaattttcagaatgatgacaggtagttcatgactaaaaaacaaaaaaggtaagaactctcaaagcctcttctaaggattttcaagcccttgattacaaaagataacacgataacttagatatgttagcagttcaatgtcttaaaagtattgagataactaaaagctattgttagaagccagacaaatgagtcaaatatacccagcttcaagctgtatctagcacagagctgcagctggttctgtaaaacgtctagccactgactagcaacatgatcttcatttgacttttcttcagtgtactcatttgtaagagatttggtcaagtttacctgaatgtttccttccatttctgtggatctgtgaggaatgaggaattaagtaggaaattatgaaagaaaaaagtcacatcaagggccgggcatactggcttatacctgtaataccagcactttggggaggccaaggcagaaggatcacttgaggacaggagttcgagaccagcctgggtagcatagtgagattccatatctattgaaaaataaagtcacattaagatcagaatttcatatttagcaatgaaaaagcagtgcagtagtgtggaatgtggagacccaggtacctgtttcctcctcatgaaattaggttcgtattgaatgccttgctgacctcagatacttatgaaaatcagtctagaaaatggatgtgaagacaatatgttatacaaatatatagtatcatcagcagttgtaatagcagtagtgaactcttgaacattttatgtgtgcaggtttgagtattccttatccataatgcttgggaccagaagtgtttcagacttcagattgtttcagatttcagaatatttgcatatacacaatgagatagcttgggaacagatccaagcctaaacaaaaaattatttcatttcatatacaccatattccatatagcctacaggtcatcttaaacttttttttttttttaacaattttgtacatgaaatgaagtttgtgttaagtacgtatgtgtggaattttccacttatggtgtcatgttggcatgcaaaaggttttggaatttggagcattccagatgtcaaacttttggattagggatgctcaacctatgtaacagtagaatcctagtaccatgaacatcattaccattttcagttttttatgatatattagaattcagtgttattgacattgctttaactaggcctctgatttgtccttgacaaacttttttttcttgaaaattataatgtagtttggtgacattgaccattcatcagatcaatccacatttatttatttgtatttgtttaaatcaataactctgtgctcagacttttatgttctctaaaagttcttctgatgtctcatataataccatttatccaatatgttttatttatataatttttgtggtcatttttacttactaaatttatatattttatacctgtcctaagaaaagggcttggtacaatatgcaggtttaaaagatagaaaaatattggtaaatcaaggctaagatgacagaaagaggaaacagcaaaatgaaactaaagaaaaagttagcatgcagaaatacacatcaaatacataccagaatgtttcaaggtacaatctaaggtattgcatctaaacagttgttttaaaaacaaaagaagtatgtatttcccattaaaaattttaaaaaataagcactggaataaacacatttaaacaattatatttactatagtatttatcagagccttaagatcacgtaaatccccacaaacatctggtaggatttttgtttcatgtaataaagtcacaaaggtttttatttttaggaaaaccaagctttttgtggcactgaagtttgagacagatttctctctttggtcttcaaaacagggaaactgagtgataagagtagagaaaattctcagcattatttcttcactaactacagtagtgtttcatgtgaacatcctaatgctacacatgtaatttcccgtagattttataaggaatgtgaatttttttacattagtcacttctttgattcttcaatattggaaacagtgcctttttgcaagctatgtaggctttttagcagttttaaaaactgaattataataataaagttttatagggatagaaattttatttttcatttttgcattttttgcaccattttttcctatttgttaaagtgttcacctgtaacataaaagctaaaaaagacaaaacagcaataaatctaaaaacaggctttaaactttcagttaaacttttgtatatggtaacacttaaaaagtgcggaagtcactgtatccaaatgcccactgtttgacagaaaaggacactatttattgatgtagtaactataatgaaaattgaaaaatattgcaaagtaaatttataaattttattaagtgtagccttaccttttgaccagaattcttaccatattcatctgccaaaatcagatgatattgacattgcagtatttgctaaaatttttgaagtatagcaaacttacaaccttgtcagtatgtaggtaagtaggtaattgattgatagatggataaatatgatatgataggtatctattaggatctcttaagcaaatgtcatctatgacaaaattcttatttccccaaacatttggaagctttttgctttctaattatttattgctgtttgactgttagaagcaaaatgatagaaaaatattaagtacaaagcaaatcacttgcattatgtttcataaaagtaatttctaaccttattaggtaaaaattcaaaattagaaatacattttaagaagttactaatggaggcatatacagactttaatactgtgcaactgtttcctacaaagcattactctgtaaaacactgcaataacatgactttgatgaaacttgtgtaaaataaaaaatataagtatttacttttccttttccagaagtgtaagagaagattgaaaaagattagaggaagagacatgctcctttttaaagaatgttttgtgagattttacaggacaaacagtatcagttaagatcaaaccttagggattgcacagacattttatgcacgtgagaggtctattagcatattcacgacagaacaaagtattaaacattttcagtgctttgaaaaatatactcagtaatgggatggctgggtcaaatggtatttccagttctagatccttgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgcggttttgatttgcatttctctgatggccagtgatgatgagcattttttcatgtgttttttggctgcataaatgtcttcttttgagaagtgtctgttcatgtccttcgcccactttttgatggtgttgtttgtttttttcttgtaaatttgtttgagttcattgtagattctggatattagccctttgtcagatgagtaggttgcggagccataaaaaatgatgagttcatgtcctttgtagggacatggatgaaattggaaatcatcattctcagtaaactatcgcaaggagaaaaaaccaaacaccacatattctcactcataggtgggaattgaacaatgagaacacatggacacaggaaggggaacatcacactctggggactgttgtggggtggggggaggggggagggatagcatcgggagatatacctaatgctagatgatgagttagtgggtgcagcgcaccagcatggcacatgtatacatatgtaactaacctgcacaatgtgcacatgtaccctaaaacttaaagtataattaaaaaaaaaaaaaaagaaaagaaaaaaaaagaaaaatatactgagttagaaaaacatatctgaacatctagtaaagtataaaatatgtgggtaattttaaatgaaaaactcattactttcggccaggcatggtggctcacgcctattatcccagcactttgggaggcccaggcgggcgaatcatgaggtcaggagattgagaccatcctggataacacagtgaaaccccatctctactaaaaatacaaaaaattagctgggcatggtggcgggcgcctgtagtcgcagctactcgggaggctgaggcaggagaatggcgtgaacccaggaggcggagcttgcagcgagcccagatcgcgccactgcactccagcctaggcaacagtgcgagactccatctcaaaaaaataaacaaataaataaaataaaaaaataaaaaactcattacttcaattccgtaacagaccttacattcatttcactttatagcaattacttttaccaataatgtaattatgttgttttaaatattaagattttatgtaatgtttaacaaaattacattcccttttttacatctatctaaagagatttgagagataatgaaatttaacacaataaaatttaaaccttagaactttttaaaaaatctaaatttttatactgtcatactttgttttacaaaatgaggacaaaaaagtttaggaaccttaaaatattaacacttttgtgcgtgaaaaatacagcttttatataaattgttgagtctttgttaatcataattaaagttaacaaaaaatgaacataatttacaagtaatttaaatattcaggataagcacccttgcaaataagagtttattatggaaattctaacagactttttactgctgatgacctcattgtgttatttgaattagtctcctgaggccaaaagaaaaggctcataacaatttataaatgaatcttcctctcttgtgtaacattatgtgtccctttgaaacactaattttctactacttctcttgttaaaattaagccttcgagggatcttcatagttaattataaatattaaattttgaaataaagtagacattgtacttagtactcttgttttctctgtaaacatacttaatttatagtatgcaacttaaatcaaaataatgtgcttatttgataccataagcacggactctgtataccattaatccaaaatcagacaaaaactgaagctaaggcagtttgctatttgaaatcatgaagatggtatgctggaaattcctaatgattagatgtgctaaaattttgagactgtgatgcaattaagcacatgctttttgaagaaatcagtatagggattagcatcataatcagtaaatagggtggtggtactgataggagaggtcttagtggcctcagcaaaatgctttccaaggaatccgaatttcctggattattccatcacccttaggtgtgtagtttaacagtaaaaaggatagttgttccatctatatactaacagaatgagactaacattctatcaggcttccatatggagggttgtctttcacactctgggtaactggctgttaagacaaggttttcactaatatggttgtcaaatggtcaatctcttcaccttccctccattgggtttcctgtattccaagctaaattttcattatgtagcttattaagtagaaggaaaataacgaaactgttggtgtggccttaacagtttaaactagatcacctctgataatctagttaacaaaaacttggtaaagtctagatactttgtactatgaattatcctcttgggcagtttataacaagtgtaatgatttgtaattaatatcaaaatccagtatggttaaaaatgtaatacaaaataatgtatttatgctgtatggctaaaatgaattaacagtgaaatactgaaagtataaagatttattatctaggatatctaatatgactgtattaaacaaaatattttttttcttttaatagccaattggtgctttgaaccccaagagagctgtgttttatgcagagcgttatgagacatgggaagatgatcaaagcccaccctaccattataatacccattattcaacagcaacatctactttatcctggcttgttcgaattgtgagtatcttcattgagttagcttgcctttggtaccttaaaattttaacataagtaaattaaataaaaatcaaatcagttgtaatttgattaacaaagattagagacgagtgaagtagaaattaaagatttcaaagtagcaaaatatgaattttttttattgagttgtctcatttgcaaaattggattaggaagatagttatctgttgctaggtattatgagcttaaaccaaaccagttgtccagttataaaggagccaaaattgagtacatacctttttttttttttttttcagtgagagggtctctcactctgccactgaggctagagttgcagtagcactatcatagctcacagcagccttgaacccctgggctcaaaggatcttcctgcctcagcctcccgagtaactagaactacaggcatgtaacaccttgcgcatctattatttttttatttctcttctttttttttttttgagacagagtctcgctctgttgcccaggctggagtgcaatggcatgacctcggcttactgcaatctccgcctcccaggttcaagtgattctcctccctcagcctccagagtagttgggattacagatgcccaccaccacgcccagctaatttttgtatttttagtagagacagcgtttcaccatgttggccaggctggtcttgaactcctgacctcaggtgatccacctgtcttggcctcccaaagtactgggattacaggcgtgagccaccacgcccggcccagctattatttttaaacatgggatctcactttgttccccacgctggtctctcacttttgttctcctgggctcaggtgatcctcctgccttacctccctaagcactgggattacaggtgtgagccaccacacctagccctggagtgcattcttaatacccactgcctcctttctcacaaatgaggcacactggcacttgctctccccccctccctcattctttcttcttgggcagcatgttttaaaaccagtttccaaatgttttgaaaacctctttctgttacttttctctttctcctaggacataaatatatttaagtctcactgaccttaaaaaaaaaaagcctcctgccagcctccgcccactctgaagttctttcccatctctctccctgcacagtcagattcctgaaagcacaacctctgctgtcctgcagtgcactgtggtacctgttgcctctactttatcacctcccattcagtctttagcctggttgatttcagttccacatccatcactttactgaactgttttggggaggtcacatattatgcagatagagcatcccattttttacctatcatgtctcttgaagcatttcacgctattgctaatctctccttgaaattttctttcaagttccttttacaataccctctcctggtttgcctcctgtcatcctaactgttctgctcagtctcctgttcagattgtttttccttaatgttcctcttctacaggatttttctttatatttcagctgagctgtgtcattcagttacaagctagtgatttccagcttctctcttctttgcaaacatttctcatgggttcctgacccatatttccaagtgcctactagatatttctacctgaacatctcacagtaccataagcagcatttcaataaatgaactcctcatctccctcatgtacctgctgtggttaaatgccgtgattattcactcagctgcccaatctagaaattgggaagctttttcctagatattttctctgtctttccaacctcttacatccagtcagacatccacagattctaccaactaaatatctctatctccttttctgtatactgtggcactttctttaatttagattcccattctctctcgcctagagtattgccaaagctcttaacaaacctcttttcctttattcttgccttctccattctggtctagataggagcactataagtgactgaggagtattgtagaatgctaaattaaatctcttaatcaataatttttccccttattaagatatacctcagaccactctattgtatggggctgatgtgtccaagaaacacattggtaaagcagagtatatgaaactgcatctcctgtcttcgaaaatattttttcccttcacctaaatgacagctctagtttgtaggtcttccttaggcattctctccattatggggaaaaaattaactttctacagaaatttagtatgaatacattttaagtaacttggaaaccactgataggtgacaaactacaattatttttgttaagaaaaatgttgtcagaattatgattctgtttgagcacagattttatccctttcataattctacaccagcataagaagttaaggaagtctggactaactagtcttttgagaaaacaaacccaaatcttacttttaaaaatgaactctgtaatgataaactaaaggaaaagacataaaactatttttagaccaaagttattaaatcagtctagtttatccaaacattcaccttaattctgtgaacttggattcttttataaaaaatgtttctgagttagaagtttcttgagaaatactttttaaatccggcacttttaaagtatagatgttctcttttttattttctgttaattttgagaatattagatttatgtcattgcctatttatctctataaagcaatcagaacagagcatctttagtttctgggtgataataataattccagaagtaggaaaatacttcacactcacaagaggcaaatgcttttcaaattccagatacatggacacataaagagcttataacttccaacctgcagtttcagccacaagtcaaaactaaacaaagtcacaaaaatttaccagtcaagatctcaaaagagctggctttctttataatagatataaaatatgctcttaattgatttgaactctcaaatagtcagacaagaatacaaaaaaactaattaattggattcgctgatcaccaaatgatcagaccataaaaccaaaactacattctcaatcattactgccgccagtggaaaattacctattagctgtgcggaaaccagaaacaaacaaaaaaatcagtagaaggagtaaattttaaaacctagaaaaaaaaagtcactggagttcaaattctgtttgctgcctagggtccaccctggaagctaagaaaagatgtacctgggcttaagtagcccatgagatatatttcttaagctacacagtcaatttgagttcatcaggttagtccacatggaactctcaaggggaccaccaaaactgttagcaaaggaaatttttggaaaacactgaaactagagattttcaccctgggaggccttttcataccacctcaggtcccgtcaatgacaatcattgccttagtgagccaccaccatggagggagcaggacacctcttgcaggtactttggggatgaggaaaaaggtcaggagtccttcctgagaaaatgttatcaactgggttgtttggagaattaaatgagagtatatatatgatagtattttgaaatacataaagtggtattcactgtttttttacctaatcaagttagtctgaagccagatttacaagacttcttcaagtgtgactccataagaatacttgttatgaacagcctaagttaacctcatctatccctaatcagctaaacactttctcaaatcataactcagaatttattcttaagtagatttattattccagcgaaatggaattcaaacttgaatctatgcaagggtatgccagaatattctgcacatttatcctacacatgcccttgtctatagcagtgctgcacaacagaaatataatgtaaactaccatgtgacttaaaatttctagtagccacatttataagtaaaaaaagaaacaggtaaaattaattttaataaatatatttgttaatctactatttccaaaatgttatcatttaaacatgtaaccaatataaaaatgtaaaataaggcattttacattttacatttttggagggagggtactgagtctttgaaattcagagtgtattttatatttacagtgcatctcaatttgaactagccacacttcaagtgctcaatagtgacatgtggctagtggctactgttttggacagatctataaaactgcttttttggagactcagcccaaatatcttatgtcacgtggttataaataaaagtatcagtctaatggtttactaagtatttatccttatggtccagggaattgtaatgtcctcactcccattccaaggagtttatgaaatagaaaatgcattaaaatttgggtcactaagaatttgttcacaaaaataaaatacacattaaaataagtgtctgtcctttaccttagaccttttagacctagtcattaaacttgttatttgtttcaatgtacttagtataacaacaataataattgcttaaaaatgctaattaactacatacttcattactttaaattaaaaatattattttaaacaaactaccagtgaaatcacttgtctacaatatgagaccctgaaaagactgttttcctgacagctgccattgggcaaatcatgaataaacttatagcagtgtttggagtttcttcagatattaatattaaaagacacattttacttggaatgtttttactttacaacttaccctagacatataacatgtatacagaagtaattaaatctttttccctggcttgctgaccactcagtaactcgttcaccttccaaattcagtatattcaaccctcctattcaaaactcattcgtcaaacatttcataatttccaaggaagtgatgtttagaatttgacactttctgtgtaaattatggcttgttttgaaagcttaccctaaagcctctttaaaccataatgtgtctttaaaagtatatatgtatagtagaaacatttttgcaagtgttgtaactaaaaccaaaagatagtgctactgaataaaatattgttgtttatcttgaatactgaggcattaaggacaatgcatatttactcagaggaagatgagaaatacttaaccaagagcctagtgcatggtaggtacataggttaattagtgaaaacttttggaagattctaaaagatacttcttggctcttggaagagaaataggagaaaataaacttctggaattagacaaaggccattagaaataatggttcctccatttgttagaatgtgaccttgaattttctcagatataaaaggggaataattacacctactctgaagggcgatagtagggattcagttaacttagataatacagagcctggcacagaaaaatgctttgtagctgttatttcccttccctttgtattttattatgcttccaatcacttcaaatatacatcttttctttgctatagttatgtcccaggcactacctattacccataaacgagatttgttttggcttttaaatggaatgaagagaaggaaaagaagaacagaacagaactacaagaagcgaaggatgtaaaagattattatgagatgactaagcgaaaatcgtgtaagacagaagaatgaagaagttgagtaaagagaagaggcaacagggaaacggcattagatgcccacgatggaattagttgatctgtaatcatccaaaagcaagaaaggctgttagtgtcttcagaggggactaaggggtatgatagaatacagaaggacaggtactttccagtgcaggcaaggtgagttttccatcactgaaaaagggttggaagatatgaaatgatgttggagtggatgtaattaggagaagaaagtctgccattggccatttatattgcaggacctaacctgaactttgtaaagactaacgagttccagaattgtaattcctgaaattaccgtttaatatgtattcatttatacatcttatctcccatgcctaaaacttttctaatataatggtgaaatgtccaatctgttgatgtacacatggaaaatggcccaattgacaggtagtaggcaaataaatataaaagttttttaaggttaatatagcacctaatcctctatgttagtcagacatgagtcaaatgaaaaagaaaggctctgcattgtggcttgaaggtaaaagggaaacacatggaaaaagcaatctccacagtaatcagagcttgaaagatcaatacttacttataaacaaataggttatcaatttctattagtactctaccactgtagcaactggaggccttcaggtataatgagaatatatgtcagtaatgtaatatgtgaccttaagacagttgttaatcagatctttttaaaagctatttaaaacactgaaatgtggaattcaatattctctgcttttaggtgccaccagattcattcataactttgttaccggaaataaatataattctttaatttcagatttcttttcactaagcccatctgtgctattcttggcatgtctttgttaagagttgaaaactagacaggattttgtaatttaggttgaggtggagatcagcttttagcggctgatgataagaagtacggctttgcatgtataaatgggttttcactcacatctgtttaataggttaaaaaacctagagacaagcctgatccctctaaattaatctctgcccactacctacagtgaaaattaaatgccttacatcagcatcctgcaataataaagtgggttctgaagataaaactttttggtcaaacctactagtagttaagaactgaaaagaaaacccgtatcttactctcacccaccatactcccatctcccaacaataccttgtatgtttaggtgtatttaacacacatttgttaaacattgttagccatgtgctgtgcttggggctggggatagagagataaataaggccttaggaactggcagtctggtgggaagtccaacagtgaatacttggtacagtgcgtaaagctggtagtcattttcataactctgtgccaggtaagatacatcaagctttctctatgttatttcatttaatcttatttaatcccataattcccccaaggtattgtcattcccagtttacatagatgaaggaatggagacagttgcttgacacagttacttaaggttaagtaagcttgcccaagatagagaaatagttccaccaagattcaaacttaaatctgtcatattgcattcagtttaccattgctgcatctacaatttttatatccccattttatttaatataatttagtgacagatatgttattttcactaccttatttttaatagtgaattaaacatctaaaaagcaaataaattagtgaaagacatgtcatataatttttttctaacttaatttcactaacatttatttatttctcatatcacttaaaatcctaaacagcaatatggacttcttggatgcatatctgattttcaggtgaatcaatactgtcccccttacttgtatattgttttttcattgttgatcttatctctttcatcacccttttctctcatccaacactgaacatgaaatagtggcaacatattacaagtttacaaaattgatgacatctggccatactaaatttcagggagatattgaggaagatcagtatttgttgcttttactccaacagccagcccttaaggttagtggcaagaaagggagtttaagggggcaaagtatgtcccctttgtacatacatacaaaggaattgtaaagcatacaaaggaatgaacagagattacatattaaagaaagaggactaaaatattttggaaaatgtcatgtaggtttcttagcattattgaacctgggaatgacatgtcattcatcctagacttgagagagaagaattgaagcagggaaagggaaatatgtatctatctttgctataattgtagttaagaaatccttagcagaaatgaatgttatttaatccttttaaacttggaagcaaatttaatgacatcaaaaacataagaacaacctaagaactcccagtgtgagaactcccaacttaagaattacaggtaaagcattaaaattaaatgcattaggacattgcaataaagttattcctaggttttctgctataggaacatgtactggatggcagacactatgttatccaaagacaatagtcacagaatgcaaaaaggtctagttcatctactgtcatttgtacttactttattcttcgttcaacagattatatattgagcaacttctatgtaccaggagttgttctaagtgttggagataaaacaatgaataaggtagatacggaacctactcatagtggggaatatagacagattaacaatcaattaaaaccagtgtgataaatgtttcagtgctgtttgaggaaacacagattgctatttgagcatactggagagccgtggtagcgcaaggaaagtttttcaggagaaaatgacatcatggctgagtcttaaaggataaaaagaacttagtcaggtcagaatagtgaaataaatgggtaagtttatacccggcctagggaacatcacagacaaaggacaagaggtgagagtagtgtggcaagattttagagtgtgaagaggggaatggtgagagataagagttaagcaggttccagatcattcagcctcttgtaaaacaaattaggtagtttagactctctcctaatcactcccaagagctattgaaggtttttaagcagggatttgcattttaaaaacattatcagaccataaggtagtactaatactttcgtagtctttcacaggtaatcatggacattctctacctaattccacactgcagtgatcagtatcagagtgatttttgtgatcagtatcagagtgatttttgtgatcagtatcagagtgatttttcttattgcaatgttagtgtatatatagccttaattattcgaaagaaaaatccaacttatgaattgtcattaatgcaaaattatttatcagaaaatcgtagagcactggaaccccatcatttcacagatgagaagaccagaagcaaaatgacctgccagagttgcagactgacaactgctgccttggcctagtcaagcccagacaggcatctcctactgccttaatttgggggcatctttctaggaccctgatctgcctccacatcttgaaggattttcaagatagccatgtttcacaaaggaacgagggcagctgtgtttagagtggtcaaatttctgattctgtttttttgcttaggaacctttcacaaccttcttcctcaatgcaaatgatggaaaatttgatcatccagatcgaaccttctcatccgttgcaaggtcttggagaactagtcagagagatacttctgatgtaaaggtaggctcttttatttgttgatattcattaaatttcaaaatatgtggaaattttgatttttttaagtgggtatgtataagacattttatattgcagctttgttccatcatattaaaattatatggtacatctaaccttataggaaataattttgaacattatagaaaataactgaaaattctttcatattacccagtgaaggtgttttcgttatttcaaaaaattcctacctaatttagatcaaataatcaggagatgtgaaaagcctataaaatgcctttcctgctgttaactcaatatttggtccattccataaaacacagcaggaattggatttgaccttaatgtgtcatattgttatagcttgcctggcttggggtttgcgtagcctggggcaattaataaagcattaatgacaagacccatttaaaatgtaggcttttccgtatagccttagcttttacttgactgtgcctggggatactatgcaacaatacacattagattaaaccaacacacacacaatatccagaaacagccagagagcagagtaattttacagttggtactgcttaactattgttaaatacaaggatttgttattcatttatatgggctcctattttaaaaaagaaaaacattgtattcaaagcaataatatatatttgttctctcatttgtctcattttttttcctgataataaggttacatggccaggttattgcataggtaaatgtgtttcttattttaagctcattttcttcaaggcacatttttttcccattactgtcactcagtacaaaaatgttacggtatcattccatttagagccttaaaccaacaaaagttagtgagttaaaatcaaaattgtcattcacatatttatgcttctctattgcaaaacatttgtaaaaggcaatttcagtgttactgaactgtaattggatgaatacaagttttgttcagtatttttccaaagcagaaaataaaggaaatggagccaagtagattgtaacatatctgtgtgttttacttgttgttgtcaaactttacataaatgaatatttattcatacaacatatttacatttgtaaaaaaaataagagaatttaatatgcatccttactatattaagctttgaagttctaacggtcttacaactttgctgagacttaaactctaaaatatccataagccatcatttaaaatgatttgttaccagtgaagtcaaggagggagtctgtttcttatataataacactttgagaattaatacagaaaatgggagtccataggctcccattgaacagtagtatccagaattcacacaatgttcataaaaggcactcaaatattttgtatgtgaattaaatattcttatctgtaattgaaggcttcttatcgcagttaagattattgatattttaaatcagagctatatccatattatatcagcctatttcaaatgaaaatgcctgctcactgttgtttgacatcatcacacacacacacacacacacacacacacacacacacacacacaaattggcttttcaacttaattcagagatccaccctcacatatttgggggtcagtcattctaatttttatatacagttttagatttcacttcctagcctgagaatttcactgatgctttataccaccagtctctgataaccgatgccctgtaccgggctttttcctctaaattctcccagaaattttcctcttcaaaaccctttcagaaacatttacattttattactaattgtatttggggggctcctgggttcacatcatccaggacaaagaccaatgtggatatcactaacttgggagtttttttgttttttatcctcaagcagctgtactgaacacaaacatgcagctttttttttccccaaagacttaattagttcataagaagctcatttccccaggatgacattacacagattgctctcattttcagctctcttaccaccactcatgaacctttcatattatatgttaatacatcttagatatcttgccatgtagacttcccctttctttttaaaggcagcatgctacatatatacaataatttatatatgtgatctctggttgatggagaatctttctccctgattgttactatgaagcacaaggctgtagtgaacatctttgcacagacatcctgatggactccttctatatacataaaggctaattcttattaatgggactgatggctcaaagacaatatactttttttattttttaagatattgccaaaccatcatcctcaaagatgaaaattcactctctacagcagtgtgcaagggtacctccttccccgtgccccctacacccatcatcactattgtattaaacaatggaacttctgctagtctggcaagtgaaaaattaagttatgtttgttttagtttgcatttttttttgagtgacgtggaacatttttcatgtacttattgacctgtacactgactcctatctattgctcatttttcagttgggtcacatgtctttttcttactgatttgaaaaagatctttgaagttgcagaaggttccattgcaagtagggtttcttggtcgtcttagctttgttatggttcgtttaatgtgtgtgtgcgtgtgcgtgtgtgtgcatgtgtgtgtgtatgtgtgtgtgtgtccagtcaaatatatttatattcccctctatagcatcagaatttgaggtcctcatgaccagagtgttaaagagaagataagacttttgggtaataactagtgctaacttgagaatcttctgaattcatgattaaacctgatttatcagagaaaaatatgttgctacgagtagtaattgttttgctacttgtgtgttagaacctaaagtttttattcttatttctaagctgttaaagcacagcatgatatattttttaaggaagtgtgtttccatttccagagaagaaaagtatctctgcaatgtctactaacttagtcagttaatcacataggagagaactaggatgcagtagatggttttattctgtctgtctctattaatgtcagtctcttcctgtgctaatgaacgcaagctgggaagaaggagtgctgctgaagtgacctttcaggagagaggtctctggagttgagtcagactagttagtttttactttattattattttttaaatttctttccctctagcctagtcttggtaacaatgacattcaactcactgaagttcttacactaattttccttaatgccttcaaaagttgttatattacttttagaatagctatgtagatgtcagaaaaggtagctgtgacaaaatgtcattaaggtgacatagtgtaaattaatacagttaatggaggtgctcgccactgactcattgacccattatgagctcttgtggaattaatgaatgccagggcatcagtcttttgaaaaaaaaaaagaaagaaaagagatggcagctttaaaaccttgcaatgaattatattagaaaagtgaaaacgtctggatcggatttgatttcactaggaagccataaaatggtacgctctctcagcaaaatatattaaactgaaatgtcagatttgatgcaataggtatacaattatgatagtgttaatagtggtcttctatcattctaagacatactttcaggtccaatttctcagcagcttgaacttgtcataagcttataaattaggaatcgcatttgaggatatgttcttattttttgacagaatgtatataatactattaactataccgtggggttttagtgtagctgctaaaataaactagaaatcacatttatagacacaaaatgtctgctataatgttcattttgccatttctttaataatatttggtgttttcctgcactgtttttcatttaggaaattttaaactacttagactttttccttaaagagaagctgattaacagaaatttatcaatgggaagagagtcagcagaacagcagttatcttaagcatgcaatctagtgtctaatgtgcctctgtaggagtacacttacacattataaaaataagcccatcttttaaaataatactgaatagttttcaaacatgtttttgttggttgatacagtccttgaaacaatcctatgaggtagtagtcattaaccctattttgtaaaggaggttcatgaatattaagtgactcacctaagttcacacgcaggcaggtaaagaggaagccagtactagcacagagtctgtccagttatttaagatgcttcatatccaagaggattttaagaatgggagctgcaaggccacttcatgcctaggcccggaagtcacatcatgttacttccacagcgttgtattgctcaaagcaagtcatggggccctcccagaataaggaagagtagacacggactccacttcctgatgagatgagttgcaaagtcacatttcaagaggtcactgagggtggagggattactgtgcccaccttcggagacagtctaccacagtcctccgaatctggtcaaaattcacattcctcttacatgtaaaatatactcaacttgttccccacaagtcccatcccagtatttgtatcagactgaaaatctggtatcttgttgtctacataagccccaggtacagataaggcacagcaattcctaatttggagacctgggagctaaaaagacaaattatctgtcccatgtacacacaacatgtggtggtaagacagaacagttaaacttcggtagaaactccattcagaagggggagaatgtggaaggtacatagcagtcaatgttcatagcagttctgaaacgcagccaggaataagttgtcgattacccagactgcagggacagggactgtccatggattagggcccaggtctgttatctgggcttggctccttaattcattattttccatggctcttggttacttcctctgggacattggctttgccctctgaatcgttcttttgtttccagaagaaataaacatggtttgcagctgagtatctttctctgcatgcttcctgaccatagaaagttagggccaaagcctcatattcccaagttggtacagcagctttaaaactgtgtagcctttctgtgtatcaaattagaaaaagctaatactcacaaatccttttggaacaggattctctctttcaagctgtgaattaggatactgtttataatgccctaagaatccctttctcgtgaatcactctgtgtagctgagcaagtctgaaaaacactacctgaaattttaacttttataaaagggttttacagacacacccttgattttagctttattctatggccatattttacttgtagcaccttcgaattgatctccatcctgaacctatgtcttattttgagaatcttttgccaactgaagagagtgttctaggcccttctattgcttgaaatactgcttcaaaactgaacagtttcttcctgagttcatctctctcttgcatagcttatctcttttgcatagcttacaccattagatgaaaccattggtcactttcagcattctgcctggaaatcttctaagtcagaagcacatgcttattaggtacttgttctgtctttgaaattattgcagaagacgatgttaattttccaccactacttaagagggactgcttccaataacaacttccttgctgatcttccagaccccaccaggctcctcaccacccctcccacttctgcctgctgcctcatcgcaagccagaatcatgtgttaaattctttttattactttagcactccactttgaggattcagtttctgttttggtcatttatgactttgtaacaaatcaccccaaaacctataggcttaaaacaactatttattcatcgacaattatgcaatcagagttaaggctcaaaaaggacagctaacctctaagccacacagtgacagtggggcagcttgactgggcggcagaatctacagtggctttgctcacatgtcttgtgcctcatctgagatggctggaacagccaggaactgcctgggcatgtctgtctctatcacatgtttctatagcaagggagccactctattgcatgtggtaactggcttctaagaggactaaaacaaaagctgccaggcctcttaaactcttaggctgccctaagaagccttgcagtgtcaccttgtcacgttctgtgtgttgaaacaagccaggccatattcagacaagggggaaatagactccacctctttatgggaggagtaaactggagatgccaaagggcttgctcttgggatgggaggactgttatagccatctatgagaaaactctgtgagttaccaatttaaaaaatactttaagtactagtttggtttgtaccattctctacagtctgagtgtgcatttagacataaaccaaaatctcatgagcaagcaatttataaaatacatctgattagtttaggtaatatatgttagtccatatatatgtcaactttaaataaccatattcagaaaatatgattaagtgtaaagtttgtttgagctcaaagcttgagaatggtcaccccataacataggttcaagtagccctgaatatacactctgattagcagcaatcataaatgggtttttaagaaaaaaagaagaggcaggtcctaagttgcttaccaagaatttacattaaaataagataagccattggctatacattgttctttgtatcaccgatttcaggaactgaagataatgggtaaggcagctggtcagaaaccaaatgcctttttaaacagttgctccccaggcttgggttgaggaggcagcatgagtgactgatgtcccacacgcacgtctctctggacctgatgaatttttgcatgcctcacataactcagactgctgtgagctattcttttcctcatatttgctaaaaatacttgcatcatctgaactgtctacatagctattcattgaaacacaatccacagtgacagaacttttttactgaattacaggatgcactttggtactgggtaaactctagtctcagaagtaatatttttgatccgtgcccctaaaaaaaattgagaccaaatagcttctagaatatattttatataaagttatgaaatgtattgttttataaacattatttcatttaatcctcacatctaccctaagagttcattgctgacatcaccaccatgttacatatcaataaactttttgtcaaaaggttaagaaacctgcccaagctagcaagaagtctggattggactcagacctgtttgattctgatgtatgtaaggtagcatttccctggtagaagaagggacaatcccaatgctgctgcctgcccagcttccccctttatcttcaactcactggtagccatgaggttcctcttctttaagaaacacactttgagccgcgtacggtggttcatgcctgtaatcacagcacttggaaaggcagaggtggacagatcacttgagatcaagagttcgacactagcctggccaacatggcaaaaccccagctgtactaaaaatacaaaaattagtcagccatcatggcgcacacctgtaatcccagctactcgggatgctgaggctcaagaatcgcttgaacctgggaggcagaggttgtagtgagccgagatggcaccattgcactccagcctgggtgacagagcaaaactgcatctcaacaaaaaaaaaaaaaaagaaacacactttgaaaaccagggcctgcaaagtttttaatcaacatttcaatgcctgaaatttaggatatggtaaacatagtaatcttgattcatttttaatttcacaaatatttatggattacatattatatgttagcaccattcttagcaagatagacaaggtccctaccttttgggatttctattatgatgggacatgcaagcatacaacaataaatagagaaaataatcattgctatgcagaaaattaaaacagagtaacgtcatatagaatgactagatggtggccggatgttgtggctcatgcctgtaatcccagccctttgggaggctgaggtaggcagatcacgaggtcaagagttcaagaccagcctggccaatatggtgaaaccccatctctactaaaaatacaaaaattagccaggtgtggtggcacacgcctgtagtcccagctacttgggaggctgaggcagaagaatcgcttgaacctgggaggtgtaggttgcaatgagctgagatcatgccattggactccagcctgggtggcagagcaggactccatcgcaaaaaaaaaaaaaaaaaaaaaaaagaaaaaaaaaaagaatgactggattgttactttaaaaggcagaatacagaatataggagcaggaaacctggatttaaagtatctgggtttgatttttggccttactaccaatttgcagtgcagccattagcaaattacccacccaatctttacctcagtgttcatgtctataaagcgggaataatgagaacacctacttcacaaactttttgtgaagattaagaaaatatatgtaaagcacttagaacagtgccaagacatagaaaggtaccaaaataaatgttacctgctggtttaaaacagaatgaccacaggtaacatttaagttgattcctggccttggagcacaaatgtagtaattgccatcttcttgcacataaccagttaaatctcagagatgaaacgctcatattctttggtttatatttttgaaacaacaaatcttttcaataatggaattgtgaatataaattatactaatgtcttgtgtttacatacactaactttaaataaaacttgctatttgaaacaagattgtaaaacaataaaactgagaccaaaaaaaaatctcacctctgctgcttcagctacttctccctagacttcttgtgatttcacttcctctactatccccttcacaaaactccaaactatccccaactctggacttcgggttcagagagctttagtcactgatagctctggtgtttgaaacctctaggggctctgcaaacaagctgtgcttcagaagtttctttctatctgtgtttaaaacatgtctgtttagtgattgtttccattatgagaaatctgggagagtttctttgtcccttcaaacatcaagcctctaacagcttacatctacatcttagttaatgccctaatttatgaccacatttgggtggcctgataagaatggagccaaaaaaaccatccttacttagaagggtgtcctgaaggccctggtaacacgacttctttctatgactagccccagttagggcctccttgaatgatcctactggagtattcttcctcctgcccttctaaagaaccatcaagacagatctttctaggccttccttgttctttggtggaggccagctgttagtgcccttctttctagagtgcctaaatgaaaatgaaattagtcttctgccacttttgcagtttgagaacaattctgatggcaactttaaaatcaactttttctatatttaaattgagctattttatacttttgagccttttaaatgtaacttgaataagcaagataacattttttaaacagaaaagtttccccttaaaaggcagatttcatttcagggtttatatccttttccttttctttaataaagttcttcattcactctttccccatcttgaggcatttttctgaccatctgtgtattccccagatttctagtcttattaaaataacttcatccaatatctttaatagcttaatatttaatgagcacctgctgcgtgcaaagtatagcactgagagctacgaaggatccaacaaaacataaacctcacaaaataggctcaaaactttgcgtttgcccagattttattcatactaaaattgcattttccccaattttattcacattaataaatatgacatcctatgtttcttgcgcctttgtgaatctaatttaatgactttcagtgaaattgcattgtagtggtaagtaggttaataatgaccacatattttatacaggaaagaatgggaaataatatatgaaaaacattatagagtgccaagatggtataagataaattaagactattttagttgtttaaataaaactaaatatattttgctatgtacatgtagatatatacgttcctctctgccctcaaggaagcttctgtagcctcgttgtagagatagggcatgagcacaaataactgacgaaaggcagtaagggaaacacctgatttatgtgagtctagtacatataaatcacactcccaaccgagcagctgcacaagcttacgttccttcccactttggaccctttagggtgttattgctattgtgtcacatgaagaccaggtcatatgcaaatagcaatagtctttgccttctctgcgccttttactaattcctcatgttttcccaaagagtgagagtaagagcagaagaaactatatattttacattcatacattgaagtcataagataataatatgcatttctgattggatgccaatacatgagaacagcagtgattctttacttctactctcctgtcagcgatcaaaccaaactgctccttccgtgactgataaacactgtcatgtttgcccagcctggaaatcaaactcatgatagtcattgctgatagaatagtcactgctgaagtgccctttagcctgtcttatccttcaattaaactgtatgatttttggcaaatgaacatgtgttttctacagtatggtttttctttcagcctcttctccatttccccgttcatattggagtcattgaaaaattatattaatttgtattaattccactagaattctcttttcctttttcgttgtggccttgaggtcttgtacatagtttattgttgatacacatttggcccctagtgtgagccatctaattccctctctttagctctgttgtagatttcccctctttgataaagttccacaatagggcccctttctctccacacttagcagttgcccttctctctttctcctccctatacatgcatatacaccacatcttcccattctccaatctctcctttactttgtcacccagtgtcttgctataaaacaaatttgactgtgttaaaaactcttttttaaaatttctaaaccactaagacaaaatccaaacagcgtatccttcattaaacttttctcatccatctggcctcatatacctcccaccatctcatccctcccttgtcttgatctacccacaatataccctgttctcctcttgtgctcagtttctcaccattccatataactccctgagggtgcccggccccctcttctggttttcatcttagccatgctccaactccaatggcccatctccaatgaagtctctcctgacttgcccagaatcccctgctctttcctccctgctcccttcttcctcagctgctattgtgtattataaccatctggttctacatctgccccacaggccagactatgaattacttgacagtaaggccatgtcttgttcattttttgtttcctgagtacacatcacagtttctggtactaaaaacctttactgtatgcataagtaaatgtcagagaaatatgtaaaggattttagaaagatttctatttaaatagaagaaaactgagattcttaaaaagcaaagctccatttatccagaaaaatcatttatatggacctgttgatgcacccataatgctggagaaaatgaacatttatatttttcttatggctcacagtgatcatcataagagtaatggtcagtttcacacagagtgttactaaaatgaatgcccacttaaaacagatatatcagttttagtgggagaactcgtgaagagaaagattttatatatgctttttctagaaagttagggatccagtttatttgaagacctcagtatgtggtggttttaattttttctatgcatccctagaaaagactacagtgagatttaaatttcagatgctatgccatcaatgttgatcatattacacaaataaatgtgtagcctcacaaccctatcttgatatttgaaaaaagatgatcaggatggtacacataaaaactacagcagtttgttttaattttctcccaattactttttaaaaaacaacaaaaactttcagggtattaaaatcagttcatttctacatcagatttattctaaagtaacagaaacctcaaattagatgctgtacatcacacacaagttctccttgaatccagttgtttatgctacagttacatacaagtaacacaagttgtctttgcatccaatttattgagaacctgtcatttctatggcatgcattaaatatttaaaactgtttatcatattgtgtatcatctcttttattgtgttcagtgattgatataaaaataatttactttatcaagtaaaaaaaactatgaatctctttataaaaatcacatattgtaattgtcagtatagttaaaaacaaaagtagaaaatatgtgatctattacaaatactggcaattagtttttaatttggatagttcataaattttcagatgaagattttacacaacatagacttgtttatatagctttacatatttgttttctaatgctattgtgaactgttgttaatttgtatactcatttctcttcattaatttatgggaggataagattgaaaataggtaacattttaaagtagctatcataaacataaattttcaagtgaatttttcacaagaaatgcttcatctcagatctttaaataaaattaaatgaagaatagaatagaattaattcataaaatattggttttaagaaattattttattccatttatagttaataagttataagttaatagttttattcaactgatttttataaagtggtttaatatgcttcatttttattcctgataggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggtaagagagattttgcttttgcttgggcagtcatcagggagttaacatattctgtagttttgttttgtcctgttctttactataatattaccaattatacttaacatctataaatacaagcttaaaattttaaatgaaaaagaaaacattttactgttgtcttgacagcattccttattgtagagtggattttccgttcatgaggactaataaagcaatggtaattcagttatgtttgctcctttaggagaagacaatcagatgagcatctgttgactaatataatgtattctaaagtgcttaaaataaatgcctatttcttagttttatctactgactaaatctgaacgcttttttcacttataaaaacactcagaacagaaaaaaatttatttagaacatatttatatgtgcgatatttatgctgtgaaacataccttatggtgtaaacattctgaaatagaaaacatctttttttgttttgttttacagacagtgtttcactctgttgcccaggctggagtgaagtggtgcaatcatagcacactaaagcctcaaactcctgggctcaagtagtcctcccacctcagcctcttgagtagctggggttataggcaaatgccaccatgccaagttaatttttaaaaaagattttttttggtaagataggatctcactatgttgcacgcactgatcttgaactccggggatcaagaaatcctcctacctaggcctcccagaagaaaacatcattattttaagctatattacagatatctgggtgtttaaatgagaaatgtataaacagaatgttcacatatgggaatttgatgggttttaatacatttcacacatatttaaggagattttaatcccaacatggttatagtaggtgacaataaaccactttacaaaacagcctctctagtgtactcttgaattacatcaataaaaccaatgacgccaaatatatttttaaccctgtttcattcactcccaagtttttccaactgtctgataaatatattttattttgtttttacagcttatttatttgaatcagaattcaaataaggtccacacattgtgagggaattcacatattccttaatcctcttttcttaaagagcttaattgaaatataattcatatcctgtgcaaattgttcatcatttaaagtaaaaaaaaaatgaatattagtccattcacaaagttgtgcaaccatcaccacaatcaatttaagagcatttttatcacctcatagagaaccccataccttttagcatcttccccgatttttcctgatttccccattctccccagctagcccaaggcaaacacaaatctactttatatctccattgatttgactattctagacatttcatgtaaacagaatcataaaatatggggttctcctcccctcctctcgattttctgtcacttttcttttggactttactgtcagtcacacattttcttctattttggagctgtatgttctgtctctaagaaatattttacttttaacgtactttattttagaaagttgctgatgtaatatacctatgcttaaaagcatcatctagataatctgcaatgtgttctcccccctttttttttaagaaaatttcatgttttgcataagtcttattgccaatctctctcacttctcaatctgttaaattggcactttcagatatatgcagttatttcatactattcccttgaacaatagcttatttcttcaatttatatttttaatgtgaatgacttatatttcagtaatatatacttctgaaaatttctgattctttttagaattggtatttcatcaccacattattctcacatacttgaatgttatctgtaaatatcagtgtaaggataccagcgctacaaatggaaccctaaaggctcattgtatatcaatatctctcagtcacatcattccattgtagctccagagctcagagccctgcttggcacatactagttgttcaggaaatatttctgagtgaatgaatgaattaatgaattatagaggtgtagtaatctcatagctgttagcatatagtctattaagtccaaaccagtcaaactgaatgaatccttcactccggcaagcaaagtagccaatagttgttggaccaatgcttttgttgatcatgctattgaacagaattctcatatgggtgctgataataagtgcctcttacctgtcaggcattaagcaaggcacttgattttttttaacatttattttacagataagaaatatgaaggccagacatgtttcataatttatccatggcagagcccagattcaagtacagaaaagttttaactcctaagttatactctttccagtatgccagctacctctgatattatctcttctttgtgaaattctttgagattattcgatctctacttttaggtttataattgtcaatccagaccttatttatttcctttaacttcgtggacatggttaatgcagatcattcacagataaagactgcaagtatactaagcttaaatatgcattaaagaaaaatagagtggttatctttattatccactggacatttcacatttattaatttgctaatgtttactgataatgtaccaggaaatgtatatgacattttttagacttctaaacatgcagtaatgcagactggatgagcaggaggccactgttgtttcccagtcccaggactaggccacatttcctgctagaagagtactattttcagtggtacccattccattcagtgtacagataactttaggaaagggatttgccttcttaataaaagactgaaagtttgagaagaaagttttaggatgagcgaagatttactatgatacagggaaaggacgtatgttttttaaaaattggggaagtgggctctcatgtaaatgatctaaaccatcttgtcttaagtttctagtagaggcctaaattaacaaaattgtgttgtgaaaagcatagggcatttggcgttagcatttttgaaagcagttatgtaagatcagtttctcattatagttatttaagcagagacttttttgtattgaaaagaagccattggagagagagtatgatgtctcctttcagtttttgcagcagctcccttatcttgcgttaccaatagcaaatttcagtgagaacaggagtaactaagtatttaaactagtacttaattataatacaggtaaatacttctccagatagagaaagcctgcgcagaatgctgtttggaaataggaacacagctagtcagtggtcttggtgagaagctgcctgctctgtaaatgagccgaagtcataacaaagataggtggaagtaaaggtcctcagtgatatctcttcttaggagtacgtctgcactgatgcttccaaatgcagacataggaaacagtggactaagtgattggtcaaatgcctccagattcgtccactgaaaaataatttgtttgctatagaaattggtccccacagtttttcctcctttttgtcttcctctctgctcatagctcacactgtcttcttagctgttctgctgtgtttattgctttacctgattaatagacatggcaaaacaggctttaaagataaattggtgaaaccttgtccctacaaaaaatacaaaacttagtcaggtgtggtgacacagtgtctgtgattccagctactcaggaggctgaggtgggaggatcgtttgagcctaggaggtcgaagctgcaatgagccgagattgcgctactgcactccagccgagatcgcgccactgcactccaccagagcaagaccctctctcaaaaaaataaaataaaataaagataaattggcattcaacaaatggtgctggaaaaattggtgctagaagagttggatatctatatccaaaaaaaaggaaggggaaggtttcagtccttacatcacaccatataaaaaaattaactcaaaatagatcatggacctaagtttgaaacctgaaactatcaaacatctaaaagaaacatataggaggaaatctttgtgactttatgttagcaaagatgttttagatatgacaacaaaagcacaacctataaaagaaaacattgatacactggactttattaaaacttagcttgtttgaacactactgtaagaaaattaaaagacaagccacaggctgagaaaaaatatttcaaaacacatctaataaaggactaggatctaaaatatataaagagcactcaaaaatcaataaaaataaaacaatatttagataattaatttttttaaaggaggggcaaaagaatcttcagcgaagaagatatgtagatggcaaataaacacatgaaaagatgcctcatatcaaaaattaatccacaaattaaaattaatcaaattgaaaccacagtaagctaccattacacattagaatgactttaaaaattaaaagggggaaaaaaaaaaaaacctctgacatcccaagccctggtagagatgcacaatagctgaaattcacatatcctgctggtacaaaacagtttggttgtttcttataaacacacaccaaccatataacccagcaaccctgcttcttggttttagccccccaaaaatgaaaacttatacaagtacatcaatgtttataatggctttatttgctttcatcaaaagctggaaactacccaaatatttctcacctggtaaagggataaacaaactaaaataaactatagtaactccatattatgaagtactagttagccataaaaaagaaccaagcactgatacatgtaacaaaatcactttcttgctgtcacttggatgatgccaaaacatttttaacggctttattaaaatataagttatatatcataaaattcacttgttttcagtgtacaatttaatgatttttagtaaattttaacagttatatgaccatcaccacagtctaatcttagaatattttcaccaccccagaaagattccctgcccacctccagcccaaggcaactgctaatcaactttttatctccaaaggtttgccttttctgtgtatttcatataaaaggaattatacaatatgtggtctttgagtttgacttctttgagtagtttttgagattcacccatgttgtagcatgtattggtactttgcccaactttttacataatactaccacattgtgtggaatatcacattttgttcacccattcatcagttgatgaacatttgatttgtttctactttttggcaattttgagtaatgctgctatgaacagtcatatacaaatttctatgtgaacatacatttttatttatttggggtatagacctaggagtagaattgctgggtcatatggtaaatttatgtttaacttcttaagaaactgcccagctgtttctcaaaatgaccttgcattccccagcaatgtatgacagttccagttcctccatagcctcactcccacttgttattacctgttttttttttttattacagccattctagtgaatgtgaggtaatatctcattacaatatttttttttcttttttttttgagacagagtctcgctctgtcgcccaggctggagtgcagtggcaccatctcggctcactacaagctctgcctcctgggttcacgccattctcctgccacagcctcctgagtagctgggactacaggcgctcgccaccacgcccggctaattttttgtatttttagtagagatggggtttcaccgtgttagccagagtggtctcgatctcctgacctcatgatctgcccacgttgacctcccaaagtgctgggattacaggcgtgagccacggcgcctggcctacaattttaatatatattccctagtgactaatgatattgagcatctcttcatgtatttattgaatgctaaaacatttttagatttattttaataaaacatttagtgattcattatagacacagaatttgtgttcttcatagtcaaagaagtttgtatgcccccagaattaataattttattactgatgtgcctaaatgaaatagaaaagccagtcttgcttttaaagacaaatcccctagacagtgttataccccaaattttttgaatgtaggaaaagctaataattattgttgatgagaaacctttaaataattaatgttggtataagctaaacaagcaagacctacctatatctgcagaaaatgctacattcaactagtgtgttgggtggtaatgcaatccaactaaataaactttccagataaatgaattttctagattttcctaagtgagaactttttagaagcattatggttatctgttaagttttattttatttttaattgacaattaataattgtttatatttatggggtatactgtgatcttttgatatatgtatacaagtcagaatagttagcatatccatcacctcaaatatttatcattgctttgtggtaagaacatttaaaatatattttaaaaatatatatatttacatatatatataaataattaactacagtcactttgctgtgcaatagaacaccagagtttattcctcctaactgtaactgcaccattgaccaacatttcccctttccctatccatatctcccatcagcctctggtaaccaccattctactcactacttctatgagtttgacttttttagattccatacataagtgagatcatacattatttgtatctctgtgcctggcctattttatttaacataatatcctccaggttcatccatgttgccacaaatgacagaatttcctgttatttcttaaagctgaatatcatttcattgtttatatataccatatttttaaaatccattcattcgttggtagacacttaggttgcttccatatcctggctattatgaataatgctgcagggaacatgagaatgcaaatatccctttagcatactgatttcagttactttgggtaaatacctagtgggatggctggattatatggtaattctatttttagttgtttttgtttgtttgtttgtttgtttgtttgttttgagacagtgtctcactcttgcccagactgaagtgcagtggtgcaatcagtgaccactgcagccttgaactcccgggctcaagtgatcctcccacctcagcctcccaagtagctgggagcacaggtgcatgccaccacacccagctaatttttaaatttgttatagagatggaagagtcttgaactcttgggctcaagtaatcctcccacctcagcctcccaaaatgctgggattacaggcatgagccaccaagccaggcctatttttagttttttgaggaatctccaaattgttttccaaaatggctttactaatttatgccactactaacagcgtagttgttccccttttctccacatctttgccaacacttatctttcatcttttttataatagccaatctaacaggtataaggttatatctcactgtggctttaacttgcatttttctgatgattagagatgttgaacattttctcatatgtccattggccatttgtatgtcttcttttgagaaatatttatttaaattctttgcccatttttaataggattatttgtttccttgttgagtagtttcggttccttgtattatggttatctttctaaaatttattactactttgttccctgcccttttatacaaggaatgatacttcattttttacttaaaaaagtcaagtttatcatcctgagtacccattgttattccatgaagtgatataattccatatctattattttctactttcttcttcaggttgtcagctatcagtacagttccctttaatagccctcagccataccaatgaaaattggttgtttacaatctcttctagactacaaaaccagataattcattgtatcaagcccttattataaggcttaagaatcagtcaagtgctcagtgaggccgtagaggaaatgtgaattttgtagctctgatagggagtgactttagcctctacctcaagtttcactggccactgctgatttggaagttgtgtatcaacagatgaagtgacaaaaccatccttagtaaattaatgtaactacaggcagcaccaggttaacacttcttcttacatgcaaacagctatctggctggcctaaggcattcttctcccctagtatagctgcttgcatttgtttctcctctttcctcattccaagacttaactgctgacaactgctgcaaatcagaatggataccctaatcttagccaccttaccccataccctagtgatagtcctgagtcatcctgatatgaaggttgaccaggatatcataatggcaatgatagtgcttgtaggacatgccatttgagtgtgtattctgtgccagatactgtgctagaacttcaggtgcatcattgttttaatccttaaaaaatcactttcagaggccaaggcagatcgatcgcttgagaccaggagttcaaggaccagcctgggcaacatgttgaaaccccatctctactaaaaatacaaaaaaaaaaaaaacaaaaaaaaattaacaaggcatggtggtacatagtcccagttactcgggaggctgagtgagagaatcacttgagcccaggtggacagtgaggcaacatcacaccattgcactccagcctaggtgacagaataagaccctgtctcaaaaaaaaaaaaaaaaaaaattagctgaggagttattgacctgaaacccattgaggtaaaaatatattttttttgagacagagtcttactctgttgccctggctggagtgcagtggcacgatctcagctcactgcaacctccgcctcctgggttcaagtgattctcctgcctcacccttccgagtagctgggattataggcatgcaccaccacgcccggctaattttttgtatttttaatagagacagggtctcaccatgttggccagcctggtcttgaactcctgacctcaggtgatccgcctgcctcagcctccaaaagtgctgggattacaggcctgagccaccatgctcggccccattgaggtaaatttacatgccaaataccaccaccttatcaaggtgtcagtgttcttattcacagtctccaggataggtaagtggtggtggcaggcaagaggagccgtggaggagaggagaaaggagaagagaaggaaatccgaagccagctccgtagggtgagcagaagatgggaagagatgagaattcagcatggtccagccccagcagcttttagggcctgactgtctatggtccctgtttctatatcttttaccctccacccttacccgtaaggcttcctttcactgccaggaaaccctgaacttacagctgaggaagtgccagctctctctgcccatctggtatgagaggaagtgtgtcctccttcaattctacaaatggaagaaatgatattcatttacattctaagctttgtagtcatgggattttagaactggaatacacctttatttgaatgaggagtctgaggcctaggaaggcaaagtggttcatggaaactctgaacccaagtgcttttctaactaaccatgcttggtgtcacaagttggaactctgaatgtagtgtccccttgttccgtcttaaagtctgtaaaattccacctgtattttgaattaaatttaatttatagattgacctgcgaacaaaaccatagtagaataatactgtttctactgcaatatatattccaatcaccaaattataaagaaactttggaatatcctgtttgttatttgcaaactgtctgtatctgtgcttagatggcctccaaacacctaattgtgacccagacttaaaattcagttttcctcagtgacactctggtctgtctcagtacacatgtgatcaatacacaggttttcttttaaaaagtctctttaaaaaacctgattctcaccagatggtttcatgacatttgggttttagagaattaacagattattcattgaaaggaatagcctgaaaaattgtataatactataaagacaatttaaactctgaagtaggttttccctcttactgtaagagagaataaaacacatgaatacaaattctgagtaacaatttttaaaatttataattgctcagagtacttatattgcacataaattaaatataacaaataatttactcctgatactaatatgaccagtttaagaactgacttctgtttatatatacttcttacctgttataacttgtctttttaacatctaaagtgctgataagcagactttattcaaagtgtgcttctttaaaataagcctcacggtgtagcatccctgtaaatacatattaatccagccagctgtgtgcaatgcactaggaactgtaaggattcatatgtaattcagtgaagccactgttcctcaaatatttactctcgcagattcagaagaattaagttttacaactaatatatgaaggatacatattgtgcatctctggaaatataaaacattctcagaaatgaatagtccattttaattgtaagtagtaagttccaacttgtgttcatgaaggaatgagagaagcaaggcactgcagtttccctatgttctaaaccaaattcctgttatttcatcataggaattaatggatctggtaagacttgtgaactgaaactttattccatggagcgaaaggctttatacaaaattctgcatattcaggataattaaactgccccagtctgtgttctctgcatcacctggaagcagtgccgggtgaaatggatcacgtgtaggagtgcctcacttgaaaagtgcttattgtttctgtgttgtgcttctgggttttccttgaaggaagcctacggaatagaaagggaaagctaccttgtgtgtcaacaaaaagctgtatccataacagctatagcagccattcttagttgcttcagaattagagctaaaggaaaagcccacactgctgcctctgagaactgtcttaagcatcaacgctacgcaaagacatctcgtgaaatgtggctgcatgattctgcagctgctcgtctctcagtgtctcctgtgctgcttcaacttgaagttttccttcatagcacctttttcatagtttctgttgctccaactcctggtcggttttctcatcctactactaggaaatgatcatactgatctcttgcagaaataatgtcagatatctgtgttaaaactaaaaagtttaaccagttatctacatatgttcatacttgctgaaggaatgtttatttggtgagtatttatgtaatatacaaagtctaggcactcatataaaatatcaagtatttaaattttccataaattccttgaatataggctgtattttttatgttgttttgtaactttaaaagtttctaactttatattggctgggtaattcatacaggatttagttcttatgaaatagctttagagaaaatgtgctctagtatatttataattttgactaggattatcttcagttatttgaaagagttctttgtaatgagcctaaagtataaaatgaaaatgtcatatattccaaagagatgacattcacagtggtaaaaaacctccatttctttgtatggattagtattctgtacctatgagtattccctccttctttcaaactgtcattaagaaattcaaggcaaagatgacaaaatattataaaaagtgatatcattgatgattaaatgcccagctttattactgcatgccagcaattgaacagcaggtatttgatgcatttgtagcagactttacatgtctacaacctaatttcattttttatttttttaaaaaatgaagcagtactttgttgtttaagttatggacaataacatgtatgtaattggttagaattgtttgttttgtaaatacagtgccaagagttatgtttcgctgtgaaatacaaagtttactctcactagaaaacctggaaaagcgatacagacacatttagtagacatttcaatgcattctaaggtcattaagtttatacgtcaagaattggtttaatttatccacatgaagctaggcttattagactgacttactcatgaaacattaataaagcattgtgtttagttctaacctgattataatctgaccttctgacaaaggacagaaatagaaagtatctgataacattaccctaatgctgggttcatccatcataatctacccttttaaaaatttgttttagaaaaaggccctttcacggatgtgcattgataatctcatctcgccctcagcccagcagattcctggtgctgctgggccaagtacaggctgtctgcagtcagcagagcatgcacagcaactgaggcaggggaagccaagctccagtgtggctctgctcatattgtattataacctttacagaatgtccgtatttcaaagaaaatgtttcctttttaagctgggttttttttttaagtagattataccccaaatgcaaatgtaaaaatttgcatttggggtataatctacttttaaaaaccccagcttaaaaaagaattttaagcaaataacataagaatttttggaagtcttatgtaggaattcaaaatatcaagatagacatcttgtgtttgagtgccatctctggaacacctgttagccatgtgttgtgctgaacccctattaacttcaacagggatggcaccaggttctagaggccaaagaagagacccagagccagtgagcatgacatagagttttactggggacttacctatcggggaaagtccagtggtagcaggctggacaggagacccatatggctcagtggcagcagactggacagcagaactgcaaccgcttgcaaaaaacctgctgtttatatcacatttttatttaacactcccccacccaaccacaacatcctgtatctggcaaccttcatttaacccaaaacaaagggccttgattcccattatggcctgagttccaagagatgggccagagggggctcagatattcttcacagataaggaatggatctccaggttggccaccccaattccctagcttgagactctcaactgcattcaggtgtgtctgccatacagggtctttctcaaggtttgttcaagtcatcactgtcaggtgcagcttaccgcacaccatgacacttggaagtaagacaccctatctcttggaactgcagtgtcctccttatttctcaaattgaggacttgttcattccataagtctttactgagagctagttatgagcaaagcattatggaaaatacaaagaatggccatggatcctactctaagtgaagttagagtagagaaattccttcgttcattccgtaattatgaaggggctatcatgcacttcatcctgctctgggctctgggaacacaaggatgagcaactcagtgagtggcttcagaaggtgcactctagttagggacacagacaaataaacaaacagtcccagtaaacactgatagtgtttattcaacagatacctgttgagtgttccgggtgatgttttatgtgtttgcaaggatccctgccgtcctggagctcacttttgatcaaagggagacaggcgatagacaattttttaaaagtgaaatatctagtatcttagaaggtgaccggtggtagaaaataccactgcaagaaaaggagactgtgagtacctgcaggggagagaggtcaggacagcctccctatgaagggagattagaggtaggcctggaggagcagagggagggagccaagtgactctcttggggaaagagcatggtgggcaaagggaacattagagcaaaggccttatggcagggatgtggttggcaaggaggccagtgggccaggaaagggtgggcaagtgggcacacagtaggacaagaggactgagtagtagtgggggagcatcacacagggtcttgaaggccatcataagtactttgcctttttaccctgagtaaaatgtaaagtccttgcaatcttttgagtggaagtgtgactgatcttccttatgttttgaagggatcactctggctgcagtgttgggaatgaatgattctgcaagggtagaatcagggagatctgctagaaggtaatttgagagatgatggtggcttggaccaggggtagcagtaaaagtagtaagaaattattgattctgggtgtattttaaaatttgagcctatagtctccctgggacttcctaccagtggccattttccctcaggtatctctagtcttacagaggcaggtgaagggctggggatgagcatgcggagtagtgatggctacagcagcagagatagataaatccatcttagcagaacattttagagagttcagctaaaatgaaagcgtgggtgtttagtgcctgttgtcaacttggccctttagcagaaattctaagcagcggaaaaagccagagtcaacatgtttatcctccgctagactgtaatctttttcaggacatcgaatgcttattcatctatgtgtcctctaaggctaatgtctgacatatggttggtggtcagtaatctggggcaggagagatattagactatattcaccttgtttatttgcatttcagtgggatctgctcccaaagatcagaggttttgtcttgtttgtcacagcatcccagggcctagaacactgcctggcacataacaggtgctccatgttgaatgaatgaatgctccctctgtttgaaatgcccttctcccagatgtctttatagttcatttcttcactggggtccttaattgtcacaaactcagagaagccttccctgacctcctcccctaaactagcaatcctcccccactacacatacaccctactccccatcctgcttttctgtttccttcgcacttgtcacctgctgacacaccctgtatcttactaattatgttagtttttgttggtctcctcccagtacaatgtaaactctcttgcagggactttgggtttttttgttcactgctataatcttacaatctagaagagggtctgtcacaaagcagatggccaatcaatatttgctgagtgaatgaatgagcttcttccccagccccgccctcattactgacatttcctttattccttcctcttgtgatcatcacatcttttccactgctttaattaataaacctataaatatttattaaacagttattatccaatgataggttaagagttgtgggaaatgcaagataagaattagataaagtccctatcttcaaaaggcttacattctaattgaggatatagtattaactttggaaacaatgaagtgctaattggcaatcatcccattcatttgtacagtacctcacagtttgttgtaaaatgatttcacaagtaaatttgcatgtgttatcttactctattaagtaacaagaggatactgatgaaaagtgttgggtagaaattcatagaaaaaaacaagtgagagctgagaacacaggaagcaaacactgaacttgagtaagaaggatgagtaggtcttcaaaaagcaggaagacaatgctttcaagctagagagaaagaaagcaaaagctctgaggtcataccagctgctgtgtgcccaagggctgtgaagtgtctgtgctggggaagctaaggatttatatcaggaagtcctgagaaacagtggggaaaggtgggatggaggtttgaaaggcctgagtcacataggttatgctgggaggagcagtggcagctttgaaaaagagaatggcaatgtggacatgatggcttgacaagtctgtcccacaagcaggacaccagacagactggattcagaagaagtttgaagtatgttgtagtaacccatgtggagagctgtgagggttagaaataatcttctgtcttatacatccagaaacagtcaagtactggaataatttaagccccttaaaataaacatcaaagacaactatattgtctctacttaaaacagttgaattattgaagttgtaatagctacaacttcagtcaaattatgaaaagaagatggcatagacactacagaagtgacaatatggctttctgattatctacttgaatatatgcaactctatttagagaattttttaatctcaaaagcagatttttgacgtaatgagaaaaagggatgggaaatatttttgctctgatctagaagaagacatgggtatttaatattcttaaattttaaaattcaggagaaatattgtctcctcacagttaaatttggtagtctactttcttttttttcataaatttcggagaagctttaccccaaacctgctagagaaagaattctgtaccatccaatactcatgggagaaaatagaaattagaatgagggaaatattatccatctaagagatatcctctctagtttaaatatcactctttatttccttctttccagatccccagggtagagctctggattgggaattggtttatctaggcttaacgcaattgcttctgcctttagatatgcaagtagagggtaaagaaagctattaagaccattatgacactaatagcttagtaatcaagtatttctttacatttttccaatgtaagtattgtactaaaaatcccgtttcaaagtgccaaataggtttgtatataaaaatggttctgaaaagaacaaaataaacagataccaatgaccggtcaatactgtttatagtaaagagtcttaatgtcaggcttcagctttagacaagttgttatattttaattattgatagctaatgttccattcttagatattcatttaattttgaactagatttagcttttaaatgtgtaaactgtatcttcttttctttctgcacagtaagtggcaagataaaaaatcgacaagactttgtttaacctcttacctcattgttcctttgccatttaattttataataaaaaagacaaaattatttaactataattaattatttattgattcactatgctgcctctctaagatatagaatagggtaaataactatagacataaatattttttaatttaattaaagactattatgagcatctatgagctaataaatcttaaaactgagatgaaatggatgaatactgagaaaaatatttaaaatgtcaaaattgagacttacaaggcttatggaaatttaaatggtaaaatcttcccatcccctcctcaaaattcaaggcccatattacattacacgtaaattctaccaaattttcaacagataatgaattcattttcttatacaaattgttccaggaaacatggaaagctatccagctaattttatgaggctagaattccaaaaacagtgaaggggaggaaaaagaaataaggcttatttcatgtacggctataaatataaaaattctaaatgaattcttatcaatgttattaaatgtgtgtgtatatgcctgtgtgtgtgtgggtgtgtgtgtgtgtgtgtgtgtgtgagaattgcatcaggactaagtagagtttaacccttaagatcaggaaaaagatagggattttccacatcaccactgctgttttacatagttcttaaggctaagaacaattctataagaaaacaaaaagttgtaggtgtaactactaagagtggctacaaacacaatcaacttctagaaatcagtatcattgttctacatcattaataaccaagtataaaatatagtttcaaagtattacagttgcatcaaaatttatgaagtatctgggaataaacttaaccaagaacactaagataaaacttttatggagaaaattttattttttaactctaataaaggacatagaaaatgatctgtataaatcaagatatttggggaccttggatagtaaaacctagtgtcagtgttcacaaattaatgtataaattgattggcattccaatcaaattcttttgatatatctatgcacttaatgtaaaagttacaaagaagaataaatgttcctgaatagcctagtttatcctgaaaaaaagaataaattctagcacatattgagatatgtaagaaataagataattaagataaggtaataatagaaatgaaaaatatagaaagctggacacacatacgttgacatgataggtacatagaagagagagcaaaagaatataaagataaaataaattaagataataatagaaatgaaaaatatagaaagctgggcacacacatatctagacatgataaatacataggagagagagcaaaagaaaaggaggaaggagactgggcttctatgtagattatgatattatctgtaaataacggcagctttatgtcttcgtttcaaatatatatttacacagtaaagataataccatacatctctgagaaaaggaatttttgtttaatagatggtattggaaaaactcactcactttataaacaaaaataagactggacccatatctaatatcatatatgaatgaaagtagatgtagattaattaaagatcaaaatatgaaaagtaaaaccataaatataaagctaaatgatacaaatatatttatctctataattcaagacaaaacctcaaagcataaacatttttaaaacatgatttgatgatctcaaaattaagaaaatatatccaacaaagaacatggataaagttaatagatatatgacatttgggagaatgcatttgcagtgtttcaaaccaacaaggaactcttatctaaaatatataaatcaggccaggtgcagttgctcacatttgtaattccagcactttgggaggccgaggcaggcggatcacgtgagctcaggagtttgagaccagcctgggcaacatggcgaaaccctgtccctgcaatacaaaaatacaaaaattagccaggcacggtggcgcatgtctgtagtcccacccagctactcgggaggctgagatggaaggatcactggagcccaggagacggaggttgtagtgagctgagatcgcaacactgcactccaccctgggccatagagtgagatcctgtctaaaaaataataataataaaattaaatatataaatcaacaatataaagacaagaacctccagtgtttaaatgggtaagggatatgaacaggaaatttacagaagaggaaacccaaaagaccaacaagcatattaaaaagatgtcaaatctgttagtaatttgaggaatacaaattaaaacaatgagatattattttgtatctcttatactggccaaaattagaaacctggataatactaacagttgatggagataaggacgtatagaaactgtcatgcattgctagagagtgggcacggatgactcacattaagtatgcactcccagttctactccagattataaatcccaaagaaattctcagaaagatccaaaaggggcatttatcacaggcttgtgtcatggggattagaggtagcctggtgtttgttaccaggggagttttgtgcagccatgagaagcaatgggctagtcacacagtgacacaggtagatttttaaaataatactaagtgagaaaagtaaggaacaaaatgaaatttttaaccctatatatttttatagttcaaaagtatatccacaaaagaatgagtaatattttataagggcacatgcaaacaaaaggagaaacattaaatacattatagttattgcccatggtggtggaaggaaatgaaaataggagatggagataaaagagaaaaaacacattttaaaagctcaaattattgaaaagtcatcattcccactaccactcatgattccattaggtattttattcaataatggttttactctaatagagataatagtaaatttcatcaaacctttctttagtggtatctataagatatatttgtaatgaatgcgcttagctgatcatgttggtaaaatcttcctttaaattatttatctgattccataactaaattgaattcctgtgaatagacttgagcagtagttactcaataatgaacctctatttactcattttttaaatcccttcatttattgcatcagacactgaaaatattactaaataattagactgacattttttcttaattgaatagttatagagaattgacaaaatcatttatacaaattgaccaaactaatatagacataatacagaattttaaccatctcttctttcagactcatttcctgtgttctactctgaactgttatttcaagatcgatgagatagacaatatagaaattctgtttgcctttagtatggaaactgttctttcataaaatgtcattgtttacattgctgaatgagaaacatccacactaattggtgtagatgaaatacaaaaaattttgaaaggaataaatcaggaaagggattgaagggaataaattactagttaaatgtgatcacaggaaaagttgaaaagtattatttataatattttatatacttaaaaaatgaaaagcagtttttggcaatcttaattcaagaaatcatttattcattaagtgaattccaaattggtttcaacaccatggaaatcacagagaatgactttgttcacatatttagtgaccgccgtaatttagaaaattgtcttacatggctctgcaatagctgaaatttacaaagctagatgtacagctcttttccatgttgttgaaatcagtgtcctctttaaatcactaggaagttgatgataaatgactgcagtaagtgagaggcgtagtgagccatgcaccatcactacttatttcacggacctgagcaagactccctacctacctgtcaagacacctctaggaagcttctgatggcttcttaggaaataaaaaggccttttttttttcttttttctgtttatggaaacttagtatgggccttgactctcagtaatttatatttctttcccattagctagcaaacatccaaaattgcccagtgattcccaaactgtgtaatagctgagttaattcatagtggaagaaagatattcccttctagtcatctcagaggtaagctggaggacttcaggcaggaaaataaatgtatatcagagtttctcataaaattgcttaatttcaaactaatatttaaaaatgagaaatgaaactgtaacatggtattaaaaaaggtaatttaaattatttttcttttaaacatgagtgtgttttaataagaaatttatttatgttaaatcatattatgtacctaatggagccaagagaaagtttagcattttagaaagggaaaattttcatttaggtctctgtactttcatttaggtgtctgtaaaatactactgaggtagtatttttccatttctaggaactgaagatctgatacatataaatcaagtacagaaatttaaagagcatattctcctttttatatatatttcaaagtaaaaaaaaaataaaaggatatgaaggtgtactaagttttgatggtctctcatttctttcttgactcatttcaggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggtaggtgttaaatcccatattattccaaaaatttctgtcatctctcaaacacaaatttgacatttcatctctttctgtataattttgttttcaacataacttcttacaaaacagatttcaggttcttgacatatgtggaaaaattgaaaagtcccaaaacaagtaatgcaaccagtatgtggttcctttttaaatttcagacactttaaatatacttctatatctgtatatttgtttttcttacttcaaaatttacattaaaatatgtaatgctttacgtattttagtaataagtgaaacctagctgaatatttaaataggaatattccacattaacataatctgccactgtggctattcttaaaaataacagcacaagtgctaggattacaggttcagtggctcttgcctgtaattccagcactttgggaggccaaggtgagtgaatggcttgagcccaggagttcgagaccagcctggccaatatgctgaaaccccatctctacaaaaaatacaaaaattagcagggtgtggtggcgcagctgtgtggtcccagctactgtgggggctgaggtgagaagatcacttgaacccaggaggcagaggttgccatgagccaagattgcaccactgcactccagcctgggtgacagagcgagaccctatctcaaaaaaataataaatataaataaaaggaatatttctaccttttagacagaatactcaaaaacatgcatgaatgaaatagatgcagttatgctattttattcttatgtgttttcaatctgaaatgtttatagctaacagttgggaattatgtgctgtagtatgtatatagtatttttagtgaaaatattcatataaaatattacttaaatcatttctacattgcacaaaatgatttcagataagtggaaagagtgaagatgcaacagctgctacataagtgttgcttcaaggaagtgatatcccagtcttccattctaccagatatctgccatctgtcgtatgcaaaacaagtaatcatttctgcatctccagccagtggaatgcttttcttattttttattttaaaggtggaaaacttggagatgggcgcaatgaagctctacagaaaaatttgcattcataagtttatttcttatatacctctataaaattaaaatgactccatttgtatggttcaagcaaagaagaggaaaaggaagggaagagcctcataatcattgatccttggacccttagggcaaaatattctgagaacacgttgcaagcgtattattaggggcaatattgtaccatattgtgtgcacacaagataaaattattgcctgaagccaagagaaaaacatagagacagaatgaatgaatgagagagaaggcaggtgttatgaaatggctggtgaaataaggaattttctctacaaatcattacactcacccaactgagtatccccagttgtgtataaattgtaatcagattatttggtaggagataattctgagcttaattagtctcaactgtacacccttgcttattacatgcctgttttattaaatactttataaactattcttttaaggctaataccttttagaatcagaaaaaaagaaaacagttgtaatagttcatccttatattctaagatcaactgaattgtcttttgacttctaaatgtcataggcatttttgcttttggatattttgttatacatttttacccattataataaagtcctgttcttataaagaaagttgcaagttaatcctgttgggcaaaacaaattaaatacattaaacacaaaataaaataaattaaataaattaaatacaaaataaaatacattaagcatcttatatgtgatgaaagtgcaaggcagcattaaaattgacagaaaaatagcaggtttgtccaatttaaatgagggtttaaaaagagataactgaaagaatttgaaaatgaaattaaaatggaaattttctttacatggatacagtgttcattatttgaatcttatcaaaatacctgtttctacaaaataacatcattgctttggacagtgaaagaattgtgtataaggctttgttaatgtagaacttcttaatgaaacattacatagaaatgtaaaatttaaaatgtaaaaattaaaaattaaaaattgtcttctgttgaatgggaatgattcaagcatatgttggcatattatatagatggtctgaacaatatcttgtattacagcttcatgaccttctagtgatgcagactctctgctactagggtgcctcagctcaggactctgtctcctttcagcatgctcattcgaagcacataattgccagacactcaggtttcattagagagacccagagtcatactgtgaaatgttatgttctttctccccagaccccttgcccacttcctcaaccctataattctgtgtcagttcttagaacacgatacatgtgaaggagcgcatacctggaatactcttacttcccttcccccagcccccagaggcctgagcacacatcagcagagaggtttaccatgaccctgtggacctgtgtggactcaagattgcttaggaagagcctctatctccttgtgaccactagggggccatttagtacagtgtagacataacagattaaatgatttcaaggaatgctagttaatttcccctttcccacttcccaccattcccccctctaacatattcccattgctgttaatgccagttagccaagtagaagctaacagattcccacaaagacagttctgcactaacatttaagaatgtgaggaatagtgtcctccaaaggacgagagcccacctgaatcctgtgagctgggtaagtgaggccgagtcattcaatctcactttacctcagttgctctctctgtaaatacatctattgttataagaaagaacccagataaaatggagtgaagtacagcatattcattatttagtggtcatttatgcacccttacctatatacaacccctatgagtagaccatgtgggaggcacaatacctttttttaaaacattcttgttgagttcctggaggtcttgtactgctgtgttgcgacttgagagagttgattcccacctaagtggttggacacagactcttggaaaaagcagagtttaagatattaacccttttattgagctcaatacatttattttatttgataatgtttatcttagtatttttaaaatacaaagattgtacatttcatatagataaaaccaaaggaaggctaattatggctacactaaactccatctagcctaagatggattttttcatgcttaaattaaacactaatttaaaaagagaaatatttaatatatgaatatctatatatgtctcctttgtaaaaaaaaaaaaaaaaaaaaaaattctactacttgcctataactttgagttttgaagttagtgctaaagtttgagaaatggcttaaggttattgattcattctttcttgacaggtgaaatcatgaagcagcactaaccacagcaattatggcattaaaatgtcaagaaattagaggtcagaataacagataattttcttctctatgtcagattgaaaattgacattctttgacagtttaggaactctggctgagaaaattatgacagcttaacttattttatacttgtaaagcagtaattgataataaactttatcatgacagcctctgggcagaaacatgacagtacagttctggtacaaagctcttcttaatatgtaaacactagatctgttggatagtagatattatttaaattgtctaaagtcttggcttacatcgtaatcttctatgcactttttttcatagatgagctgtactatttgagcagtttttcaagcattataaagaatattttttcttatcggtttttatatattaataaaaagtatatgatctgatttatatttttacttactaaatgatgaccaagaaacttcatcctatgacctgcttaggaaagagaatattctggttggtaatcatttagtcccatggttttctaacaccttgatgctcaaatgtggcccataacccagcagaatcagcatcacctgggaacttgctagaacttcagcctctcagccttccccaacctactaaatacatgtaatgagatccctaggcaacttgtttgagacattaacttttaagaagcactgctctactaaaggtgtgttagaatcatttggaaagctttttttttttcccctacaaaagtacagagaatggtataatgaacctccatgtacctatcacccaatttcaaaaatttaaaaccatttcatcaaaacctcacccctccccttgtattttttttctttctttcagagacagtctcactctgtcaccaaggctgaagtgcagcggcttactgcaccccacctcccaggttcaagcaattctcccacctcagcctcccaagtaactgagattatagacacccacaaccgcacctggctaatttttgtatttttagtagagacagggtttcaccatgttggccaggatggtcttgaactcctgacctcaggtgatctgcctgcctcagcctacaaaagtgctgggattacaggcatgagccactgtgcacggcccccctgtactatttttaatacacatgtcatacccatctaactccccatccactctatcctccccatcacatgggcatctcagaatatccagggaaaggcttcaatgaagcaagtcttattttgaaaaaaaaaaaaaaaaattatctgggaatttcacacacattcccaattaaaaaccattaatctagctaacactctcattaaataattttttgtttgtttgttttgagacagagtctcgctctgtcgcccaggctgaagtgcagtggcgcaatctgggctcactgcaagctctgcctcccgggttcacgccattctcctgcctcagcctcccaagtagctgggactacaggcgcctgctgccacgcccggctaattttttgtatttttagtagagatggggtttcaccatgttagccaggatggtctcaatttcctgatcttgtgatccgcccacctcggccttccaaagtgctgggattacaggcgtgagccaccgcgcccggcctaaataattttttcagctgggcgtgatagctcacgcctgtaatccccacactttgggagaccgaggcgggtggatcactaggtcaggagttcaagacctgtctgcctcagagtatgattatattgtatgccataggcaacaaaaatggatagaaagatgggaatgatattataagttgtatcacagctcaaccattagtatttgagtgacattaagtcagtcacttgaattttatgtacctgtattttctcacctaaaaaattgatgacagagatgatacctaattcatgggagaaaaatatgtgaaaatacttaaactataaagcactacacaggcattattacctaaaggcataattaaatgaagttatcttagaagaacttttgttttaataatttcattatatatgacaccaaaactatcaatttaattttaaaaaatctgttagcaacagagaaaataagttaatttgtttttaatattatttagtaaaaagaagcagttgtggcttttaaatttattttcaatactgtctccaaaattttataaagatggcctaattgcagcccacttattgcctgtaacattctttcttgatctaaattagtattagcatttatatcctttattatcctttatatttttaaaagttttacattaggccaggcgctgtggctcatgcctgtaatcccagcactttggaaagccgaggcaggcagatcacgaggtcaggagattgagactatcctggctaacacggtgaaaccccatctctactaaaaatacaaaaaatagctgggcgtggtggcgggcacctgtagtcccagctactcgggaggctgaggcaggagaatggtgtgaacccgggaggcgcagcttgtagtgagccaagatcataccactgcactccagcctgggcgacagagtgagactatctgaaaaaaaagttttactttagtgtcattagttttgtattcatattatcaaatgaattagcaacactattactggcattaaagttgtactggttcagcaagagaaaaaaattgagtcagtatttcaacagaagctgtaagcatataccagacaagttattaacaagatactaagttctgaacttgtcataatacttgtcatcattctatagttgacgttgccagactgaaaatgatttcaatggcttctttttaacggtgagaggtatgcacataagtctatcataaaaggctgttttgctggcagctattagaacatgtgagccattgcaatatttatttatagatatacacatttatttatgctggaaatattaaaatattaagtagtttttaatattaccaacagtcataaaaatgtggcatttttagtctaattttctgttaatatttcttggctttcttagcttatagtttctttttctatctttttctcaatctgacagggataacactgcctccctttggatcggctatggtgaaaatatgcccataggaagtaggctagattacttcagtttttactttattttcttgctgaaatattccttgctactacagagaattgacatgatagggctgtcaagaaccagaagatagatgtgtctttaaccaaaacagctgcaatgctggcttttctgagaagatgaattcataaaatttataagacaaaaaattaacacactttttcatcctgatgatgtaaatgaagggtaatttaagggcccataatgacaacattgaggacctctacaatcattgtcttccttgaattctttctattattctttattctttctatgaatcctttattcctcagcctttcctccccccatttctgattctctttgatatgacaaggaatatcaacaccacctgcccgatctgcgtgaatgagttgtagcacaaggttatccatttacaactgccatgatgcctaattgtcttcatatgggggatatccagggttcttctcctgggcagttattctgagaagtgattgcaacaaatgatcacaaagtgggtgattaagatttcttaaaaccatcttaatttccccctataattactgcatgttttactgggatgaaaattttaacagattcaaaagccaaattaaaatggaaagaaaacccctacattttaattagtggagtgaaaatacgtatttggtgttctttaaagctaaaggatcattttgggaacatgaaaaataccatgattcctaaaactaataaggatataggttcaaatatatttgttatgtgtttctcactgcaaaggttttcattgagagccataaggcttgcattgcaaaggtttgatgaataaggttttaatatagaaattagtatcaaggaaattaatgacacacatttaattttgattagtgaataaatctttaatttaggtctatcttacctgctcataattactgcagtacttcactaggccatggtcatcaatcgtccactagaaaagcataaataatgcagctagtcaaagttggatgtatgtcatttatgtgacttgtgcttctttcttcgctttgtgttatttttattgtgtggtgttgagaagtgctaattattgattttcagaaattaacagcaagtactttcacaagcatctaaagccatattttactcaagggaagaagggtgaaaattgcagcctgctgtttataatagaaatagctggaagggatttccttatcttctattaacatagatttcacttctataacacagttgttacctcagcataaattaacaattattcaaaacatattgcatacttcaatttgttgaaatagatattactcaatctaagtacctagacatttcagttagatatttagaactcatttttaaacattttaaacatattgataatgagcctatttaaagccatttgaagtctcagtacagtatatctaaattactgttgcccatttatgtcaaaatcaagaatattttgttctgctgaatacgtccaataatactttattctcactttagtatactaaaagtatatgatttcaatttggaatatttataccagcacctggtaaacctgtgtctcaatgtcattccacataccaaacaaatctatttcagctttttaaaaaaatattttcccatgattaaacacttctagtgaacttataaaggccaccacttctctctcgttcctgctcctacaccaccacctccccctcaacttgttttcctcctccttcacctcctgaatcagccagcatagagtttagtttatataaacttattcaaccagggaaaatttggcagggatgtcatactgattgttctcacctgtggtaaaggatttgtggattgagtcctctacttaggtaccatttaatgattaaccccaaagtgggcaaagaaccagaaacctggaagaatccttaagcgatcatctgctaaaatcttcgcttccaggtaggcgaatccctaagtcatctagaaaagagtatttcagttctcttcctgagtatcaacaaatatttattgcaatgagactctacagcctttcctatctgcttacaatgtttatctctgaaatatttaaaatcctcagtgaaaatgccccttgcttggatataatctttttttggtcattcctaccccaacatgtagcaaaaggtaaccagcatttctctcatttgttgtgcctgaataacaatcctatttgtatcagtcaggatctcagcacattacctttcaaagcgataatgaagactccaaagaagacatacacatgaccaacaagtatgtgccagcatcattcatctttagggaaatgcaaatcaaagctgcagtgagataccacctcacacccattaggttagctactatcaaaatagaaaataacaagtgttagtgaggatgtagagaaactggaaactttgtgcaccattgataggaatataaaatgctaccactggcgtagctgctaggaaaaacaatatggcaatcgttcaaaaattaaaaatagaattccctatgacccagcaaattctacttccggatatatatccaaaagaattgagagaaagggcttcaaagagacatttgtatacctatgtccacaggagcacttttcacaatagtcaaaagtcgaggccaggcgcagtggctcacacctgtaatcccagcactttgggaggctgaggcaggcggatcacaaggtcagggatttgaaaccagcttggccaatatggtgaaactccgtctctactaaaaatacaaaaattagccgggcatggtggcaggcacctgtagtcccagctactcgggaggctgaggcaggagaatcacttgaacccgggaggcggaggttgcagtgagctgagattgcgccactgcactccagcctgggttacagagcaagactccatctcaaaaaagaaaaaaaaaaaaagttgaaagcaacccaagtgtccgtggatagatgaatggataaacaaaatgtggggtggtgtatgtgtgtgtaatgcattattagtcaaccttaaaaaggaaggaaattctgacacatgctacaacatggatgaaccttaaggacattaatactaagtgaaacaagccagtcacaaaaagacaaatcctgtatgattccacttctatgaggtatcttaacgagtcaaaatcatagagaaagaaagtggaatagtgacccccagggactagagggagtggcgagtttttgtttaataaatatagcgttttagttttagaagatgaaaagagttctggagattggttacacaatagtgtgaatgtacttaacactactgaactgtactcttaaaaatggttaagatggtaaattttgtgttatatatattctaccacaattaactttttttaaaggataatgaagagagtttaataatggttctatttacaaaggtatagacatggtaaagtggatgaacaagggaaagcgacaaggaaagggagccattcccagaatctggcaataaaagtgctcacccaacaagagctgtggccttaggtagaggagtactggccaggcactgccaaaacgggacttggcagagaggggccatataatcctgtctctgctcctgagctctgtcattggctgaacccactgggaaggtagagagcaagggagcacaggtctatggaggcgcatcttccagagccaaagaaggtgtccagctcactggtctgttccccctgggttgttcatttctctaggccaagaagacttatttaaggcttccaggcttgctcagccacaatcagctacattaaaatgcactcactcttcctacctgagttgacttatacttattttaagtggagaaattgagtgagcttgtcattgatggcactgatctgatttggacagaaaatattctggatggagcattttctctccggaggaaatgatgcttactttttcacattcatttgttaagtcagttatgtaatatcaccattataattcaacatgccaaggaggaaacagggatcagcaagaggataagtcacatcttaattctacttagatttacgctaaaagaaagaaaccaagaattaaggcaggtaactggacaaatcagaatctctctctcaaatattgtctaagtgcatctactaattaaggcaattgtggtccctttttactcggattaccaaatatttgcttaaatattctaataattttgccaggataattttagccttaatgcagttgaaggttaaaacaaaaggaaaaatatttattctcctattttgtggtttctatgaaaaactagaagcagttgaatataaaatagcattttaattttttatatagtttaatatttataaagcaagaaacaacaaagtgcagatattatttgcttgatttattttgctcctgtttttccagcattaaaaagtaatgctttatatgatcttgttttattacaacaataaaccagaagcaaaagcttatcagttaaaatgtagtctgccattaagtaacctttccttttatcatttcagacttaaaattccattgtttttgtttatttttttcctatttggcattggtagaattgcaggtggaacagaaagatgatatcaatcacatgtatttttttattttgtgtcaagcttgtattttttggtttaaaaaagagcacttttaagtattaaaagccttgtaagtaagagctatacagtgagataaacaaaatgctaaggaaactttgaaaatctttttctgttttctcaagcaaccacttttactacttttttcttgaattttctgaaaattgttagtgaatttactggtatttggacgtagtttgatattttgcattgtgggtaccataacctatagtactttataaaatgctgatttttctgaaaaacaatttaaaagtttatacagaccagggagatggatgaataggtcatttgagagcctgtattattagctccttcatgctgtttgtcatggctctgtagacctgacggcatttcatctgaaagataatactgaattacatttaccaaaaaaaaaaaaaaaaaaagcagttgtaatcattctatggagaaaaatgtaaatgggttaaatctacctgcaatgtggaaaagacaagattaacgaaagtttttgcctaccacacaccagagaaggtatggcttctgaattctggcttacttggttgccacatttaattttaccttagtaggaagtcttttatatgaataagcaaatgtgcaacacataagcacacattatatttatcgatttccttttctgaggattcaattccaggtatgtatctttattcatagaggaggtagaacttccttggaaggaaagccaaaaaggaaagaaaacaattaagagatacggaggtcaaagaaagaaggcatgtgtcacatcatagctaacacacatgcccctttgtgcacactttagaggacaccttctctaaatggatgaattacaaaaggcactcctttctctggctctccaggtagattctattacttatttgccttccaactgggcatctttgtacagggcataaacagcatacccatgcacggtggccctgacctatgagaaagaagaaagactcaagagaacttgttaagtaaggaaaaaggggactcccatgaagatgtcataatttcgtaacttagtaggtgggtcctgcagaattgtataaaggagagcctcatcagactaaggaatgggataatcaggaagtagggaggggacaaaagagaaagtgtccctaatcgaaacttttccttaatgggagctctatatacagataagcaggtaaaactgagttatgtgtcatatatgtgtttgtaacctgaaaatcatttatgctgttcagattttcttattttgttcatttgtgcataactcacttcacatttatctttacttctctgcctatacctacaaaattccatgttttagaacttcctcaaggtgttcaacctacctatttctcggtgagtcttagctggagagaaaaataaatgctaagtgcatgatgtcagttcaataaatattcagcaaacaattttataatcagtaagaatccatataacaattaaaatttaacactctttaacttaattttcatttctactttaacaattccaggtaaagaaataattattataattattttatgagacaattgagttttgatatatacaagttttattaataagttatcagtaccctaaaagattacataatgtaaatcattactttatttacagcttcgaccattacattttgggttcacaaatacttacagaaaataaatacacaaaaccattttggagaaacactttggcagtaaaactaaacttactcctaccctatgactcaccaatcccatatctaggtatagaccctccaaaaactggctgctaacctccatcaaaagacatgtacaagaatcttctaagcaactttattcacagtaacctgaaactgttaacaacccaaatatccatcaacagaattgataaattgtgttaggttaatacaggggaatactatacagcaaaagaaaaatgaacaaactaccgatacatacaacaaggttgaatcttgcagacataaagttgatcaaaaaaggcagaaacaggaaatatgtagtgtataactcaatttatcaaaaattcaagaataaaaaataattgatgataaacatcagaataattattagcttgacagggtgatggggctagatagggggaataattggctggggaggcacacaaggttaccagtatctatgtattctctcatgtacccaccacccagaccaagatatggaaccttctagttccattccaaagtcctctgtcttaatgtagatggtggttagaagaactgaaaaaatgtatatacatacatatatacattcatcaagctgtacacttaagattagtgtaccttatacacttttatcttaaaccttaaaaaatgagtaatttgaataaataaataaaagtgaatgcacataataagcttaacttcaggataccaaaatcagtgatttcttaataacattaagaaagaatattatttaagtacaagcaaatctatattttcatgttattctaccaaagtgttgtctaccaatggctgcatggtcttttgtatttgtgaaacatcaaacgttttgttagccacatttgttttaaaaaatctagtggtttaagcctattacctatgctggctttgtatgaaatatgtaagactcatgataccactgtttaagtaaaaagtcactatgatttattgattctaagatgcacaccattttcatatctcaatactccaaaatcataatgtgtcttacaatcaatcaatcatagcatattttaattgatagcatattttacttattaatagtatataaaataatggagcttctaataatggataacatagatttaatgaagttggattgatggacatttccaaagttttagtctctttccatatacattatacatgctcatgagctcacgtgttcaatgttaactcattttgggtttactggaaagtacaacagatacacaaagcaactgatatcttgtaatacaaattaaagttttcattattatattttaaaaggattcacaagccccaaagcatataagaaccagacagggaatagatgagtgacacaagccagtggcagtgcccaggtcatgtgagtggtgggcgttacaaaagggcagttgtgcaggaatgctgatgtggtattgcctgatctgcgaagtttttaagagaagccaaaaaatccaatttcttgtatgccatttactgacctgtaaattttggctcaaatagaaaccatgtctgtgagctgaatctagcccatgggatgccagtgtgtgactttgggctgaatgtaagctctttgagggcaggaatctttatctgtttcattttaccagtatcattaatatctagaatggaatctagtatgtagtaggtactcaacaaatacatgttttgtgaataaataaagttaacgttaaatctcactgacccttgcagaccaatgtatagagaaatagatacatgtagaatttttttaatgacatttctggataatatagaaggaattcatctcacagttccagtagtttctttttttttttaacttgatatatttggaaatttttaagggaaaatttctatatggtagaaaaccttttcatgctgtggacaagctaattcttacttaatcttcaaacctgagctctgtcctttttccaaaagtctctttcctaagaacctattccccttcccctctgtcactcgtctgggctcccagggcagcctgggcttgtctcccctgtgtcctgctccctaccatgtgcactgacacactcatcgtctttattttgggggctgctaacttcctgaggtcagcctggtatctgactttgtatcccttggcatagagtaagcattcaacaaatgtctgttaattgtttttgtggtattgaattgtaaaagtaaaaaattctgaagtgcttttctttttctagaccaggtttcagttttatacaaatgccctgcttctgtattcaccaaatatttttagaatctctgttaagactaagtcaccatcctgacctgcagagattcagtctgaacaaacagacatacataaataattgtgtgttaaaatctatagtaaaggagaaaaatgtgctgtgagaatatgcagggcattcattatgatttagaaggatttagatccttgcccaaggaggtgaaggatttagatccttgcccaaggttagcattcggggaggattttctcctacacagggagtagctctcagaacaactacttcattgtaacaattcatgggttgcagaatgagttctgcgtgtcaccaggcaaccctcccattcacaggacctgcacacttgacaagaaagtcattgatgacccccttaaagtgggaaaggacagaaaatcttacatggggagcaggtgaagaaagatagtaggtgctcactctcccctcaaacgttttagtaatgacaagaagtagaacttaaaggagacagcatgcttttcaagatcagaaagatctgtacatttttaaatcagagggtaaggaattactggaaggcaggactaccagatagctaaaaggtaaatattggactgagatcctttgggtcatgaaggcatgtaaagtagatcacaaggaagagggagtcagtatagtctcaaaagaaataaacgttcagtgtcgagaactgactgtcttaatgaaaggataaagttagtcacaatctcgtctttatcctgatgcctgattggggaactcttttaaatatatatgcatatgtattctgccttagtccaaaatggtcagagttgggactcactgaagagaactgcacagaagatttctagaaattttatccatttcataacattttctagtacaatgttaatactttcctttaagaaacaaaactagagtcaagcaaagcatgtttgttgactaattccttcaataaacatttaaaggctccctactaagtgcaagacactgatctagagattaaaacatgtttaattttacccccggctcctcgcccccacttgtgtcctttttctggggaagtaaaaacaggagtagtagtatctgttgttagagagacgtttagctgttcatgatacatgaagctaggtattaagcacttgctaaccagggcagcgttaacaataaaattaccacttttctttgcaaataattctcaagagttagttattaaaaatgtgaacctaaccagaaatggtctcttcccccttttataatcataaatcttgcactggggagacaaaagtaggatgtaaatgcatcatatgtgaataaaatttagttaaatagtcacacttgtgagtagacaccatgcaaataaatgtatacataaaaattggacagcacttaaagagatttaataattcatcccattgcctctgcagataaaagaaccaaagtcccatttacgcgatggctaaaatatggcagataatgatgcattcatatttaatattgctaataaatttgcaggttcgcatttttattgataaacattttcttgaaatacagtgtaggaggacagatttttaaatttaagtactttataaattagaattgtagatagcgatgagattagtggtggtgctatgtcaagagccatctaccaactcacctgtgcttctacaagcacctagctatgattttcctatttcacttttacgtgcaaccaaattgcacacaatttagggaaaaaattagcatggtagcagagtaatgatcatagtaaatatcatgcttctccttgttgacataaattacatataatatttcagaaaaagatttttgttagtctagcttaatatatggaaatattttgcctatagaatttatgtatcgaggaaatacttaagtttcttttaagatgatctctttgacacacacaagaaaggtatattgtacagtccagacagtttgagggctaaaattatttctattccttggaggctataaaatctcatttccagctacacaggctttaatgaaatattgtatagcttaggatacaggaagatttatttcttttttgggtgagttctctctaaaatttcagggaaaatttttgagaaaatgaatttataccttaaaaataatattccagaattcatcttaaaatagcatagaaagctaaaatatatttttgtaacaaaagttttgttatatttaataattctataaaatcttggtgttctttctgctgatcaccctctgaattaattggaacctataactttctgaattttattttgtataattggtagacttcatgtctcattcttttttttccccattaagattccagaagcttatttcattagagacccccacactttccttcttacaaaggactttattaaggtatatgttctgtatttagtgtggaaagtgttctttggtctttagctgcatgcatgtattcacaggttagattttccacatttaaccccagcttctgggaataagaatagtgactgggttaactgaagcatgtttggaaggagaagcaaagcttgtctacaaaatactaacacttggatgattctgcaccctgagaaaagagcacccgttgaattttctggactttttttcatggctgacttgggatacacttgcgttgtcaaagagtgtgttggcctctctctttgatgcatattgattatgacaatcaccctccttcccctgcaggccatggaggcacagatacagaactttggacagacgccatctcagttgcttattgagccacatccgcctcggagctctgccatgcacctggtaagacatatcagcatgttgagatttttttttctttcctttttacctgggaatagagcaaataaaattgtgattttaacagcatattttaaaaggcttctcgatttattggttaactcttcagcctaagtacaaactaataccccagggagagacagagaaggaagtgtaaatctacctttaagtcctacttaagctgtcccacttttggattcacaaaaatagccatcttctctatgtatgactctacataaactcattcatgcacacacaggcatagagacacacactgacaccagaattagactatatttgtaaattacaatgaaaaatgtattgcagacacaatatgatattgccaaatttcgtggcaagatacagtaggggaagtagttcatttgaataaaaggaaagaaatataaaggtaatttgtggttattacagagaggttgttgaacagagtggttaagagtaagggccccagagccggacagggcaaacaccatctctgcactagctagtaaatgacttgggcaaggtatttaacctctctgtttttgcatttcagcatcttcaaaatagaggtaaaaatagtacctactactgagaattgaatgattcaatactgtatagcacttagaccagcacctgtcatacaataagttcttaataaatgtgagctgacatcatcataattagctactggttaaacctcttattcccactttgcaagggagtcatattcttttcattttaatctgaatttaaaagtccatttccataaaaaagtttctttacagtttattagcaaatagtaaacattttcttctttaagtaatttgaagaaggtaaaatttttatgagcaatttctttagaattttttttaaaactgatttttcactatttttttactgaagtaaacaattcttgaaggtaaaaatgcgttcacaagatgaacttcaagacaacaagtactctaattttagagtaaagagctctggaatatggtccataatatatgtgtaaacaaatgtataaggtgttattttgtgatggaagtattaatcacacctttcatttactctgtcatttaacgaatttttattgagccccttctgtatgtcagatctgatgctaagcactggagatacagtgacaaataagtcctctaaactttcaagaaatcagtagtcgaacttttgggaaacacataaatgctttttgttgttgttgttttgagacagaatctcactgtcacccaggctggagtgcagtggcgcaatctcagctcactgcaaccttcgcctccctggttcaagcaattctcctgccttagcctcccgagtagccgggattacaggtgtgcgccaccacccctggctaatttttgtatttttagtaaagatggggtttcaccatgttggtcaggctagtctcaaactcctgacctcgtgatctgcctgcctcagcctcccaaagtgctgggattacaggtgtgagtcaccacgcccgacctaaatgcatttgtttttaaatttttttttaagatagggtctcactctgttgcacaggctagaatatagcgccatgatcatggctcactgcagcctcaaactcctaggctcacacgatctttcttcctcagtcttcctagtagctgggactacgggtgtgtgccaccatgcctggctaaatttttaaaattttttgtagagattgggttttgctgtgtttcccaggctggtcttgaactcctggggaccctcagtctcccaaagcgctgggaatacaggcataagccaccatgcctgcctggtgtgtgtttaaactctttttttttttttttttttttttttttaccttccttcaacagctcagccaaacagcttcagcctccttggttagtcactagtgaactcttttgactgcagttggtctttctgtgtaactaaacagaaaggtttgcaccaagctcaggctgttgccgtataaacccctcagccacattgtagacatagagatgtggcctcggagcctcaccgtttttaataaactgtccagaagaatatctctaacactttattttatgaaatgctttggcagaagagttttattcccgtgttagttttctgtgtttaataataataataaaaatatttatcctggagatatgcccagtcagaattcattactttcctagaggaagttgttagagactgaattggcatgaaactgtttataaagaaactctaagctttctaagttcatgtagcagagaattcatatatactgcaaaccattaagaaacatgtatgaaagctaaataatggttatttccagcctccctactttatgtttttaatatggtggtatttgtagtgttttgtaggacttacagtatctactttctgtcaagtcatatgctagatgttgacaaaacagacgctaaaaacagaaagaagaaaacacatggacacgtgacagggaacaacacgcactggggcctgtcatgggggtgggggtggtgggaggggagcatcaggaagaacagctaatgtatgcagggcttactaccaaggtgatgggttgatctgtgcagcaaaccaccatggcacacgtttacctatgtaacaacctgcgtgtcctgcacatgtatcctggaacttaaaataattaaaaaaaaagaagaagaagaagaaaaagcattggccctccataagctcccagcctagaagggagaaacaaggcttcaaccataaacagtcagtgccagagcagaacctggggagaactgccagggaagcgctcggctgctttatggggctactgtattttaattatttagactgtagtcatgaccccagatcaaccagatagaaatgaaagtattagtcaattcactttatatttcgtgtaaaaaatgggagtcactaatttgactaactttcccaccaaactgatttttaagctgcattgcataactgtgttacgtcatgtgggtgtgtctatgagctaacttttcacattgcattgtggtgatatttgaattgaggctggtctttaatgattctgtgtccctgtatcagtgccttcacagaattcttattctctactctctgtgccattccccagtcaaagctgctcgatttggggcagacattcaccagtatgaaagtttaggtggcttttcctccttgtgtgtgctcgtgctagccttgtctgtttaacctcattctccctagacctttcactaactatgttattccttttgtcttcctctgttctcttccctttctattcaacagtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggtatgtgtgcctgagcaaatcacttactaaagatttcttaaaagctacaattaaagtaaaaaagtgtactgggactgggattagctcatatcccacattatctacaaaaaacagcagactaaataaataattgtcaaatccaactaagggacttctatctgtctccttcatttctgctgtatgttagtgcctcataggatgcttggatcatagtcaactactcagtaactatttgacaaattgaagcagttctaccaataattcaggttctcctactctattctgctattgcctaactgcaaaaaaatacacccttcttttttcctatatcaaacagaagagagtttgaatatgggtttctggatgctggcttcacatcctcttgtctctatatcagtaatttatttagcaaatatttgaatgactattatgtgtcaagtagtcccaagcactgtatatacagcaataaacaaaacaagcaccaactctatttttgcagagcttagaatctttgcaaaaagacaaaatctaaattctccagtgatttcacacttcacatgtgtttctccaaactctttcctgaaagtaccagccagtacatcttgaagcgacataacgttgtggcaaacatttagacatattgcaggagttcaagaccagcctggccaagatggtgaaaccccgtctctactaaaactacaaaaattaaccaggcacagtggcaggcacctgtaatcccagctactcgggaggctgaggcaggagaaacgcttgaacccgggcagcagaggttgcagtgagctgagatcgcgccactgcactccagcctggacgacaaagtgagactttgtctcaaaataaacaaaccaacaaatcaaaacacatttagacatatggatgcttaaccagggcagagtggatgtgaccaaatgatttagttggcccagtttaccacttgggatctcccaggaagccgaggactccccgtctccagagttgaatagctgagccatgccgaagtaacctgaatctttctattttactgacctctacattgctctaaaaaatacagtgatttatatcctagctttatctcctaagagtttctaagtgcacctattttaaggttattggtgatattatcaacgtaaggtaacgctacttccattccatcagagataggcagcacatatcttaaggaaaatatatgactgtattattctcaggagacagcctctagaaatgttttgcattgagaaaaactacaaaggactaaatttttatttaaaattgtttgaaagtgttgtatatattgtataatcacgtgtgaaaaactatgactaatgaacttcatcaagctctaaacattaatcctctgaaagtagcttttagtgagattaagattttaggtgtggcccaatttttataccttccatttacttgtcacatgttgaaaaaaaggccccattggatgggagccccagcttcctgtgtcctgccccaggtgagcgcaggctcatacccatccctgcttggaagcatagccctttcattgatttctgcttcctgtgtcctgccccaggtgagcccagcctcatacccatccctgcttggaagcatagccctttcattgatttcaggctcattgattgctcatgaccttagctttttgatgggttcaataaatgttacaatcttctatttatccagctttttctcatcattagaacagaaacaaaactcttcccagccttgtacatcgtaagtggaaacctgaagtccctgttgtgattattttgtaaggctgtctacagagacacatagtatcagaacaatttatcaaatcatttttaagcaaatatgcattttgtaaaatcatcataaaacactacccattaggaaatcccttctttctgagaattttatgttagtttttctctctttttttaatctttaggcctcagaggagctccaggatactccttggatcaagcccaccatcttcccattgaaatggatccattaataggtatgttaataaaaaagaataaattttcatggatactatccatatattcatatatagttatttttcataagatagttgaacaatattttttctaccacaagattaaaatgctaataatatcaaattatcatcaaggagctgtgtaaatcataatatgccatctaagaactttttggtattaaagcaatcgtttcttgatatttttggaggtcatttaagttggttataaataaggcaaataattccaaactgtattttctttcagcctaaagtgttctctaacagctcagtattatttaaaatataaggattcaaaaagattactaaaggctgggggaggaatagcattaggagaaatacctgatgtaaatgacaagttgatgggtgcagcaaaccaacatggcacatgtatacctatgtaacaaacctgcacattgtgcacatgtaccccagaacttaaatttaaaaaaaaaaaaaaaaagggccgggcatggtggctcactcctgtaatcccagtactttgggagtccaagacgggcggatcacgaggtcaggagatcgagaccatcctggctaacacggtgaaaccccgtctctactaaaaatataaaaaaattagccaggcgcggtggcgggcacctgtagtcccagctactcgggaggctgagggaggagaatggcgtgaacctgggaggcggagcttgcagtgagccaagatggcaccactgcactccagcctgggtgacagagcgagactccatctcaaaaaaaaaaaaggaagctaatattgaagaacatcttttctggcagtcttttttttttttttttttttttttgaggcggagtctcgctctgtcgcccaggctggagtacagtggcgcgatctcggctcactgcaacctccgcctcccgggttcacgccattctcctgcctcagcctcccgagtagctgggattacaggcgcccgccaccgcgcccggctaatttttggtatttttagtggagtcagggtttcaccgtgttagccaggatggtctcgatctcctgacctcgtgatctgcccatctctgcctcccaaagtgctgggattacaggcgtgagccaccgcgcccggccacctctggcagtctttatcactgaatttttttaaactgacatgttgtaaagcaaatgtttcatatgaattgcaaactgatgagctataactctttgcagcagacattcaaaatatttttaaataatcgtgtacatatttattagccattggatccagagctagcatcttagtctttcgaggcccttccggtttcatatatgtaagacagtttttaataatgtttgttctatctgtatcactggatgattagtaagataaattagaaaaaaattgaaaatgctacgaaaaattattaagctacatattaaagtcaaggtgttttattcttgggttcttttttttttttttttttttgagatggagtctcattatgtcacccaggctggagtgcagtgatgcaatctcagaccactgcaacctccgcctcccaggttaaaccaattcccccacctcagcctcctgagtagctgggattacaggcgtgcaccaccacgcctgtctaatttttgtatttttagtagagacagggtttcaccgtgttggccaggctggtctcgaactcctgaccttaagtgatctgcctgcctggccctcccagagtcctgggattacagacgtgagccaccacgcgcagcctcttattcttagattcaaattcatccttcgtctttgaacctggaaataagataagatacagacgtttcaattagttacttatacccatacacaaaataccatttacatgtctttgggagcttataagctttaggattaagaatattattagtctagtctagctatttctctttccagtagacattgacaatgaaatatacagctagtgtgtaaccatggaaaaattaataggtctattctaattagtaaaggaccaactgtatagttttcaagtggcctgggacccttggtcttcttgtccttactgacttttgtgtataatatttttattgcttatgtttcttagtaattatttttatactgttagtagatatctacagatagtagtacttaatatttaactggtgttagagagtggtggtgaccttctacatctgcatttctgtttaagaattcagcccagtgatttatcctgaaaggatggtgcgcagtaagggacaggctggcatgcagacaggcactggggaaatcagatggtgtctctgagttcctgactttattcagattcaatcccagggctctgcactgattctttgcctgtctctttcctccccagtccctctctcatcttttttgttcctctcctcccctgctagccctttctggaaaggccttctgtctgttgacaatccaggcctgtaaagctgctgacctgaagctccctgtggggctgcccacgtaacaacatcccttgctcaaatctctaccctcctttttcacaggaattataaataccatctgaaaatgacagacttggggcaaatattaatatatctcttccttaataacatacttcatacaatatttagttttcatgtgattcttataaactaatgaacttgtatatagtgaacatctaaagaattaaatgcattaaaatattgtattatgttttaaattaattgtcttgaattcctcatattgtttttattggtggagggagaactaaaatttctggcataattttaaaatacataatgtggttcataaataattactgcgaaggaaatttatattcctcaagggagaatcttaataatctcataccattaaaaaaactatttctggataaatgaagcatgaaagtattgttttccttctttgagtgcttggcaaaactcatatggaatctttcttcaaatgcttttttccatttacttttagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacaggtaatcctaactatgaaacaccatattctcttcaaaatgactattgttaaaaccaaagctgaatatgaaatcatacttaatgtaggcatttttatcatttgccaacttgagtagtcaagattcaaattaaatgttcacattgtaagcaaagtaactaactataacttcatgtattccgaacgttagcatgatcccagaattcataggacaaatggggctattgttcctttcccacaaattcatatgcagtaaaagatcctaaaactccccttggtctggcccaaaccctgaagagaaaaatcgtgattgtgttattttataaagtcttttctttaaaaatctcaagtgacattcttgtatcagtttccaaaagcaatgcaagaaagcaacctgtagccagatttgaataacattgtaactttgtcagcccatagatgaacttttcacaaaactggtaaaataaaattaaaaatatggtaaaattttttaaaaaatctgataaagttacacttattaccatttgaagaaaaagactaaatgaagcaaacctgtcatttctgtgttgcagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgagtgtttgtatcaaatttgtcctatcaaactatagtttatttaaatatattttgcctttttgattttcctaatagttttttcctgaggtgtaaggattttaaaatatgaaagcttaagtggccaaaatctgtactggaacgtagctatgttcaaagtgttaaaatgatcagtactatcacctacaacatggagagacttccagatcccctcaccagtcccctacccagaccctctgctcagcagcccagtcaccaaatgtccccatccttcagaaattttcttcagcttcaccttatccattaaacctcatattatttctttcagctgaaaataatctctccctgctctgaatttttagaagattttgcctgtgtctcattcagggcactaactgctatctaccatatatactgtagtaaatttctccatttattcgtttagcaaacagtgagtgagtacccccttcacatgaggcattgtgggagatgcaaaaactgaataagacagtttccttgcttgggaggattcctcaagtgatagttattccacagtgcaccctaagatatcccataggaagaaagcgttgggagaggctggactccttcgtgaaataattttggagtacagtgtttatactcaaactttctacataagctctgaaagtcttacacaaataaatttgttgatgcttgtttaatccgcagcctctcaaacttctttttccaatgaaacttttatttatgtaagagaagttagttattagttgttggactgctgccccaagaaaacactaaagtagataatgagtgtctgtctttccatcttcagttcctgtcatagtaatatacataataggtttccaataaattaaatgactgaagagctggataagagattggctagaaataattactgcttttaattactaagctttcaatagttcactcaaatgcatgactttcctgtataatatagaaaggtttctgtgaagtgataatggcaagtactcaaaccaggattattcaaattgtcacagcttacacagcactccaaaataaactgaaacatgaatttggggaatacttataacccaacagagataaaaatttttcaggaaacctgtgcatctacaactaaaatactataagagtagataagaaatctacaagatgccatgttacattgcgtggctggctgctgcctctctggttagttccaacctgtgagacagctaggggtggaaactgaattgcacatccacccttcatgtcccactccatccccccaacccttatgcattttgacaggaataccgcaaaaataggaaatggctttggatggataagaacaaaggccccatcatagtacaggagagaatggagaaatacatttgtatgagaagatagtggaagattggattagatgtccaaatgttatgtgaagttttattcctgttgcccatagctagagttgaacagtggatgaagaaactaggtgtgttgtaaaatagcatatgcctcttggcatagctactgaacaagagagtgtctattgtacatacgagtctctgttctaaatttgaacaagatgtgatctttatttgagggaaaagatattcaatgttgcttgatttccaaccagttcaaataattagttaccaattctgttattaacaaacattatgctctaaataccagtaagataatctccctatttactcttttgtaaagccatgtccgtaaacaattcatttttaacagaattctagtatgcctatgtatgcgtatgtgtacatgtgtataagacatatgacctaccagcgatggctttattattctcaagaatggtacattatcaagtatattttatctaaatatatgttcacatatttccaaattgtctttatttccataatagtgtagcatttctttaaaaagtttaattaagcagcaggtctgtgtagtatctttcatatacattgataaaaattagaacttgttagaaaaaatttaaaagaaacagaatagagctttaaatctaattaattaccgtcttcaaaatgaagcccagaaatgatgcaagtgttatttccaaaaaggggatttatttcttaaaagctgccatctggtagctgagataagatgttttatataatatactgctaggaggtaaagaatattaaagaaaaatattaaattatagtaattatctatgttcactactgtgttttctaatgatctcttaaaccaaaagatggctaactatcaattgtagctttggtacatcagttagcaagaaaagttaaatacaataatatttaaattatttaaagctccttacaacaggagctgtgtaaatacaaaatgcttttttaattcttaagaacaaaaatatggatattatatttgttaaaaagcagtgtcatattttagttttaagtaaggacaagattatcttaaagatattatgacaaaattatcaatatgtatttttcagtattacctccatctataggaatttatttttagtgaaaagctgttgtcatcattatgaacctaaaccacttccatagaatccatcctgtcaagactttattagatatttaatgtgaacatacgtagtatggtacattaataaaagggaaaagtgctcttctagaataaacaagataagcacctaaagtattagtcaagcaacagtatgtgttgggtgcctactgtgtgcctactgtgagcctggtactatcccagcagctgggaatgctgcaaagtcacaacctctgactttctagagtttacaagaatctacttttatactgatcacaaactgtttctcctgcttggatatactgaggatgtcaagtatttgttaaatgaatcatgaattgttatccgataatattttgtaccatactttaaggattcgtaaaatgcttaactttacatcaaattgatgattatgaaaaaaactggttttagcttttttccataaggatgatcacagtagtaaaaaagtgatctcaggtttagtattgattgactgactgatttgtgacccacttatctatttaaaaagctaacctagtagcatatatatgcctgactagggcaaccatctgtgtcggtctcttcactcttttttcaggcagtcacagcacacactgaattgactgccatatcagtgccctgcctgtggtttgacatagacatagttgttgccatcagaaaactcacaatgtgaaagagattttcttctgttccagtttaatctactctagcttccaattcacaggtcagagaagcaggccatatgtgttttctatctcataatacattgatactcaagaccagaaagctagttatgtctaaatttgtattaaagtgtgtgacacaatgcccttaggttttggaggttgtatgtattaacctatccttgacgtgggaagtcctggcatgtaacataatatcctagtagctgttataatgaagggattggccttggtgtggacatggaactgctttgtgtgtcaccgaggccaaatcacacctgttcatcacaacatcatgaaatgataggatttatcatttaacctttacatgcatatcactaaaatcttctcaagataaaattcaactgactttaacatatttgtttctcttgcattgtcattattatattgtaatagatagctctattaattccacgaagaaaaaatgtcatgtttgtgaaatctttttggcaggtatagaaagtatgtatggttttattgtgtcaaatatattgtgaagaatgcagacatctcagaaatattagtctttttctaatcattttgaccattgtgatgaattggtcacaaagataatgaatatttgtaagcagactatcagatatagagtctcagaccataaaagagataagcaaagtctacctagtgcaggttagagttgaattatcattgctttattaatgtattttataatattattcattgttattctttcaaactcgcggctttgaacgtataaattatcttggagactttaaataggtccctaactagataacagaattgcaaagatgtgaaggacagatgctttcatccgaaacagacttttacacaaattctgaaactaatttggaagtgataaaaattaatttgcgcactttaattggaagcagcctactgcatgaaagagagcagagcagagcaggcaatttgtgctaaaagctgattgaattttttgtcaggtaggtatcttggacttggccgcttatcctcttgagcctctctttgcaatatattacaacccatctctgactggtgttctttaaaaggatcaatggtattcctttggaatccctagagtccaaaatttcattgatcttaggacttgacatttctcattacgtgctgtagcttccaacaagatagtcacaatagaggcaagttaacattgttgtctcttcaacagacactcaaaatacattgggacttcagctcaaaagccaatctgcttttaaagaatgtagttttaatgtttataccacatacaaggtgctttatagagagtttgatatacatacatacaaaaatttttaaatcatagccatgtgaaactttgaaagaggatttaccgttcatcttttcaactcaaatctacaaatattcattgggtagtttgtataacacattgttattatgcttttctattccactttttaaaaataagtattttagctcgtgtacgggcattatgcagactgtcaaaggagaagccaattgcaaaggagactccagctgtgcacacacaccttctctgggctcccattgtgtatgcctcagctctggacgctgaccctcctgccagccacaacctgtcaccaaacatctgccaaatcacatccctctctttgttggcatccaggcttcttttaaaaagactatcctggtgcccagctccacaactgccactaaccagtgctattataagaaatgaaagcatggccgatggatagcccagagagatttgtagagtatatttagatttagatacattaaacaagtttgtatcacttctcggagcaaagaatcttagctaggatttagcatatgttaaaccatctttgtaagatcagaggaagtgtagctccatatgcaatagttctcaccttgcagggctttttgaggaccaaatggtaatggatgtattggaacatcgatggcacagagtccattctgcagtagaccactcatccaccccatcccctcattctaacaccagtagactttccagggttccagactgagaagggagctgcttgctactcggcctcggcttttcctttccttttatgggactaaggcttcaagaaaggtctttggcctagattggaagcaatatatacagagtgactaatgtgttctgatcagagagcttcaggttccaaccagggggtgtctgggctttacgcagagcccagcttcctgaggaaggggaggtggatgatactattagttgtttttaggtgagcgtaggacagtaatgtactgtgacctagatctgggctcaggacttcaagagaagaggttgtcctgcagtggcagtgctcagaggaaaatgtagtcattgttatctctgaagaggaaaaagaagttagaatgaatgaataaataatttcaccgtatctgtcttccattcttcactgaatactctatgagtacataaggaaatgaaaccacatcatgggtgaatttgacattttccaacccacagaatgtttttacttgcattatcttgggaccttgggaaatgcgggtccaagtgtatttgatacttggaacagacctccacagcacctgcctgtggctgaggagttggggtcttgataagggactcctgaccgataccgctcttctcagctattccagcaaatttctaacataatatgttgaaataaatcttgaaatcatagtagtaatgaaactaccataccctttgactaaatcccttattctgggattttaactttcaaaactccatcatattttatctaagtataaacatgaataaaaatatcttctgccatgattctgcagtgacttccccagggtcagaaataaaatctgaatcagattttatcaggaggttcatcctctcactgtgcagcggaggtcttagaaactccactggctttgtttagttctaaatcagaaagaccacagcttcccctgcatatcagtgtcccacaaatgaggtttaaaataagaaccatgagttctttactttggccatttctctaaaagccagagaccatctcactaaaaaacctctcctgtctatgtgaataagcagcatctaatactagtatatttttttatcatccattttgagaatattgaaatgacctttgataaaaggaggatggaatttgtttattttaagccttttaatattcggagtttccaaatgcatgtctataaggaatctaaaaattggacgtgtttgttcttcatcagttctagtcattccagcacacggtgagtgcttctgtggaggcagtggtgggcctgagggcaacggcggtggccctcagaggggcggtccacctgcacctccctctgcactgggccctttaaccctgggctacatccatcaactgtgatgtgacagtgacagaatattcctaggattttgaatgattgttggggtgtgtgacatctgtccctagcaacgaaatgaaatataggaaacaagctttcccgccgctgcaggtttcccaactcagaaagcctggaatggcattttatttgcctttcacttaaagaaggaaacagtgctttcaggggccctaaaaaataccccctaatagttaagttccacagtttattcagatgatctggggaaatcgtaatgaaaaaaataaaatattttaaactctctaaatcagacatgagcctttgaaaaactcatttcctagcagaaaatgtataacatgcataaggaatatttttatacattttttttctcaattccctgcaataggatcagattgctttttattttttctatagcatattagggaaaggtcccaaaactattcattttatataaatgaattaagtgtataatttcagggttttccagtgtgctagtctctccaagataaaattatcatttagaaaaattaaacctgatattacacataaaatcttacaaatacttttttagagatttaatttttatggatacataatagttgtacatattgatgggatatgttatacaaggatacaatgtgtaatgatcaaattggggtaattaggatatccaacacctcagacattcatcacttctttgcattaggaacattctaaatcttctcttctagttattttgaaatgtacaataaattattagccgtagtcaccctattttgctaccaaacactagattttattccttctgcctaactttatctatctaactgtattgttctacccattaaccaacaccttcccaccacccttgccagcctctggtaaccactattctgtttatttcctctgtgagatcaatttcttcagctcccacatatgagtaagaagatgggacagttgtctttctgtgcctggctaatttcacttaacctcatgtccttcagttccatctatgttgttgcaaatgacaggatttctttttttttatagcagaataatattcaattatgtaaatatatctcattttctttatcttttcattatttgttggacacttaggttgattctatatctgagctattgtgaatagtgctgcagtcaacacaggggtgcagatatctctgatttgctgatttcctttgtttggaaaactcttatcaatgcttaaagcttattttaccaggaagcccagggcatctttgaaacaatttttttttctttttcacctttttcctgcagtgtgaaacataattttataaattatataaatatgtttcagacaaatccaggactgctgacattataaatggacactctaccaatagtcaaaacacattatagcaatatccatgtattcagaagaagatggcaaactagcatgagctgctgtcccccttctcccacactccatctaagagatgcctcaaaaacaaaattggagctgatgggtctgagaaaatgcaaataaaacggagaaatccttggggagacagaagataggcaggtcttaagagaagataggcaggtcttaaggaaggggctcttggccgaccagagtggaagatgtgggtcgtcttactgggtaaggccttgtgattatgcactttcctcatgaactctctgtggcttccctcttgccactgtgggcagagaactggagcagcagtccagctagccagcacccagaggtcccataagtgccaaagaaggggctattcagggggaggtgcatctgccagccctggaacatttaacttcccccaaccccagtgagggccagtagttcaacctaggaggcagctctaggaaagaggggcaccaagaccaaagtacagagtggttctctgagagacaagataggggatcgggggtggttaccccaccaaaaataggaattcacaaaggaaaacaggcaagcatgcaaagaacacaagtgctagaaaagaaagaccgcaaacagaacaacctatatgggtgatgcagaataagctcatttctttctgataaaagaagagaaaaatatagaactttttacaaaaggcataacattctctaagtccttcaatttatgaaagcagttagcagtgaaaatgcttctgggatataattcagctggactttttagctaggttcgcactaataaagtgaagtaggttcaattccaacccttagctgtatgaacttgggcaagttgaatcaccttgcaaagccttgggtgtctaggctatagactagggatagtaagagttcctacctcatagagcatgaccataaatacatgatgtaacacagataaatgccttagcaggcattgtacctgtttcataacaataatggaagaaaaagaatagccattaccactctcgttacgttctaagcatgttacatacgttaacttgtcctgtcatctaaacagcatgtataatagattcgctagttatgcgcatttcacaaaagaggagagcagagaggttaagtaactggctcatggtcacacagcttaataataatgcccttaataaacatgggtattttttgaatattgcattgctggtgtagctctctccccctgctattggtctgtagtgcctcactgctgctgttttcttgcaggtgactatccggcaccaagagccgtcctcacaggccatgaccatgaagttgtctgtgtttctgtctgtgcagaacttgggcttgttatcagtggtgctaaaggtcagaagtcatttctttcattttcaatgtctagaagatgactgttttctcacactaagcgtgattgtcagtttatttcttccaggaagcttcccatagacaaatggtatcccaaagttatttgtagatgtttagttttatgattaatatttactggcactaatataaaatatgtataaaattttatgtagtattttgtggtcaacagtgttctaagcagaacactgataaattacagtgtattcttatgatgcagccattgtaaaggacatgtaaaagacaaggggaaagtatccctgatgtagtgggggaggtggggggtcatgtcactcatcagacacggcctaggatcccctccctcttcaagtccctttctttataaggccaggggctgtgtagaggttggtggaaaggaaacaaagattacttggttctttggaggttttgttttgtttttgaggcataccttcactcttgtcacgcaggctggggtgcaatggtgcaatccaggctccctgcaacttccgcctcctgggttcaggtgattctcctgcctcaccctccctagtagctgggattacaggcgcccgcaaccaagcctggctaattttttgtattttcagtagagatggggtttcaccatgttggccaggctggtctttaactcctgacctcaggtgatccacccacctcagcctcccaaattgctgggattacaggcgtgagccaccacacccagcctctttggagtttttgtagaagatctttcatttcaggaagtcaggaaacttaggtcctagttctggctcaaatagcagttctctgtgggaagactcccaggcagaaaggagcctgatgcttggagaaactgaaaggagccctgggtgctgctggagtatcaccgtggtgccacaacctggaggaatgagaaggctgaagggatgggaggggcctggggcacaagcatttgcaatttttttttaaatgagtatagtaggaaactattgaagttttttaatcgaggtgatgagatagataggtttggttgttagagctcatttcagcctttctacggagaatggatagagtctgaaggctggcaccatgtttttaaaattttggtatctaagaataaataacccagaaatggacacataggatattttcagtcttttaattttaaaaagtaataatatgtgtaatatcattttaccctgtgaagttaaaaaaaaaaaaaaaaaggaaaataagtgacacatagtaggcgccaagaaagagacatttcctgcaggggctgtgtgatattagagatgattgctggtgttttcctaattttctatagggcaagtctattactttagtaatcaggacaaaatttaatcatgtcacttgctttgtaaaatatgtgtctattcagctcaattaaaaataaacacgtaattcatacattgttttgtggaaatctttttgggacaagggaatagatatataacaccaaactatagtgaccaatttttatgaattgatcagtgaattttttactttatcaacactattttataagggcaaaaaaacccagaaaccatcagagccaaatgtcactccttaccctcctttcacactcttgcctcactattcatttatttgaaagacaaaatatctttctgtaggctgaaatacttaagttttctcaattttgcttttacattttatgcgtatggatgacagaaaaaggtaaaatgtacttgacggcagtgtattgatgtggtacaacgcgtaaaattttgatgctacttgagaaaatgagcagctgttctgataattctattaaactttcaagaaaagtttctaaaagcgtattaagagaaaatgtctggcacataaagtcttttattgtcacgtaatctgtgagctgtaccattttactatgaatattacctgacaaaggaaaagaccaagtatctacctggtgaagaagcgtgcggcgtaggagtgtgatatgtagcaggtactctggctttgctctgtttaaatgtagcatcagcgcttggcctggccagcctacctctttcctgtcctcttccgtcacatctgagcgcacacccagcaaggttttcaggttggtgggagctagtatgtcgtttgtcgtccccaactgaccctggcattgatgtccccactttgcagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggtaaatctgcatagttcgtgctaagtaggactgaagccaagagattaaagattgattgttttacattaaataattcataatagaatgtctgtgctatccagataaatgtgttctagattaaaagtatataacttcttgcggactggtactttaaagaaacccaaagttcatttaattgcaagtaattaactcactgcattagacttcagaaatgatagctgttgtttgattaaagcttagaacctcgggagggtttttaaagctccttttataattgtttcagtgctgcaccctcacaacattaaaagtgagtttattttcaaagatttctatctctagaaccctaaacaaaaattacatatacccatttgcccttcattcatgaataaattataattgctgggttgtcattattaaacactgttttgaaatatgtttcttccatttgttctttaattctctataatattaatattcaagatttaactaaacatgttacttaatgctcaaattcttcctggattaaattgataatattctcttgggaatttaatcttggttttaataagatcttttgtatatgtaagaacttcgatgaattccacaatggaaattctgtggattgaacttgattttgttggacaaatgactgacagtaggcaataatgataagggaactgtactgagtacttttcagtagtgacagttggctatttaggaaaaattgagagaaatggttgttgtgtattttattttattttgtttttttttgtttgtttgttttaccttttctgaaggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggtgagctgcgtcaaggacaagtatcatcactgagaactgtcattgaaggctctcttcattctaccaagggtgaattgtgctgtgagtgcaattccagcatccaaatgaaagaaagactggcaaagaaaaggggaaaatgaggggaagagtaaggattctagtgagagggaaacagaggaagagaataagaaggaaaaaaagaaaaggatctgatgaagaacaggtgcctgcagacatgttttaagggcccaagacatagaacttactcccaccaagttccctgttctcaggttcctgcctagtctcagacaggccaccctggcttatatgatgtgagggaaacacgtatttttcagcagaggtgggattcagtgtgagacctacttcttgctaaccagtttccagcaaagtgcatagtgtgggccgtagctggcccccctttcaacagcatgcggcactcacgcattacccagaacaatttttttacccccatgttcttatttacctgtttctcatttatgttattttgttttattgtatgtatttccttaaaacacgttaatcctttaatccagctctttcttggaaagagttgatatggatgttaatcaattaataatgattttccattgttcctcaatttgcaataggattttattatttcctgaaatttacctttgggtttcttacaaagtgaaaataatattagaaatataaagtctaaagttcctaagcctttaaaataaactacaaccctgtaatctgaatatggcatgtgatttctaatttttgctatttaacagaaataagaaaagcttgttaatcaacgtttttcccaactacatgtaatattcctcataacagtattggttttaaaatattttaaatattaagacataataaagttaacaaagcatcttcacaatataataaaatggcactgaagtcatcaggaaaaacgctgtaagctaatttagtctgggaaaggatgtttggtctgcagcccagactgtttttaaagaaggtttaaggttattattggagtatcccaaagtgctgcagcccatacttaggaataaatgggaatggtttgttgtgttactatttgtatatatgtgtgtttccagagtgtttgaaatgatttgtgtttgtaagcagtttcaatatttccctgatattcttactcgttcgtgtattcattttgctgccatcatcataggttgagtgcagtgcaaagtactaaggatccacaacaagaaactgaccccagagagctcagatcctcataatcattgcatatgagggcaccaggaacagactaacagaagaaggaagggatgaactcttcttgagggctgggaagggcaggaaagaccttagaagaggctcatccattcaccaggcatgaacagacagggtggatggaagagcatattcaaagttgcagtagtattagggggtctcaatggaggggggaaagatactaagtttctatttctattttaacctcatccttggttttgattattttgttgttttataatgaatagtgcatgcatatcaattataaactgataaacatatattggggatattactcaaaaggtatttattggatgaggtgtctaatcaaaagtgaagcaacactttatgtagacagaaatcctgaaacctgagttcagtcagtggcagtgggactggggaggaatatccctgaaaaagaagcctcagagctgaacagctgatcagttaggagggagagggagaggagacaaggtgacttaaccagcaaaagaccagcaaggtcagaaggtaccagtgattcatggtggacatgttgaatctgagggttttgtgacacagcctggcagtgacctccacttggcaatgggaaatcagcatctggggcttcagaatgagacgtcgttgcctttacgtccagggagactgtggaccgagaggacaagaggtggagtgattcaagggggcaaagaaaagaaaggtcacagagataggaagagatgccagatatcctcagagaagccaatagatgcccaaaacaaggcagcggacaggcacgtgtgtgattgctgagagaaatggggcacccagcggaggctggaaatgtggttccgtgggcccctcacgctctgcagcagggctggctgtccaggtgtgtgcgggctaactgtgctcctctcagcagaaccaagaagaaatttcagtcctacttccatgaatacaaaattaagacttggcaaaccttgagatcgtgatattgtctagtgtaaaatgccaaactttgagatactgtctagtgtaaaatagcaaccacagaaatgattttatatcactcttaactgctgtttctgcttttccaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattcaccgactgtttcagatttcattggacatgtcactagcatgctttcattgtgttgtcatacaggtttccgaagtcatcatcatctgatgtagagcctacagcatctaaaaacatgaaatcgagtcctaatgaggttctgcaatttgctgaaacctgagctgctctgccgagccatctggcagggatctggggcaacagcgaccatggggaaacggccctcattgtctattctgcataatccactttggggattgtctttattttatttaaaaggaactaagtagtgaa

SEQ ID NO: 696 - DNA, 298751 bp, Homo sapiens
gttccaatgagaatgaaggctgaggtgtgcgccttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctggtgagtatgtttctgtcatttttagggttgcttctgcagtttgccttggagtctgggctgtgggaaaggctgctgcgtcctggtgaggacactgcgtttctttcagactttgaagatctgtcgttttagaaaagtggctgcctctgtcaccagccccatggttactgtcctgtagtgtgactgtcaggaggtgtttctcagtccttcgttgtaagaatgtagatgccggttgcaccttctgttgtcttggaagagactgcagtgcttggctggaaaataagctgctcgggactcctctgagaagccaaagtgaagctcagagatggaagtgggtatacttgtgctaacccagggttgctgaggttgggtgagcttccgcttctcagaggtggaggagaggcagctcctgagccatttctggcctcgtggtcagagctgcccaatttcagtgtgagaaataccagagaggcagaactttggctgccttctctaaaagcatatgaatgattgcaggagcgtattttacgtcctttccttttccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacattttttttttaatgttgttctagttactgtaaatgaaacggttaaaatgtcataaataccttatgataaacatttttcaaatttgcttaaaaagcaacacatcagtaggcagggtatgacagggagctttttcagtacagtcatttgagtgtgtgggcttcctgagttaataatgagtcagcacccaattctaaaattggagcagctaagagaatgttcaatctgctcctcagcacagcacggtggctggccggccccccgtaggaaggcttggctggtggatctcgggttaaaatcgacttaggatgccccccttatgtaagtgaccagctcccagcttgggtcccagctcctctgggcttctgctgagagaccccctctgctaagggatctgtctctgaggcaggagctaacacatttggcttccaacctttggctaatgttgacgatttttaggttgtcttgaggcaacaggttgaacatagtttctgaaatgaaaaatctagtgtttattaaggccagggcagctgagggctgagcctgcatctggagccttgagatgttccgcttgcacgtcaccctcgccgagggattgggcgggagagtcggtcaccgagtgaacttcaaagttggcgctctgcatgtgacgtgtagcgtgggaagattaagtcagcttaaaatgagagaacaagattccaaggaagaaaacctccccagaaccttactcgtttatagataaaagaagataaatattgagaaaattaaaaaaataaaacgaaatagttgggctgcaaaccagcagctctgggaccagatgcagccctggtgaaggcatcccccaccaggttctgtttggcctgctcaggattgtttttttgtgttgagataactgtgggtggggtccacactctccggatctcaggccctgtcacaccctaatgccacaaagcttggagagtgcgattacagcgaggctcagaagccaggctgagggcctgccagcctcgtggggctgctgtgtggtccccatgggttagcatctgcccggccgccggaacagggcctggatggagaaggaactccatcagcactaactctgctagactctcttattaatctgccctctgaaggcatttgggcttgtggcccttgagttagttccatggctttttcaagaaagatcctgcagttccaatgtgagcagcagttgtttccaaggctaacaatttcacgccaactagaagcctccacaagtcaggtgccaggcatttctaagccagtagagcagctccgcttgtttctctgggtgagtcctctcagggtgagaccctgtctccttgtaagcagtcggagacgtgccaccttcatggagacgggagccaatcaaaggcaaactgcgttagacagctcttccatgcggtatggacaccaacattcgatcatccttgtttcagagaaggtgccgggccccagacatgtgcttatgactgggtcccatggccttcaatcctttaaagggttttaaggtggctgatttttatcccagacattgatcatgttttttttcatgcagaatttgggcagttgtctggacattaggagttgagtcacctcctacccatgaggaacaagcctgtggggggactgatattatcacttctgtcatcaagaaataaggccgcaggcatccctgaatatagagcatttattaatcgaactgtgaaaatgaaacacagacagtgatgacagctggaagttggccaatgtcctgttgtcatattgccctcagcctagggactggcctgtggctcactgaccctgtctcccactctccacctctcatcagcacctggacctggtgcacctggtctacctcatgtccagtgttttccgcagtacctgactggtatccccacccttggttgttgtgtggtgagctcgtccctatgttggcaagttacttaattcctaggtgtcccgccttcctcactgtaaaatgagaatagtcatagcacgaatgtcatgaatccttgtgaagattttatgattagcacacgagttacaaggagacacgataactgttacgtacgtactcattcgttcggaaatacaacagacagcttagtatctccacccgggtccctctgccctgtgggaatccataaagaattgattctcatcccccagaagtgagatcccgcttgtgtcatcaattacatggcatgttctgcatttacaggacatttatttattaggtaagtggggaatcctccttggttctctccaggaaaacctggagttctagatatcatcatcatcatcatcatcactgtcatcatcattgacatcatcacaataagtactcccattgtattcagccctaaccgtatggtagcaactttatggtattccctttaacctccccccaccccaatatccatcctggaagatgggaaggatgataggtttgttgactcactcaaggcggtgggactctccagcaggtatcaggcacagcatctgcttcaaagaacacatcgacgacaggggagccccttgcactcactcaggacaggagaatcaggaaaagcagcagatctgcagggctttgtgtgtaatccaaccagactgatgccacaggccaggaaaccgaggacggttggcttcagacctaccctggagtggaagcagctggattctgtcctcacgcttcctgtctaaagccagctagagtaaatttctagtcatctagattctggttatttggaaatcatcacagtatctggagatgactcatattgaaaaaaattaaataagatacacttaaaacttaacccagggtgaacataacatggcctttccttgtcaattctgaagaagatcattcaagtttgtgcagtgccttagaagccagatgctctcttccattctgccagggtcctaaagaagtactactgtgtcctttagatcactctgccttgatcactctgtcccgtcactctgctatttcacctgtcagtgaaatacctggtatcgtcctgccaacgtgaagcattgaatgctttatacgtctccatcctgattgtttaggctttgaatgctgagaagtatctgcactttgttggtcaattgtagatggtgctaatttgtggggagtttttcctgcaacttccccctgtgccataatccagaggacctccctctgcccccagtgctgtaggctaggcagctatgggcctggctcagggctgtcgggcaaggattggactctctataggttccgttgggttctggttagatcacagagctcaggcaaggaaaagccgacaatagatcagaaggaagttgagcgctcaggaaggaggagtgggcaggatgcttggtggtgtcagaggattccttcggattaaaaaaaatagatgttattgcactttgtgtaatcagaaaagctaaggttgacagcagatcttatccactgtggttttcctgcttatcttttgttttaggagtgataaccctgcgagtgagggcttctgttacagggtcttgtagctcttctcttcatcctgccctttaaaacatttattggactaaaaatcacaggatttttaatgatgacagaaaatgtattattttagctgttctcactggacaaatcacttacggagtgttgattaatacattgataagtttctatcaattcagctagatacaagggaaaatgtataaaatagcaagggctccgaaaagagtcaggcttaatttctcttgcacagaaaaaggattctattgctctttctgttccgtcctcaaacaggaagcaggttttctgggacaagggtcaacaggcagccagttcatccatctgcctactccgccatccttagcactggcttccttcctccaagttatcttatgcttcaagaaggctgctggagctcctgccatcacttctgcattccagacagaagagaggaaggaagtggggggcaaaaggcaaagcctcctagatgtcagactcctctgcaggcctttccttgaattcccagctaaccctttcagcctagtctttcactggccaccctatctgtaaaggagctggaggaggaagatggaggagtgaggcaaggccctgagatgatgcagagcaaggggcacacaagaggggactcaggtccaaggtgaaatagcagcaagcactctccctccaaaacccaccgcctccttatgaatccctttggccttgattatgccagtagataatgggtatgtgacagttttagcttctctggcctttgatcaggttgatttatgtgaatagactccatgtccttggagatgaacctgttctaaaaattctaagcaaccagccatttggctctttgctggaaagtagcctggcttttgaagccaagtctggacagtttccttgctgcacctcaggactcaaaggacatggtcctgactcaggaagagctggctttgagggaaggggtgagtcatgaacccaagcacagcagagattcttggtgtgtgctgcagaaggtgagagtagcccccatctccctgtgccagtctcctgggggaaatttatgatggccttacataattgggcttatatgtgtttcactagaaagacaaaaaaaggtgagaccttgtctgccaattcgctaccacctccttggggtctaagagctaggctgtttgttcaaagctaggctcctttgtgtattaacagtgtgaccccgggcatcatccttaacccctctttgtcccaattccacatctgaatgatggggatgataatggtagactctgccacatatggttctgaggactaagtgaggccacatgtgcaaaggatccggaacagtgcctggccccaagtcagccctcaggcaacagaacagtgtttggattgtccttgttgctttattggatacgtgataagtactggtgaaatgcatgaatgaaaagaaatcccacttgattttaatacaagaatcaagcaagtgacttctgtccctttgaataccctcctccaagtggtccaaagtccttgaagctaccatctccttggtacccttcctgatgcttctggtgtgggcaatgaggttacttcatcaagtagaccctggttacagagaagttaaatgatttgtccccaggcccactcacaggagagagtactatacaatatcaagctggttgtcttcagcactctgttgtagagacttccagtatgcattctcttctgcttcctctgttgtcaaccacaagtccatgttgttagggacaacagtgtgcccagttaaaaaacgatatttcctagtctcctttacagatacggtggccaatgaaagatataggctgaaagggttagctagggattctagaaaagctctctaaaggagactgacatgtaataggcttagcattttgcacctgaattctctccttccccctgtctggaatgcagacgtgatggctggagctccaacagccttcatgaagccataagacaatgtggaggaaagaaaccagtgctaaggatggcagagcaggcagatggtcacaggtctttgggtgaccagctattttgcctgcctggagatttgactatttttggagccggatgcagagggaggtgggaaaaatattccagctgaaattcaacctgtaggagtatttttcagggtgtcagggtcacttctgtgtggagctgcctttcaggtctctggtatagggggcaagggtcatggcctcatggtgatgcccagggaccccaggtgctttggtctttgcagaccactttcttatgaaaaagcagagtgtgactgctctggcagaaagataaatgtcattcaggctgattcattattatacattcattttcgtttatttgtggttttcctctgattttaaaataaatcaaaattaaaacacttgtgcaggcccctaacagtatcatgggccccatgcactgtgcccagcatgcccagtggacatgtaggccccaagagggcagagagcaatcacagaaggacttgccctggccaacataggctggtctctctaggggcagcttcggaattgtgaattacccagagctgcgtgccaggaaatgtggacctaactcttgcctctgaggaaggcaggcaggcttggtttcatgtactgttgatgagcccgacatcctcaatgctcactcgagctttggaaatgacaagcaggattttcagaacaggattctctgtcctgtccctgttttaatttcagcctccttattccccatgtaataattctccatactggctcaattatttgtttaacgggtatgaattccagtctataatgccaaggtatcaaaatgtgacgtacctttactctagaaatctctaaattatattaaatctgctccaagatcgccctgccctacctcaccctctctgcctggttattgggagattcaaattctgtcattattggggatcctttcttgtcataatgctccagatgtcatcaaacaaacttgggcttaggtgatgccaggaaacctgggggggagcatccattgtctgcagtggctgctaccattgcaacttcgacacctgcagtctcagtgtgtggggggctctgggagctgctcagggcctgctccagttggggtggaccccacacctctcgtgatctgtcctctaactgtaggctccgctgctggaaatgtgtcgctgctctcatggccactgtgtgagctcccagtctcggcaaatgcacccagcaatgtctgattgatagggcaccctctgtgggccttgtcctgcttgctgctagctgctgctgggcctctcccagcctgggcctcctgtctcagtctgaaggccaagagacagcagcgacagcagaggaggcagaaacagaaaactctccgaggacccggggaagtcacaaggtggcttcccaaactctctagtgcagcactgtctgatagaaccttctgcaaggatggaaaagttctgtatctgtgctggtcaaagcagcggccacaagtcacatgtggctcctaagcaactgaaatgtggctactgtgactaggaactggattgaaagttttatctaatttcagttaattttaatttaaatgcccacaactgcatgtggctaccaggttggacagcacacatgtggaacacagactcctgatctgggagccttgaaagatgagccgtcactctgatgaggtggagggcctgaattgagccctgcggtggcactcggcaggtcttcagaggggctggtgacccctccaaggtgcacagcccctgggctacgagcagtggctagtcaggttggggtccctggcctctgccatgagtggccactagtggaagcctcaatgtctccacctccagtgggctctcaggcctcacgtgcccatgccagggtagggggcctgtcgaggaggatgccctggcacccagagcttctctgctgtttgtcctgagggttcccttgggctgggggcctcaggtgcagggcacatgcagccggactgtccagccttgtggtatttgcacatgaactttcctgcgtggggatagacagccttattcttgtttgtgtaaagccattccaggaactattaatagttagactggcataaataagcctcaggtttggttcttgttagtgtcctacaaatccctcaaactttactcttttggctttttaagggagaagctttacagtatgttcaggcacaattgacaagaaacatacaagttgtgcggagatgagcagacccagggccccaggcctgagcctcttttctctcccatgccctgcctgctcaagttaccttgagcacaaatgatgtccttctgtgtgtgggatcacagactgagacatggggctgttcctcccctgaagtcacccctcaagttccccacatgattttactcctggctactccccagtttgctgtagtttgctggaccatgtgaccttggaggggctcacaaggcacaatgatgaagccactgccagggctgagcctcagctcaaccagctacttaatgcatgcatagcaagttacttaacacctactgacctcagtttcctcacccgtaaactagaaatagaggaacaattaccacagagagttgttctgaggatgcaaagagttcttgcatgaaaaattcttaggaaagtgctgcacatagtaggtattcaatagcattagctatttagattggaattagtggctttttgccatttactcctgactgtaggagctgttctctgggccccagatctccattccagcaatgatctctctcctccaactctggcattggaggagtaccacaatcctgcctccaggtttcatttgctgacacccaggggcagcattaggtgtagagtgctggacatctaagggaagaggttcaattgtccatccgtttagttatttactcattattcaatgaatgttaattgagaccagtcagggcagctgagaagcagtgcggttgtgaggagggctgttagtaggggagatgcaggtgctggtgtgcttccctgtatgaatatggcagctagtgcagcgtcatgaagagggaatcagggacactctggggatgttaaaaactctgttgatgtggaatcagaatccctgggccagtcctgccttcctcttgctagctgtgtggccatgatcgagggtcctctttgatcctccctgatacatgggcgaggtgacccacagtggcagatgcttaaccatccaacatggagtcatcatcattacttagacacccttcatttggaatcacgattctcagtgtgaagggcacttcccaccatagaagcccctctctgtgagccctcagagggctgtctaatccataagccctttccctcccaaagaggcagcccagcgcatcactgcaaagcgccagctgagaagacgttctataaattatccaaagcctattctctggcacatccatattttggacctagctttgcccccgaagtcatataagcatagccacgatgggaaggatggtcataactcaacatgcccattcatataccttgagcacatatcctgtcccagaaactgctgaattattgcatgagccccagctccttccacaccaaagcccttccgactgcatggacctcaccacttcttctttttttttttttttttttttttttttttgagacggagtctcgctctgtcgccctggctggagtgcagtggcgggatctcggctcaatgcaagctccgcctcccgggttcacgccattctcctgcctcagcctcccaagtagctgggactacaggcgcccgccactacgcccggctaattttttgtatttttagtagagacgggatttcaccctttttagccgggatggtcttgatctcctgacctcgtgatccgcccgcctcggcctcccaaagtgctgggattacaggcggacctcaccacttctgttcaagctcttccttcttctcatgattcctggaaagattctttatgtgctgaggtgttcagctacccttgatcttgtgctgccttccacagcatctacttggcaactttccaatgtcccacttcaggtgggcacagtgacctcctttgtctggtttttggcaaccatacctatctgttggacctgggcactgcactgacagccagctgacctccctgcctctctgtgtgggaacgtgctgcaaagccacatctctctaattctgtgtgtgtgtgtgtatatatatatatatcttttagagacaagatctcactctgtcactcaggctggagtacagtgaagcaatcatagctcactgcagccttgaacttctgagctcaagtgacccttgacctcagcctcctgaagagctgggactacaggcatgtggcaccatgcctggctaattttaaaatcttttttttggtagagacgagcgtctcactgtgttgtccaggctggtctcaaactcctgtcctccagtgatcctcccacctctgcctctcaaagtgctgggatcattctgaatatgaggtggtgactttttaaaaaaaaactttttttttaacctaagtagaactttgcattatcgctggtgttgtcttttagatttagcccatgtattctctaatataaaacatgaagcttcatgtcatctataacttggagtggtatcccctttacatcttcaccagaagaccacttggatcagtgaagaccaagagcagagacctgtgacatccactagcgattgtcttcactgttgccactatcccagtgctctcgggcactgcattgaacacaaatagctccccttgctgcacaagtttcactgatgggggtaaagggggttatgaaatgtatcatgtgatcaaatctgtgatagtgatcccacagacaaatggagcatgtggggatgatttagacactcagccagccttgtcttgatggatacccatccttctctgctgctctctctttcctccatcctcaagcacagggagcttttggcgaggttagctaacttcggggcagctgtgaattagatactggctgtaagttacctccaacatccagagcatttaaacgctgggctgtcaatgattgtcattttcattgtttacacataatcacatcctcagtttgtggggtggatgcatttgattcaattcagatatgcctttcaagctggccctgctgagctgggcctgaaaggcacatggctcatctcatctgcatgtgacagtctctttgaagtccccagaagtgcctgctcagagtcatgctcgggagggaagaggtaaggcacagaatgagtacagactgccacccagccgcaggaaaggtgactgcacaccagaggttcctggtaaggaggtgactcacccgtgactgtctcacctgtccaaagtgtgtgtcacctgctctgtgttcacccactgggttcatcagaggggcacttgaacaaaacaggaatgtcactggagaggggaacaaatgctgtccccaagtccttccctgccgtttagagtaacacagcccctgtccgcacatcctcacccccatctgccctctgcttgccagaattatcagaatctctccattctaatttcagccattctctgtgaaaatgaaaagttagtggcaggcaatggacaccctattgaaatagaaattgttcttcatatgtcagaaaagtcccagagtaatctgggagtaatctgagcaaactgattcaaaggattattacaatttcttagtcttctactgctgcaaaagtggcactctttgattctcatgtttgaggttctaattgctacctcatgcaggacttacgagagatcagccatgctgcttacactgtgtgtagtgaatcaatgttattctgaagggcctcctggaagcagtagagattggagaatgtatgtcttttaacatgatcattcccatcctatgggggttgggcactcttaactcatgttgcagatgagtaaactgaggcttttgagagtttgagggtgcacagcttgaggcagaggtggaattcccagcttcatccaagaaaccacgaatctccaatggcttgcacacatccaggtttgctggatcctatttgccaagaccacatgcagattaggagccttcaaacaaattatttccaagggagggcatctttctctgtaacccctaccctggcaattctccatggcctcagggagtccagccggaagctctgcgatgagtcctggggaactctcatctggaaaaaggcgctcatgacaggtggtgccaaccttccacggatgcttttcagcatctcttgggatgaggatacagaatttctctttcaccctgtaaacgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcctttgcaaatacagtataagcaaaaaagaatgggcctttttcttttcttccttattttccacaaaatctatcaaaatgggtttttttttgttttgttttgtttgagacagggtctcactctgttgcccaggctggagtgcagtgacaccatcacggttcactgcagcctcgacctccccaggctcagttgatcctcccatctcagccttctgagttgctgggactacaagcatgcatcaccagacctggctaatttttctattttttgtagggacagggttttgctgtgttgcccaggctggtctcaatctcctggacacaagcaatctgcctgcctcagcctcataatgtattctttaatgttaaaccccttcttgtgttgagaggcctggcttgtgtgtttgagcgcagctgcctacctttgcagctgtaaatgtcagggctccaggagggctggctgggtctcccctcctcccctgttgggtgggtggggccctgagcttatccaggcaaccccaggggaagtgtggatggatgggtggatgggtaggccctggccttcagggaatgcactgtgtgtggtcttccagccccagcaaagtctcagggggccccagcgggaagtcgccatcctcagggggtccgagtggggagtcgccatcctcacggtcagccgtggtttcgaactgagctcccaggggcggagactccattcccccggggaacaatctgatagccagaaatgagagcagtgagtgacttggacgctgtgtgattcaggagggtcccagtccctcagagtcgcctggacaccagattgtatttacaaaacagatggatgaggaaatggagattggatcttcaaaagaattaacctcagattttatttatttattttaaaaattttaatttttcccaaggaccctttccaagtcaagaattgttttaaaaagaagcctggtgaaggcaaatgctgtctgtggccgaaggcaccgtgaggagctgaggctgacttatgtttctcctctgggctacgtgcgcctctaaggagttcacacactttaacccccttaggaaccctacatgatcatcctcgtttcttaaagaggaagcagagccagcaaacaagtgggggagccacagttccagcccaggtgtcactgggccctgcctgccccagccggctcctcaggagcacacggcaccccacgcgcgtgcaggggacagctgtcctcacaggaacagccctgggacctacaggacttcctggggtttaccctcagatcacccatgaggttagaatcacaaagcccgggagtcaggagacacagggcagctggagggaggtctttactgaggctactgaggcacagcagccccgtctagaggcctccctgagaggcacttcctgaggagtctggtggattttgagctgctttttaaacaaccttctccttagcatagacactgacactgaagggaaagaaagcaaatggtctgttcttagtgggaaggcaacttgctttcaggggaatgagtttggggaaagaggactggtagaagacacgactaagaaagtgagtaggagtccagacgtgtgtgattcatcctttagggcctctgtgtgtgatgggttgacttgtgtctcccaaaattcacatgtggacgtccttgcccctggcagctcagacgtgaccttatttggaaatagtgccattgccgatgtaattagttcaaatgaggtcatgctggagtcgggtgggcccctgatcccatatcactggtgtccttataagaaggggaaatttcaagacagacacacactcagggagtgcaccatgtgaagactggacttaaacagctacaccaccagaagccgagagagaggctggaacatagccttccctttggaggtagcctggcccagtgggcactgtgatctcagacttccagccttcagaactgtgagacaatattttattgtttaagccacttattttttggtactttcttacggcagccctagcagatgctaatccagcgtgcgtcctggcagaggttgaagggggctcctcaagtcccaggtccagcttggtgtggttcagctactcgagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgctaaaaagaaaaaaacaaaaagactcatttcatctttatatgggatgggatccgtgctctggtgggctacagagtgtgtctctgtgtgggtccctgtactccatgcgaggttggcggccgagccatggttcccatgtgagcaggacagtacagtctcacctcacacagagaacctcgcccgaacatggaactttcacccacattgccattttcccgctccctttccctcctttgaggttcacactcgtctcttcaaattaaaatttacaaagagaggagatggaggctcccaagtggccacaaagtcacattttatgtgagacctttttgcctcatttgctagttattgaacaaaggtgactctgaacctagcagaagcacgggttcaacacacagttcagaaaaacaggaaccatcaattcataagaacttaaagaaaaaaatagtttaaagaactgagaagttgccacattatagtgaaagaatgttgggttttggaaatgacaaaaacgagcaatcttcacctcgaaaatccggtggagtcagttacacaagacataaccgcacacaaacatggcatttctgataatataatggcatttacagtcaagaagcttctttcagagtatttcatggaaagttattttagtagcaagggtagccttaagcagtgagtattcgtcaagagagtgaaaccttgacttcaaagtcaagaggcggaggagtgaggactcagatctggaggcgacctgcagggcgggtgcccacgcacaggtgtcccagctgtggacatcccacgtgcacgggagtgggccaaagagcggcccatggatccctgcccacctcagaaatgtgagcaggcagctggggggcatttggactctaaccgggacaacctagtggccgggcaggggatgcaggcaccacaggtcacagtagtttgctacgagtgtcagcttttaaaattttaaataatcctcttattgtaaaattgaggacattatttgaagcaacgcaaaaaccatgtaaaaaaaatgtctgtaggatatgaatagcatgtttctttaaggcaatatctgaagaaaatataaaagccccaggtgaaagacaccctgggagcagaggtgcccctgagggtcggctgccccaggacagaggagggctctgctggtgcccaggtggcactgcctgtcttgatgccaggtgcaggggtttagaagaaaagacaaggaagaaaataaaactcaccaccgacattcctaccactagagttacccactgttcccaatcaggcatatttcctcccaatcctgtcctctctgtgtatttggtaattgcgtaaaccatctctcccataattaatctcctttaaaatttggaataatatagttgttagaataatataataatcatgcagaataatttagaataatgttgtttagaacaatttttgtagtcatgctaccttgcagtcattcataactcagaagaactctgcatttagaaggtctatttaaaatgtgccctctttgctgaagagttagttttatggtaaaaatccaataaaattgtagctaagcactgaaaaaaagtaaaggattaagctcagcctccagaaatactgattttatatatatttgctctggggaagattggtttaagaagacctattgctcttttataaattgcctccttatattttttgccctcttttcccctccctccctcctttattccctctgtctcttccctttcccctccctccctcccttcgttcctttcttccttctccttttcttccttttttttattgttgttctgggggaacttttctaatatcctggattttaagactttgatatatatgctgcaaatactttctctcaacctgtcttaactttctttactgtgtcgtttatattatggaactatttaacttttaagtagttattattttccttttaacacccaggttttgtcttgcttagaaagtctgttcctacccctagattcgaaaaatatcctcagatttttttcttctgatacttagtaattttatttttggtttaaaatgtcaagtcaagtagaacttatttttgtttataatttgaagtaagggagtttcattttaccctaaatgtgtagcaaattttcccagactatttattaagtcattcacttttttcctgctgaaattatgatatttaagttgataagttttatgtgttggggaggtgtcaaatgggcagtttccagttggaatgtgggattgggtagagctttgacacaacgtctgtgtctttccgtctcccatgtgacttcagggcaaagaggcagaggaatggagctcagagcttttagagaatatgggccagaaacaggaaggagtcaggacctgataacgggaaccagcggacagtgaacgcagtggagggccactggggccggagcagccgagagatttcaggaggtgagcttcagagagcctcggcataaatggatccagggtgtggtcagctcagggaaagacagacaaccagggctgagcacaggccaggccaggccaggcagggcccccggagaatcacgttttagtatctgcatattgagaaagtttgaccttgagtgtgaaatgtagacaagcaacccaaataaaaaataggcctgattggggccaaaaacaaaacagattgatgaaaataatctcaagagtaggaatggacacaacctacaagaaggagactgaacccaccaagtgtggcgcttgagtcaaatcaaacgattagaggctgccaagtcggcccaaaccccaagagcgtgggaatctgggagggcaccgagggctgggctgagagcctcttttcaaggaagtctttccaggatgctgtacttctgtcttgccaccttgcaggccttacagtgagaccatgaagtccctggcactctccctgtcggacccgtggccgatgttgatatctgctcggccggcctcacaggtgtgcgcgctgtgcagtcgcttagggcctcccctgcgcagaagggcctggcttggtttaatgccctgctgttaccatcttaaaattcttaatggcttttgaacaaaggccgcacatgttcattttgcaccgctttgtaattacataatttaaaactctgtgcttttctcttcctttttattaaaaacaagaatgtcagaaattgcccctttaaaactgtaaaacaagaaggcattaaactcttaatatttcaggtcaaatttgacactgtctctggacatgcaggtctgggtattggtgggccttagcccctttcctgctgagcccagaagatgcttctagtcacctagcataggtctctagggggcctctgccacaaggcagggccagcgccaaatgacatgcagttgcctttgatgaatgggactctccaccactgctttatgtaaacagcaggtcctgatatatgaaatgtggcttcaaagcaacttaaagaaatgaagggtcaaggatagaatatgtgatgagattctgataccatggagcctccagccccatggcttgctgtgcttgggctgtgttctctgtcctggaagggtccacagagagggcaggctgccagcaggaggcctgcctgctccaccagactgatgacacttattccacttggttcccagaactaagaggtcaggggccatgaaggactagttgcaggagaacactctgtcttaatttaaggcatgctctgtggagtggggctgttgggcagcctttccaatttatccacccatccctgggatctcttgggattgagaaactgagtttctccagggttcttctctcaccactcatatcctgcaaccttagggtcctccctgtactgggtatcagcctggtctcagcattcagggactcagagagaataatcagaggtgcatttctatcactgtgaggaccttaggctcaggccaataatgcaaagaagcaccctacctgggagaaacttactgtctagttgtaaagaaagcaccagggggccatgatgcccatcccacccatgttcccacccaaactctcctaaacccacagctcccaaacaagtcctggattgtacagatcaggctccagccaaggtgagctcactgaggtcagagcttacagaatctgggagctcaaccaacatgatggcttcagagatgaaatacccagcacatccagctgcagttgccccataaggagcagaaagtttgctatcacttcctctgtactgtttttatgttcaggtgacctgtgggtcagttgtttgtaatgtggtgatgcctgtaaagggagcactggaggtcagggggtgccagtgagtggaggagaccattataaatactgtgtccccaaagggtgtacagtcaaataaatatagcatgggaaaagccaggttgacccaagagaaacatctttttctaaaaatctgcaagacttctcagagcctttggtcgtgcattttaaatatccaaatatgtgttttgaaaatatgtgaaacagcataacatttgtggtatatgttaaatgtagatgatggtggaactttctgtttttttcttagagaatttcatgggaccaggcttccaaaaaacacaaatgttttgaggacaaaacatatgaatattgtagaagattagaagcaataaattactataggcagaagataagtgacattggattgaaatttttaaaatgggaaaataattacaaatggaggagtggcatggtcagaggcggagtgcaggtgcctgtggcacatctgggctcactggctcaggcaagctgcggtggagcaggaggctggggacatgtgtgtagagtcccaactgtcagatcacagtgttgggttgggtcttccacctgcaggggcgtgtgtgtgtgtgtgtgtgtgtgtgtgtgtgtgtctgtgtgtctgtgcacatgtgtgtgtgtgctgcttagagtttttgagcaaagtatggaatgatcaatgtgcagctttagaataatgacttggtgggaagaattgaagtgaagaaacactggagatttgtagccctcctagaagtcactttcagcatggatcttggtgtggcctggaaggaaaggacctggcttgtgggaggcagcagcagaatggacacatgagagccacaatcaagacagacgtggcagggtgaataactggctgaattgtgaaactctaggctgcccatattacactgacattttgagaattcagaacagatggcaacacctgggcccctgcctgtgcagatgggccagaaaaacgtgacacgtgtgaaggtgggcatggggtggcagcagtttctctcgcccaagcattaagagtgttacagagcagaactgttattacggaattggtgaagcacctctgggggactccccctccttcccccaagtatatgttggctaagtagccaccaataacaaatggagacacctgcatgctcctgcagccactgcagtgtggccagctcctctgctgggctatacacgtggagatcgtgtaagtgaccagggccaatgtctctggcagccatggagaaacaggcggcccagccaggccctttcactgcccgtgatggacagcttgccatcgctggtcaatagctgcactcccagatagtattaggtaatatataattaataaagaatattccagttgatctggttcttttaaaacaaggaaacttcttgctatttggtacccacaaattccactactccctgaattgtatgtcctgaaatctcacaaatttgcatgctgacattgttaataaaggaacaggagataatttaaacggccctgtggtttggaagtcacaggttctgctgcttcatgttcatgcacgagactaagagcctttgaagaagatcacttcctagaccaaggctttatgtttggattaaatgcagctcctccagatcatctcctgaggagattcagccagcctctgttctctctactatccccgtcttcttgcctcatcccatgcacacatttatatgtgttcacatttatgcatggacatgctctagtgtgccctctagtgcagacattttatgcatgaaactttaacccctcttgcatcaaggcatataagcagaagagatgagtggaaagattttagggcttggaagggcaaacgtgatagtcactgtacattataaagaacaccaaatgacagtgtgctttggaatatactactaggaatgtttctgctttgcaattagaaagtaatgacattgaaaggaagtgaaaaaaaatcacaggtatataattcagcgccgaattgatgaggacacagaggtgaactagaaaggcatcccagtggaaaccacttacagccatgccataaaagcaagatctaagcaatggggatataaaaaaggaagggaaattgatgaagatgacttggggtgacgtgacctggagtttagggagggacagggacttgccttggactcactatgggtgctcatgaaggaggcagcatttggacaaggccctgagaggcaggtgggtttggatgtgcagtggtggtccgggtgtgtggagcgggggtcagcatgtgcaaaggcatggaggtcagcaaaccaaggctgagagcacaagaggttcactgtgtgtcttccagctgcccagtgagcacatggaggtaaaggtgcacaactcggtaagcgacaggagtttgtgtggatcaggcctgctgtgacataaatatgcaaatgatgtggtccctcgtggtaccaccctcaggatgacacactcttctaccaaaacatggctgaaaatttttggtgtgtgggggtgtaccctgggagcccatttagaagctacagtgaaaagagccctcattgcttcagctttgagccatctgggccctcgcacctggctcatttcacctgacagtttctaaaacttctcacaaggaatttgtcggtttattacacatccatagaatgccctgaagagctattccaaaagaagagcttgaaagtcgaacgctaagcagaaaaacagtgacttccaaaccacagggtttgtttgaattatcaacttagtcctttattaacaacttcaaggtgcaaatttgtgagattccagacaggcagttcaatgagcagctggattttgctggttcccaagagcaaggaaaattcccttgttttaaagagccagatccatttggaatagtctttcttccccacatattacagcatgaacgtgactctaaagtacctgccgagggtctttctttttgtgacggtgggcgctgttccccactgtcgtggacttctcacagcgctcagtgtgcattcagttgcttctctccataacgcctctcagctaactgtgctgtttctgtgctcctgggttgttaatgttcaagtcttggctctataccattttccttatcatttaggattccactgggaagacatcactaagttgtgaaatcaaacttcatgagttggctgagatcatagggttgggtgtcctctgagcacttgcaggctgggggaagacagaaaacctggacaccttgcaattgtttgcaacaaagtggaaaaactaaagtagttttgatatgtgcattagtttgcttggactgctataacgaaatactacttggtggcttaaacaacagaaatttcttttcttacagtcctggaggctggaagtgcaaaaggaaggtgtcggcaagatcgtttttttctgagagctctctccttggcttgcagatggcagcttgctcctggcacagtcttttctctgtatgtgctcatgtctgtgtcctgatttccatttcctagtagggccagtcaaattggattagggcctaaagtaattatctcattttactttacttctttaaaggccatatgtccaaatacagtcacattctggggtgctagaggttaagatttcaacatatgaatttgcaggggacacatctccacccataacaatttgtttttcgtaatacgtttaaaatacccatttctgggctggacgcagtggctcatgcctataatcccagcactgtgggaggatcacttgagcccaggagtttgagaccagcctgggcaacatagccagactctatctataaaaaaaaatacacacacacacaaacttggccagatacagtggtgcacacctgtagtcctagctgcttgggggactgaggtgggagggtcgcttgagcccagaagtttgaggttacagtgagctatgatcatgccactgccctccagcctgggcaacaaagcaagactgtgttacttaaaaaataaaataaaacaaaaagacccacttccatttatttcacccatggataaattgtgcagcaagtggttaggtgaaatgtgaaatgtctggccaattattgtcatcatgctcaattatagagacacagtatgctcccctttgcattcttcattgctgattctgtgctttacatctggcagctacaaaaatttagtattttgctagcaggtgcatcaaatctatttttggtttcaaacaatacactttttgttttcaacgattctgaccagtagtcaacaattgcaagtatgtggaatgtgattctcctgctttgggaacaagggagctcccagttttgtgggcaggatccaacattcccatcataagggcagcctcacctgtctgtacctctgacacctcagtcagagcccttggagtcggctaggccagttttggccctccttactgagacctagtcattctgtagacatacttcattctcccaggcttgggcttctggttcaacctgtggctctgacattatcaccagaagatatccatctggcccaccttctgtggcttttttcccatgcacctttcagactaaattgtatacgctcatcctccaaagggttggctgtctttggtggtattttggcctgagttctgccttggatttatgttttttgttacatatatatatatatatatatatatatatatatatatatattttttttttttttttttctttttttttgagatggagtctcactctgttgcccaggctggagtacagtggtgtgatctagattcactgctacctctgcctcctgggttcaagcgattctcctgtctcagcctccagagtagctgggattacaggcatgcaccgtcatgcctggctaatttttgtattttcagtagagacggggtttcaccatgttggccaggttggtctcgaactcctgatctcaggcgatccactcgcctaggcctcccaaagtgctgggattacaggcgtgagcctaccgcgcccagccttatttcataatttttgatcgtaattccacccacatgttctattcatgtgaaatttactaaggtgagaccaagtggagataaaaactatctaaacgaaaaacttaggtctctctttcagacttttttttggttttatggtggtaaatacaacccacttggcctttcccctgagactactggttcttttgtcactggagtcccagagatcagggtttgaactagcctaccacttactggtcatgtaactttgggcaattcagtttgcatccctaagcctcaatgtcttcatctgtaggatggaggtaaccataatgcctgtctcagaggctgctgctagtgttaactgtgggacacaacacagagtaaggcacagacgaggtgtgcagaaaacatcagcttcgtggttttttactcttctgcacttgctgtagcattctgcaaagctattattcctttcctagactcacgcccaaagttacggaggacccagcaaccatctcctgcagcccctgaaaacctcttgactcttctgtgatgtccccagtgatccagcagccccggccttcttttgatggcttgaacatttggtcttcattgaacagtttgtatattggaaacttgccagcctccatccacattccaacctccgtctgcatccctcggtacaaaatggttcaatctgtctacctcctttcacattccaccaagatattccaaggtccagggttcctttgaccacctcacacctaacaagttccctcactgtctctcactctcccctgaagattctaagctgcctctgtcctgctaaaactgtagacctgagaatgaagtaaggtgcttcaggtgaggtttgatcagcccagagcagaaaggggccacctcctcccaccctataagaccctattagtgcaccttggagccctttgcttggctggtggctacaatacacttctgttaatgacggaattccataacatttttccccattaatttctgctacaaaacacaaaagtcttagccaggtgtggtggtgcacacctgttgtcccagctactcaggagtctgaggtgagaggatcactgagcctgggaggcagaggttacagtgagccaagatggcgccgttgtactccaagctgggtgacagagggagaccctgtctcaaaaacaaaaaacaaaacaaaacaaaaaaacaaaccaaatacacacacacacacacacacacacacatacacacacacacataaaagtctcatattttacacttatgaagttaggtgggtttttttttgtttgtttctttgttttgttttgttttgttttgttttgtacccaaaagtacataacctactactacctacctttttggttttttttttttttttgagatggagtcttgctctgtcacccaggctggagtgcaatggtgctatctcagcttactgcaacctctgcctcccaggttcaagcgattctcctgcctcagcctcccgagtagctgggattacaggcacctgtcaccacacctggctagttttgtatttttagtagagacaggatttcaccatgttggccaggctgattttgaactcctgacctcagatgatccacccgcctcagcctcccaaagtgctgggattacaggtgtgagccactgcgcccggcccctttcctaaggttttctaaagcatgtttgtggcaatctatcttagaatcttgtcaaaggtaaatacaaggttcagggtttacggagccaccttctagccctttaagccaccagaattgctggtgtcttatggactcctgagaagtttgtggtggtgattcttagagctcagctcccaactgctggactgccggtcactgggcagaaacagaactcagttctcatcacctggatgccatttcatactctccaccctctcctgggcttcagttgccccacacaatgtcagtctctttgtgatggttagttttatgtgccaactttgctagggcatggtacccagatatttggtcaaacattatcctggatgtttctgtgaaggcactttttagcagattaacatttaaatcagtagattttggcaaagcagagtcataatgtgggtgggcctcatccagtcagttgaaggccttaatagaaaatgatgggctgggcgcggtggctcacgcctgtaatcccagtgctttgggaggctgaggcaggcggatcatgaggtcaggagattgagaccttcctgactaacatggtgaaaccctgtctctactaaaaatacaaaaaattagccaggtatggtggcaggcgcctgtagtcccagctactctggaggctgaggcaggagaatggcgtgaacccgggaggcggagcttgcagtgagctgagatggcaccactgcactccagcctgggtgacagagtgagactccgtctcaaaaaaaaaaaaaaaaaaagaaaagaaaatgacgaacctccccaaagaagattggattctgtcagctgacccaaactgcaacagggactcctggggtctctgcctgccagcctgccctgtggattttggacttgccagcccttaccattgtgggaacctaatccttaaacaactcaatctccactaccctcctcgcccttctctctctctctctctcacacacacacccacccacccaccccccccccccccacacacacacatccaattgattctgtttctttggagaactctgactaacacagtctccttctcagtattaatatttttttcttggacagaaaatgtagataaaatagaagtctagaagttctgttttctctcacgaccaaattcttctatttctcttttaacccattcagatttgtgagtcccggagcgtgctttgccagggctctgttgagttccacagtgcattgagcaccactatgtgggaggcactggctcccaacaggcagcaggcaccttttccctaatgaactgtctttccaggtttcactcaagccctttctatcagacttctaccatgcagctctgccaatgtctttaagcatctctcccttcttcctgactgtcctgaccaagaaactccctaatctctaatatctaaagtcatgaagccaattgcatcattagatgtgcagtatatataaataacatttacttacaagaatatttttatagaaatgtatgtaaacatacttacatacgtttctataaatacatttaaattcctaaagacttgtttgagcaatttaaaaaaaaaatgctccagtttaacttcctactacaattaggaatttggggcagggtgcataattgccagtgtactcacagtgactgcaattagaatgtactgtggagtcagaggaactgcctgacagtgccgggcagttgaccctgggctgggttcagagctctccagtggccactgagaagtaggagagtgtttcctgcacaatcctgatttcttgggggaggaggtactattgcacgctgctgggtggagcctctgaaactctcctgggccaggtctcctcccgtgcttcctctccctgaggcagcctcacctcttgacgcctgtccccagcacacccttctgtagctttcctctgactcacccctctgtgtgtctttctctccaacttggggtcctgtcacctaggcctctctcctttttcctaggtggctggcagttgctcttcccttggttttctctaatttgatctctttcccacccttccagtctgccacagtcacccttgacatccgcagaatccaccctccttggaagggatgaggaaggcggtttatataactcaatttcatttgtaatgtttcaaatggtattttttttctgggaataattggcgctggattctgaactatctttcctgttgcaaagaatgaaatcccttctaggtgatggggcttgatctttctctgttgcaatagcagcgatgtccaaaacaatcaatcagaggcattttctaccgtacctgagccattcagtggtttcgacctctgctccagattacccagggttattcagatgggttaatgcgagtccttagaatggtgtttcccaccttgagagtgggttgttggctaggtgtgtgggggagctgtttgtctacacctcagaaacgctcacaacagcaggttccagggaaagtccctgggtgtccagtaaaagctgggtcgccctccctagggggctctgagactagcagaactgatggccccataatttgagcacaggtatgcatatttcataggggttggtgggcagactcattcatgttcccatcccaggggtgcaggggacccttctcccttccccacatcagcccagggctacagaagctcctcaggaggcaaggaagggaatggagaggacaagagtgcctacagagtgggaaggagacaaggattctcaggtatttatccagggtaagggcaagggcttttctgcagtccaggacattagaagagtcctgaaccaagaactccacccctgccccgatatcagctgtttttactgactgagctgttggagaacagttttggtgtgcggaaacagtgagatccctaaccctacacccctgaacccagcagatatatccacactgaccagaaaggactggctaaccacaagcctgcctgtgcatggcagggaaaggaaagccattcttgagtaaatggtgttcaaaggttgggcaatatatgtgtatggtgttctcctgtggacataattgtgcacaagggtcagaagaaattgctttcattgggcaagctacttaacctgtctaaagctttgtttttttatgatctgtaaatgaagacagatcctatctcatggctctgcacgtcacacagcgatagcagacaggtaattaggatgcaggtagttagcagacagccagggtatactttagctgttcaagtttcctcaacctggcctcctagccatgacctttcacagaggtgcaaatcatctatgagtttgcacagaatcccctgcaaggaaatatgttcttgttcttgacttacatttgagttggttggtcttacagttaaggcggaggtcatcactcttaataaaggccattttaagtggagtgacaagtcactaagggacttgttggcattgtttacttcttatccagggctttccaagaagggacagtgtgtctgagtttttatcttatgaaggtttcccacctgcagtttagtttactattattttaagggctgtttataaatgaactagcttgtctttgcactcagggtaattcacagatttgtcagtgacttcattgcagctgtgagctttacacgaaccttgcaatccgccttgaaaaatgaaactgagtataagtggggaccaaggaagaatgtttttgagggaaatagaaattaccatcctaaaaatggttccttctgtgtgtctgctgatagaaacccttgacctctttagaaacaaccgcaaaattattcactacgattatctgaatctcataaataaaataatgattacagctgcatggaattattcaggtctaaattcatataaacatatccctaatgaatttatttatcatgacaggaaaggaaagcatagctttgtgcaccccatcccacaccctccaccccctacaaattttactaacactgtttctgggttcagaatttttttgcctgagttggtacctcaaatcacttgagttaaactgcaaatgaatcacacataatgcagataaaatgacttcatgccctaatttctagaacgtgacctgaatgtgaactagacattcgttttcctaaaccccatgagacccaggtattcttgacatgtgtagcgaggattgaaggggcccgaggctgtctgtccactctccgtgggcctggctctccttggaccaaatcgaatgcatgggaacacaccccccagttgtctttttccttcggtttatataattcctggcatgtgcctttcaacactccgtttatgttagaagtttggtattagcctcggggctttactcttgacactgctactaattctctactttatattcgtgattgcccttctgaaaggagaatcttgtttcaaaattgcacctgggcattttaaagtaaataggatgcaaatccttagttggcctcttgtgtacattaacttcagagtgaagaatgaatatgtaagccagtgatgggggatggggagttgagcaaggaaaataatttgcataatggtgtttgctccctggtgaaactgaaacccagcctgtgtgggtggggccttgtttccaaacgtcagcgctgctgcccacgaaggcctgcaccaacgcacggtgccctccgggccgcccacagaggccggcgtctggccaggagcaggggctggggacagcaagtgtgaaaccagctgaagcacctgcagctcaggcgggctgcaggctccctgctctccccctgtgaagaagcacacattgttctttcttcccgcacatttgaatctctcagtggggtctcattttctgtgacatggcaaacttcaaaaaatgggagtaaatcatttctaaagagcttagctaggcatggtggctcacgcctgtaatcccagcactttggaaggtcgaagtgggatgattgcttgagcccagaagtttgagaccggcctgggcaacatagtgagacctcatctccacgcacacacatgcgcgtacacacacacgcgcgcgcatgtgtgtgcacacacacacaaattagccaggtgtggtggcatggtaattccagctactctgggggctgaggttgggaggatggtttaagccagggaggtcgaggttgcagtgagctgtgatggcactgctgccctccagcctgggtgacacagtgagatcttatctcaaaaaaaataaaaaaatcaaaaataaagagctcctgatttccatcccccaccgagaatcattttctgagtcagctggagtgtttcagagcccaacacccaaggagcagtgcagggatggtgcccagttacaggggacagctcagctctgaatgttacaaagggcacttcatggaccaccaccttttctctgcttgctctgtacccctaaagtactacaaggcatttttggttaataataatttgaatactatgtgatcttgtagattctactgcgtttggctagctaatgtctctaagtagcaagatgatttattttttctggacaataccaggactatatgctgatacaggactggcttgctctaaggatcagattttccagtgtaaaatatatactccttatagggttgtaagagcagaagcccgtcatagcctgtttctttttgctctctcttcagccagcagttggcctggatctttgctggtagacacagggaatgttctccttgatgagtggttcccaccctggcagcctcagatcccaccatgttggcagggatgctgaaatccacctgcctatcagcctttgtaaataacaaaaatcacaagtggctctagcatttatgtattctatgatattgggactcttgtgatataaataatacaaatgcttttacatgcataattcaatttatactatgttttatctttaattaccggataataaaaacataactactctcaggaagtgtgagggatggtgactcaggctaaggtgagcctcacagcctggaggctggctttagtgctggctgggagagctgcaaggagatggcatatgctgccgatgaaggtgttctccaggaattttcagttagaagttttgatcattgttcatttggcctcaggatgaacatcatggtactgcttttcattctctataattaatatacttttcacagtcaactttgcatttgaaagtatttattttatgggaaacagtgaaaagtagataattagcacatgtgcaaatctgtttggcatttgtggggtgtttgccctgaaaacctatggatgaagcccaaagacaggagctggggggtttcatttagttaacttaaaagttttaattggtctgtgttactcttcttgttacatatttttttaaggccctaaggtgagcaagttacattttaaaataaggaggaaaagccagttttaaaagtagaattgagtcattgcatgtgtttttttttcccacaaacattagctgtgtgattattatgtcccaggcacctaaggaatagtgcccttgtcctggggaagttcacagtttggaaggggagatagttgggaaaggtaatgtgaatattaacactcgtgtttcctgggggccaaaaagttccagcttctgggccaggttaattatctgaattatcttatttcatccttacattgggaaccagatgcccccaatgcccttcagtgacttttttggtggctttgaggaaaaatgaggcccagagaggttatgtaacttgtccaaagtcacacagcaggtagacttaaagtcaaacagttagctcccaatgtgcacactcttaattaccatgccactaaaccagactctgaacaaagcactctgggagcacagagaagacctctgagggtctgtctgtgtgagtctagggcatgttcaaagttaagagctgatgtttagctcagcaggaaagggctggggcacagtgttgaatacacatatcaggtggcatttattgctgatgacagtaaaagaaaagtgtaaaacaagataatttgtttacatttcaagatacgttaagttttttttttttttttttgagataagagtcttgctcggttgcccaggctggagtgcagtggtgcaatctcagctcactgcaacctccgcctctcgggttcaagcgattctcgtgcctcagcctcccgaatagctgggactacaggcgtgtaccaccacgcctggctaatttttgtatttttagtagagatggggttttaccatatcggtcagtctggtcttgaactcctggcctcaagtgatccacccacctcggtctcccaaagtgctgggattacaggcgtgagccactgtgcccggcctcaagatgcattaagttttaaaggcccctggttatttctcgtcttctgagatgtcattccagtgtgacatggttaacatcagtgaggatggcattcctgtcccacacagtaaaatgtcacctctcacacacataactctgggcgtaaagtgagtaaaaatatgagacttagaagaatatttcatcatggtatgctgattggggatttcacttactgatactagaaaggttttgcatttcagaacacgatgaaataggtaatatttatctgaaagacgcagacaagtggtggaggaaccagacacccccagtgccgtttgctggcttttatcagacagaaagcagaaaggagaaacatgttttatcccatgagaaggaaatattggcttgatgtctaccatgcccagccttgcactagacatccaggtagctgctccatggagaagttcacagggtggtcaggatagcacagggaggaggtgatacgcttgagggaagtccaggagggactcagggagtgtaagccagtaggggggtgctcctgagaaagggaatgaggctgtgccttgaaagactgattagatagaggaggaagtgaagcatcagaggctgcccaacagaggcaggagctggggctggggtgggcaaggagaaaatcacgccgtcctcctgtgtgaacagtagagtttcatctgctgagggcagaggccatgttttatccatctctgtccccttctatgtccctttttctcctcccttccccattccctggcatcatattgggacttgttaagggctgaattgtgtcccatcccaaatttgtatggtgccaccccaactccagtaccttggaatgtgaccgtatttggagaaagggtctctgaagaggtaattaaggtaaaatgaggtcatatgggtggcctctaattcaatatgactggtgtccttataaaaggagattaagagcacaccaacatggcacacgtatacatatgtaacaaacctgcacattgtgcacatgtaccctagaacttaaagtataataaaagaaaaagaaaaaaaaaggagattaggatatagacatacacagagggaagacccacgtgacaacatagcaagtaggtggtcatctacaagccaaggagagagggaggcctcagaagaaaccaccctgccaacaacttggtctcagacttccagccatcagagctgtgagacaatacatttctgttgtcagtctctaatactttgttatagtagctcaagcaaactaataatccagtgctcaacatatttttgttgaataaaagcacaaagagattcatgagaagagggaaatgttgcatacttagggtaggagcaaaccacagaggtctttctcagcctgggcaaagaatgtcaactctgtgttggagccagtagggagctctgtgggtcctcgagcaggaaaatcccatggcttaagcagtgtttcaggaagactgggatgttaggctccagagctctgagcaagtcagatgggactgggagtcataagaaggcttgactgtggctagtgataaccaatgagcactggaaacatggaggggaatctttcctcccttttatatcagggttctctcctagaggagcaggtgaggacctctgatggaccaggaaattggaattctgcctgggaggcaagcccatggaggccctgatctgcttggacagagagtagctcccttcacctgtaaaatgagagtgaacgagctggtgtctaaggaattcagaatcccccccctggagttccacagggtatgtgggattttagggggaccagggtgtccccagtgcaagaaggaggctcccaccaaggggctgcagcactgcagataacccccaggggtatgaaaagaggctgaactgggggcctccacagtcagaatccatccattgacccaggatgccaggaacggggaggcccatgggcagcagaggctcaacgaactccgtggcctgacttggccactaggttttttcagctcttcagccactgcctgtaggaggctagctggcattccttccttggcccttagcttgcatggatgggggtttcacgttaaattctaagcccaataacatggctctttttatttaaactcagtgctgcacaatgatgaatgaatgaatgaaagatcagggcagatgaactgtcaaacctcagcagttgcccttatagttagaggtgtttctgtgaagcaaatcaaagcttatagtatcaagaactttttaaaaaagtacactttgatccaagttggatgttatttctaagtgtactcagggtgaacacctcttaaaaccccttattatgtatgctgagctattctgaacctcagtgagaaatcagtaatgtcaagaaacctatacataattatttgttataatataaaaatccagagctcttcaagcattattctatcctagttggtcagattctgcaggaaagaacactgagcctgaagcaaaataaattccttgagttaaagaaatttgtgtcttgtaaaaaagctgaatgagaaataacgttaaaaatggaaggaggcctaatgatgatattatgccatctcttgtcattacttagtcctctgttgtttcagtcatttaatctggttttctttctggatgctttaacttccattttaatattccttataattgttgtgcaattataaaagacaatctgagggacccgccttgacagcctggggtagtatcactgggagtaggatctctcagaatgctaaggagcagatgcactaagagagctgcatttcactccattttattggatcttttggtatatacgtttctgtgactttagttcaatgggatggactgttgcataatactgagggcgatatgaaggaggagtcgtctacacttgtaaaaaccttcttctttaggggtgggtagtatataattgcaaaggcatttctgatttaattaagagttgtttggttggccgggcgtggtggctcacgcttgtaatcccagcactttgggaggctgaggtgggaggatcatgaggtcaggagatcgagaccatcctggctaacacggtgaaaccccgtctctactaaaaatacaaaaaattagccaggcgtggtgttgggggcctgtagtcccagctactcgggaggctgaggcaggagaatggcgtgaacccgggaggcggagcttgcagcgagcccagatcgcgccaccgcactccagcctgggtgacagagcgagaccccgtctcagaaaaaaaaaaaaaaaaaaaaaaaaagagttttttggttacaagtgacggaaaactcaattcaaagtggtttaagcaaaatccagagttttaccatctcatgtaagtgaacaatctaggaaaagggcgtcatacatacagctcaaaatggagtcgagatatttcagatctgtcttctcctcctggcccagtttttaatgctttgaccccattctcaaataaactcaaccctcatgatctcgaggtggctgccatttgtcctttcaggtccaaatccagcaggaaaaacttttgtcacagcattcctgtaaaaggtatgaggttcgccctgattggaccagccgaggtcacatgcctacacatgagccaatcacagtggataaaggactgtgatgtactcattaatttacccgccattatctccactcctgtcctgagggtggagttatgaagcttgctaatggggcactaggatgtccactaggttttactcagtgacataggtgacccactaaatttaagcatattggtgtgcaaaggaggcatttgttgacttgcaagtagacacctctcacttatttgtcacactcgctcttccttttgtaagcttcctgggagagggatctcagtggctttcaagatcaccccttgcaaattaggcatcatgcccatcactccatcccctgtgtgagatggcggcagaacagttcctattcagacacctgccctcatgcctgttcccccgtcctcccagcagccccagctcctggttcccagcatctagctccttccttatcagcacagggagttgctttttgtttgtttgtgtttgagaaagacttcttatttcgtgcatgcacatttcctttctgtgaagcagactcgggagctttgcctttctgacttattctgtgcatcctatcagtgaagtcagtgagtggcttcaaaaatgcttgctttctttctttttcttttcttttctttttttttttttttttttttgagacggagtttcgctcttgttgccctggctggaatgcagtggtgcgacctcggctcaccacaacctccgcctcccgtgttcaagcgattctcttgcctcagcctaccaagtagctgggactacaggcgtccgccaccacacccggctaatttttttttgtatttttagtagagacggggtttcactgtgttagccaggatggtctcgatctcctgacctcgtgatccacctgcctcagcctcccgaagtgctgggattacaggtgtgagccactgctcccggccccaaaatactttctgatgctgataaaatgttttgtctactctaatgcccaaggaacagttcctcccttagcagaagttagtggttaaagcttcctctatgtttgccagtcaagaatgccacagggcaccagcctaagtgtccatgagtggatgagtggataaagaaatgcagcacacacacgtatatacacaatggaatactattcagcttttaaaatgaggaaatcctgacatttgcaacaacatggatgaacctggaggacattatgttaagtgaaataaattaggcacagaaagacaaacaacacatgatctcacttatacgtgatatagaaaaaagttgaacttacagaagtagagagtcgaatggtggttaccaggcattggcaggggtagggtaatggggagatattgttcaaaggatacaaaagttcagatagataggcgaaataaacttaagagatctactgtacaacatgtgactctagttaatagcaatgtattgtattctgaaattattgagagtaaattttaattgtcttcaccataaaagataagtatatgtgaattagctcaattgagccattccttaatgcttatttccaaacatcatgttacacagtaaatgtaatagagtttttgtcaattaaaaaaattaccaaaaaataaaaaatgaattccatagagacgttctctccaggaagggtccccttcctagatctgactactggttagggttaatcaatgccccttggcaaaacaaaaccaaccccacatttcttcatctcccatgtccaagacacatgcagtgagttctcagtgtttactaccagcacacaaatgatggctgctttattatttggtgacctttgttgtttgttgtgattgttctgttcagttttagtccctcacagcactttcagccatttagaaagacagtatttgttctgctagagcatttgcaatctgtttctgattagcttaactggtcttgaccagtgctaagttcacatttcagctttgatttatgctgtctctatctgcagatatgtttcttgttacgctaaacaagaggaggcctcttcttactgacttcttattttcatgtgaacgaggtaataggtatcaggaataattagacaaggccatacgtgctagtgtcataggagactgagatatggagagtaaataataacaaaattcctgattactagggcatagaaaaaaaatcttaggcaattccccaagttgataatcccaaatgtctaggtgtccttctcaaatagggaaacatgacattaaaactactcaaaataaatgagactcagtggtatttataaccatagataaaaaagagcaagggtcctagggaactgtgccaaggcccagccctttgattcacaagtatccacaaaaacagactgtacgggctgctttcaggagaaaatgtggccatcaaggtcaacactggaagccctatggccactcattcattccatctcattggccctgagcctttcgaaaagtaggcagagaagaagcccaaagaacaacatggcaggcaggttaaggaagaaaagcagagttcacagacatcactaacaatttcgtaatgacctcatgacttcgctggaaggattccagtggaggcgtcaccagccctttgtccacctcttaggctgagaacctcaaaggttgcccacaccttgaccacatactttcttccttttcttacacaatcaagctctgcaccaaacattagggggacatttgcattttcattatattcatgcgtatttctagcaaaataccaattcttactgataagatgttgacttgtacagtgtggcaaggaatactgtcatacagttgtgccgaaaacaagcccatttacttatttttttaaaaattaattatatataattcttataaaataacaaattccatttatttcctcttgatctctgtcatcagagacatttgaaggtcggaggtgggttcaattgaaagacataatgcacttgacaagttgttgtatgtgtgcattgtgaataggccttaacagtgcattcatttgttttattttctcccatttatacagacttttgttctgctcttagataaaatactaataaacaggaagttgaaaaaaaaatgtggtgcaattgttctgaatgttgtttttcttgcaaggctttatgggccacaccacaccatcctattcaaagcagtccctgtaggtggtggtgttaataaagaaatgaggctgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgaatgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctcttttttaaaaggaatgactttaataaccatagcaacacttactcagttttgtgatccactccaagattatgggagcaagaacagatactcctgaaagcaaccctcacctcctcccccgccccctgccctcagcaagtcctggcctgtgtgaactgaagggtttggaagctctggtttctaggagtgcccagaagctagaaagactagggtgtactagttattgaggggcagttgtcagtggcagtgtgggggcaccccagttgttattcgaggcactgcattgcttttttgtctcctctgtaagcatcctgcctcagtgtcagggcttgcagaactaggcctggagttatgccccctacccaaccaaggctttgccttttgccccccactatggtgccacctacttgggtttcccacagttggtagtgccaggcaggaagcaggagtgcaggttgcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagatggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgtcaaaaaaaaaaaaaaaaaaaaaaagggagagagtaaacaaatctctcctctgttattctgcacctggagaaaagtaaaccccttgggcataataggctgtcaccaattagacatccgggaaaggcttttctgggtttagcccttttggggaagcatgggggtagatgtaagtgtgtgaaccttcacccaagttctggagaaggattccagagtgaaagaggtttccatgctgagtcttgcatttaagggaccttccatggcgtagctgcaaagaaacctgaattgcccaggattaaccacctttcctttagacggtgagcagtgtgtttcatgaacacattacacattttagggttgtctatggaggtatcggcactctcattactatttttaacattttattctctgttcagggttaagaacttcacccacctaagtcagctcctgatacaacatggaatgttccagcaatgaaatgtgaacttaagatatttggattaaaaccccaaagttgagtcaggtttaaatattctgcaagaagcagtgagctccttttgtctatttgggcacagttttcgtgaattatttaggcttttcttagatgcctgagctccgtggttagacagcagataagttatttttccctttaatgctgaggcattttcactgatttcagtcttactcattagaaaattctgtgctcacccacagctgccagggtttctagaacacaacaccctaccttctcctgtagacattttagtccgtcctcgctcctgcactgtggctttcacagtcaaatgtgagttgaccagccgtcatttgtgagctgtgagtggtatttttggaacttgcccacccccattcccccagagtcctgtggaggtcatgctcatgggttctgccaccgggacaggaaagtttggacattactaccaaaaaaatgcaacgtgactaagcaccgtttaaaatagcctttcttattctcttgtaaaattgcagggatttccatgacagatgtcgttttagtcattttaaaacttcagcgcgctgagcctcatcagcatatttttatttttgacatttcatattttagagtggattgaaaactaatttgatccgtttcaatttggaacatccctcaaggtcattttaccagcatttaggccagtgttgatcttgctttcattttaaacatagttattttctctctgtgaagtgattactccttgcttggtgtgtggtctggtgacttgttaatttcaaaattctacgatgcaagcgggtttggacgtggagcctggcccggtgtggccaggctgtggctttgcccatcgcaacggctgcctttgcctcaaatggctcgaggctggcacctggtcaatatttgcttttgtccaaaagaaggaaacagtagaggacttgggtggtgtaattttagaactttactgttgggttgttggcttgaaagatccattctcttctgtaaatacagatacatatttactcctccaacctttccctccacacaattaagaaaccctacaattaattatgccaaatcaagatttgcttttctacatgattttttcccttttccctaggaagtctgtaatgaattttcttctttattgtaatattttatgtttttatatacacttgtatattcttatagcacatatatgtatatatgcaaactttctgaggcttctaaaaaagagaaataatattggttgattaacctcaatttcttttcaatatcaaatgtgtaacaataaccccaaaaggagaggtttcagaaattaaaacaagttgacatttgcccacttctgaattaaaatgcagcatttgacttttgtactgttttggctgtcaagccttagttttttcacactatcaggtattttcagatcaaaggtaaatatgatttagaattatatttcaaattagaactgtcatatgcccacacatacattttgctgatatacttacaaactggtaaacaatgctctttaatcaacaattcataatctgggtcagcgatttttatctccatatttgctcatactgtatgacatcaatattttatattggcttgcccataacttaatattttataaaagcctacctatgaaattcatatttcatatttgcttggctaggaaattaatttttgtgatgctgcagttcaccttgtagcatacaaattgagaaaattagcaagctgcatgtagttccttgctgtacaaaaacaaatgacacatggtgtctttatcacttgttttgtatttacagataaattttaaaaataaaacttgccatttctgttaacgtggaaaactccccaccccactcccattcttgttgactcttttttatttttaaacagcaaatacataatcaacttcagtcatctcattttcaggggaattactcattgtattttctacttacagtcaccggggctgatgttgggatctgtgatcagtttcctgttgttacgcatagcttttctcagcggtgagagagacatcatgtacagagtacacacggagggttgagatagcagcctggtttatcttacttctgatatgacttttaaaatattgattttaaaagtgtgtctttgagtgtaccaaaatagtatgtccctgatgcttctcactggatgcaatccctgcgcaaatgctttctatgtaattagattttggggctcagcttccattttttaaatctgtgaaagcattgatcatgccagcggccctggagagggccactctgttttagtgccatttacatgtatcaggacaggacagaaaagggacagcatattacaaacaaaataaaactataatcttgttcaatccttgtcatgctgaggatgtttgtaaatataaaaaaaattgtatggattccacttacatgagataactggaagggttagattcatagagaaagaaattagagcagtggttactagtggctggaggcaaggggggggaatgaggagttattgtttaatggggacagagtttctgtctgggaagatgaaaaagctctggagatggatggtggtgatagctacagcacagtgagtgtacttaataccactgaagagtacacttaaaaaatggttaaaatagtaaattttatgctatgcctattttagcacaataaaagaatacacattcatggaaacagggcatttaaatcattatgcataataaagtgagaaggtagttgtgatttgcaaaaaattatagaaattatagggagaaacacaatctcaagagccaccctggagtccagagctctcgttttacagattcaggagtggaggctcaaagaatatatgctttcttaatgactggaacccagacggcaggacccccacacagggctccttgctgaccctttgctgccttcccccctcccttagaggggccattctttattctgagtaaacgtgccactgattagatgggcttcatgataaagacctgcagtaaggacgttttaatcttttaatctagacggttcacgagttccactggtgtgtctctgggggcaggctcccagatcacagactggttccaccgtgccccgtgacctcagcgtgccattagatgggaggccgttatttcagggaaaaaatcatgtttgaaactaagtgggtccccggcagtttgcagcaacactggctgctcaaaaggacagcacgaggcttttcacagcatgtagatgccatggctttatgagagctttgagcttgggagggtctacttgtgcttttgcaaccttagtttagatttcatttgcatctactatttgtaagtgcaccatttttctaagggaagtatgtatgtgagaattatctacatgatttttgtaggtggctcacaaaacaaatgtcagtagccattctatggccttggagtatcatttcccacaccttttctatgggctgtctttatttttgactctaatacgtatcccttatcatacaaaaagttcttgagcatatttgatatattttaaaacttccaccccagtggaattaacactaattatatttaattccacacaaacttttgtcccagttgtagaccatttacctacttcctgacagcaaacactacaccgctgtgaaattttattttaacacatttgtgcccattttcagcattaataatcgtgtgtggaagtggcagcaaaatgaagatatcgcctgagcatggaaccacaaatgcctgaacgtgtgatggcatttgtgaaacaaaagcatgacatactttttctttccaaatgaggcagtgccacaactaaaaaagccagttcgcctttcgctttctaaaatcatcttgctggagagaacggttatcaaatcccatccactgcccatgtaaaataaataccattcagaaaagcgtggcatggatggccatacttctgatgggtttataactgtagattgcatacgatcccaacgtgaagcctgaaatacgacattcaacgtcaggcttattccaggctactgctgtggctacttttgtaattcaaccagtggggcgttttaggctaacgtatattgcctctaagctgataagcattttcctgatcccaggccccttctaaaattgaacacacacgttcagctggggacacctagatggaaggaagggaaagaggagaacccgaagtgaaggaaaagtcaccaagaacagtttcgtggaaaaaaaaaaaaaactctcaagaattaagaatgttgagttgcttgaatggagcttgggcaggaaaaagaccataactctcacacacgtgaaggttactgatacccaggaggtaaaagaagtatttaacatgctctaaagaagggtaaccagagtaatggggcgaaaccaagggaggacgtcctggaatgtaatattagaaataaacttccaaacagggaagtgtccatccgagtgtgaaatgggtttatcagaaacaagctgcatgccagtttcattgacattgcaaagaaggttagaataaaaagctaatgaacagaaagaagaaagaggcaaacagggtgtgtgttgagagtggtggaatatgaaggatggtgcatttgtccaggctggggctgctggcctgaggaatggtggtggagtttttttacagagcatcttctgagcaccaggagagtcccggaagctgagtttgacactagcaagacctgccctgaattggggactgctggatgcctggaagctcccctacacttacgttcctgaagttgggctttttatcaccttaggactatggcttcccaaacttggcagtcagcgtcccggcaaaagcctctctattactgcgaggtagtgtttatggagtcacagctaagaattacagagaaaatcataataggtgaatcttttttttttaaaaaaaacaacattttttgactttgcaaataaattgcagaattatcaccattgttgaaatattttccattaaaactagagtttattaaaagtgcctggaaggatgccccctgctgcctccctgagtcatcgctttggatttgttcttcagaggcatagatttatttccatagcaggggttttcagttttgtgcttacagtcccgcagtaagtcttactggcttcatcttctgacctgcttttaaaacagtcctccaccgtgctaggtacacaaagggatactttttgggtttttttgagacagagtctcgctctgtcacccgggctggagtgcagtggtgtgatctcagctcactgcaacttctgcctcccgggttcaaacaattctagtgcctcagtctcccgagtagctaggactacaggtacgcatcaccacacctgaataattttttttttttgtatttttggtagaaacagggttttgccatgttggccagactggtctcaaactcctgacctcaggtgatctgcctgtctcggcctcccagagtgctgggattataggcgtgaaccactgtgctgggcccaaagtgaaactattataacaaggtaagagcaacttttcccagagttaaaggatggtgctccatggaatagtgaaagtctgggaccaaagcaccttttccctttaatttctccaattgcttttaaaatattctatgcaataagcatctgagtccaaagggaggctgtgtcttcctctagggtctctctgaatgaggtcagtttctatgttaacttttacgcttccttttttgtctcatcccaaaccatttctcctcttgtcatcctctttttcctcctccttttccttcttatttctcctgttgccttttttctacctttttattttttgccaatatacataaaattgcttgttaaaaaaagatcaaagacagcatttttatatttttttcttaaaaaacaatatgaagggctgggcacggtggctcatgcctgtaatcccagcactttgggaggccaaggtgggcggatcatgagctcaggggttcaagaccagcctggccaacgtagtgaaaccccgtctctactaaaaacaaaaaaattagctgggcatggtggcgcacacctgtagtcccagctactcgggaggctgaggcaggagaattgcttgaacctgggaggcagaggttgcagtgagctgagatcgctccactgcactccggtttgggcaacagagcgagactttgtctcaaaaaaaaaaaaaaaagaagttaaaccatgaaaccacccataatatattagtcttcagaaagaaaagaaaaccaaggtaagatgcaaataacagaagtacaacttttatttttctaattgtggagtgactccaagaggattctgctcccaccaggtaggcgataggcgtcctgttggtggcgtgtaaaggaatggaaagctaccacgacctggggggtccaagaggggctgctgcaggtagcctacccccccagccttccccatgaccacagccacccactccctcaaagtgggacttcaggccaagcaggggaagatctcaggcgaggagaaacagtccatccgagagctccctgggagaatcttgtagactacacgctaatgagataggcctgtcgccaaaggtcacctccgcactgtcttggccacaaatgaggcctgaaatcctgctattagagttgcacacacacaggagcctcctctgggagttctgttaaccactggtctgggagaagagacggcacagatggcctccccagtctttccagggcagagcggtgggggcgggaaggaaaggaagtgccgagtagttcaggagagggggtgggcatggggttggggggcagcctggggacactatggccccatcctagcctggtgggagctagaggaacagggaaagtaagtctaaagtaagctagactcaggaaagggaaagaaaactctgcgtgtctttttttctttccttcttttcctgacacacatagtcttgtgctctctctgggctggttccactagtgcagcgatgctatgggggaggggcccagggccctgataacaggtgggcgtgtgtcaaatagcaactcaaccaatgaatgaatgaatctgcctctcctacctctccggacagttttgaagtttaggtgaaaccatgtgtacaaaagctcctgtgaactgggagacactttgcaatcccaaagtggttaataataaaaatagtaatacttttaaaaaatcataacaaataataataatgctattggaaccatcaatctaatacactttttttctgtgagagacttattggattctttccttggcatgaaagccctgcttctcccaacacaggcaggctccctctggcacagggtgattgcatcatagacctgacccaacgtgacagagaagcggttctttctgagttaccaatggccatccatctttcagcaggcgtgccttcccattttccttgctctgcccatgagaattttcagcagaaccttggattaggtgtgccagacatgttctactcttgattgtgaagattatacacactctcaccttctgagataaatgttattaaattggataaacaaccgtgtgtagttttgcttttctgttttatctcaagatcctgctgacatggctaacagggcaactgtgaaaagatttttattcgtgtctacatcagtgtgaaaggcttcatcctggtgtgtactaatcactcagacagtggtatgaataaatgaaggaatgcattgacaaactaatacacaaggtgattccggaaaggcgcacctcctgggataaatacggtgacagtggtgagtctgctctaggtctacgaagttcttgctcttagtagagatccagacacccaatgttgaagacagttcctctttgctttagaaagctttgtgtgcaagagatggcaaactacttcttaaaaaacagagagtcccgtaaacatatgccaaggtccacggtgctccaggcagggtgcttggtgccagagagacagagtgaactgagctggccatggcatctgtcctggagaagtcacactccaatcaggaaggcaggaatgtgggccagacctacagcctctggggaagggtgtccataagctgtgaggtggtggccactgactccaatggcagagaaggtgtggtaaaaaggcaaggacatctgcaatccttctctaactcttgacttattgttatctgcagcaggttaaccacccctctgttaacttccttctctctaatgaggatattaagagtagttgcctcagaaggttgagcaaatttggtaatttacacaatgtgtagttgtcccttggtatccatggggaattgattctaggatctcctatggatatcaaactccaaggatgctcaagtctctgatacaaactggcataatatttgcctgtaacctacacagatcctcttgtgtactttaaataatctctagattacttataatatctaatgcaacataaatactatgtaaacacttgttatgatatttttattggcattatttttattgttttattatttttaaatatttcaatccatagtgggttgaatccagtaatgtggaacccacagatatagaggccaagatacctcaatgattggcagttccagcattgcccatctccctgtaccaatctgtgccaacctcggaactgtggttgagtcccaagctagggggtcggttcacaccatccatcccaccactgcagcagatgctcacccagcgtcaactctgaaccaaacaccattctgggcaggggcgaaggtgagaagcacagaccttggccctgctctcccctccttgggagcccagcagagccagtccccacaggtgggactccactacccaagggaagcctgaggcatgaggcctgtgtgttgctcagtgaccgggtccatcctcccagtgccagagaaaaggaggtgcccctcaaaccacaaagtaacccttggacttctctttagctggggtggtggctgctggagagggccctgcttgctcatctctgccagcttcccagtccctgcaaccagcagtggccagcctctggccacccccatgaaagcacataaaagggttggggaagccgcaaccccagaattgaggtgagctagagtttgaggacataggttgcttttcacttatctccagcaagaaccatgttatagatcattggtacagtgacgattttatgcttctaattgaatactgatgaaaaatggcaatggtttctcagttacttcttggaaataaattgtgggtaaataacatctgcttaaagcttggaaacccagtttcctttggtttgtgtttttaaatgctttgacgatgcggtttgcttttttactccaagaaaaaaaaaacaattaaatagaggctgacaactaggtgagatccacagccaagctattctaagagcccgaagtcaccctggacacccagcttgatgacaaagggcagaaattcaatatggaaataggatccactccaaatgcaccatctctgacattatgatgaagagaatatgtatttcatgacagggcaaatgttgccatccttctgagggaagatgtaaatgaggatgcttttagggatgatttctacattgtcactaaactgagacatttgtgcttgctcgtgccaagtgaagattgctgttgctgttgttctctcgcagtgattaaggttcattccctagcaacaggcagcagcagaaaggaagctttgcaggcagagtcaccgaataaacgcagtgggaacagtatcaacaacaaacccagtgatgaagggaggggcatgtggggcacaccacattgcctctctggcttctcgtctgcacctggggccagaggcaggtgggaaggagaccttgacaatgtgggaagtccctttgatttgctgaaatggaggagttcacattttactgtgcagtctaacattgcccattctggattagctccatcagacacgcttttgtgctttactgtaactctttctttatttgtcctcctggaaactgatccataatgccaatttgctgatcagctgtccctgggacttcggtgtactgggctagaacctcagtctagtgttcaaaggagctggcagaatgggttgtctcggcatggaggacccaaaagcagagctccctggtgctttgggggagagtgaagcccttcattccactcctcattgcagaccagctttcctggtattcatgcactgcttttggtaacgcctcaaatgaaggccacagctcagccaagtagaagagagctcctagtaaatgaagtctggttgcctttgaatttataaaataatcaaagttgctatttcctgctaaggagacagatacagaacaggagataggccacagtcattactgtcccctgcttgttccctgagcccctggccttctaccttttctaactgctgtcagaaccctggttggggacttccttttgcctggttctcctgggcttgaatggcaacctatattgacagatttcatgccactgttctttttcaaacaagatgattaacaatggaataattgggtttgggaagaaggcctttttaaagcaaactatggaaaataattgatgagtagcgcagttttataaagcttttttttctattaccctttaaaaactatgttgctaactgcacatcacactgcattcatatcctgggactaataccccttgacctctgccatatgaattaaggtggaagaagggtcataagtaacaaagtttcgaagttgaatgaaccttttttttcctgtaattttactgaccatttccctttctgtttgagagatctgtgcggtcctgttgctgaggttctgtggttcaggggtgttatcggtgacagagtgctgatttcacttgggtctgttctggtttgtcttaatttctcttttagagcttaattttcatttccaacgaattaggcaagacagaaagtgacatttggaaaagagtgaatggatgactaaacattcaccagacgtcattcttgtaacagttaaatggtagtgattcatgtctccatctcttgataaaatataaagcattaaatcttgatggctaaacacactgacaaaactaccgaaccacgttcctggttgaggatacctgaaggtcgacatttatctgggatcttttgctgctgctttggtatgacttctatcaagatagctttcgacgaggtagaacgtttgctttcactctgggttttccttggtttcgacaatttttaggtgttaactgaaggaaatcccgtcttgtcagaatgttcttttcaatacaaatcgcagtgaaataacgggctagaaagatgtggatccttcttgattttaggaagcacacacctatcggcaactctctctgcctggcctgtgttcacggcggtatttttgcctctgtcaccatccttgggactaggtacaaaaataggcttatgttccacgtgtcacccaccacttcacttcctttttaatagatcatgggtaaggaggtgagaggacatgagaaggattggcatgaagtaaataacagttaaatcttttcagccaggggtggtggctcaagcctgtaatcccagcactttgggaggccgaggcgggcggatcacctgaggtcaggagtgcgagaccaccctagccaacgtggtgagaccccgtctctactaaaaaatacaaaaattagccgggcgtggtggtggatgcctgtaatcccagctactcaggaggctgagacaggagaattgcttgaacctgggaggcagaggttgcggtgagccgagatcgcgctattgcactccagcctgggtgacagagtgagactccgtctcaaaaaaaaaaaaaaaaaaaagagttaaatcttttcagatttctaggctggaaatcaacagaacaagatctgctagcagaagttgttacatctcaactaagtatagactggagatgaatctgacaacctgtgacatctttaaatgtcaaacccaccgcacatcacagatgacatcgtacctaatgatcaaactccctttaaaatatacttcatgtaaatacatttttgcgaaaccacaagctgtttctctcagttttgttttcagctggctttgataaggagattggttggcagcctacagctaattaagcagctttcaagccaacatcagtgaaaggttttaggtgactatcagaaatccattccactctccatggtccaccggtgtcgactatgcctttcaattgtgccgacagaccctgtcagaagagaatggtttcgcactaatccaagtttacaaccaaaatcatcctgttttcagtggtgtagatccagtgtctgtatctgtcttgtcaactcacaatagcattagcacagggggctggatttatgctctaagaaatgcaatttacctttctaagctcacttatatatatttgtatctaacatattgtaaatttcttaaacttgttacacatttaattttataactagaaatcaatttttatttatttatttatttatttatttagtggacaacagaaaatgaagtgcaagagtccctcatttccggggcaagaattctgagttccttggcttctttcattcttgtctgactttcccccctccagttgcagttatttctagattttggtaaattattcattgcttttaaaagagaaaaagctcaattttctaaatctacatttgagctagccctaacctctaaagccagattgttttaacaaaattgtcatcattttatacatgacagattggcttcaaataaaatggtaaatgggaggaaaagtatattttgcttacacttaggaatgcctgtaaatgtaacagagtttaaaaaaaaatcttggtgttttaacaaatgcatattgtgaaaaagaggaagaaaaaattagctggttgcctgtgaagtaattgtgctaaaaacattcatttttaatatataagagttcacattttaattcatatacttgcaaaagaaaagtgggattttttttcttaatgctttgactatttaaggaaagcttttgtgctgtgccagtctgcttttaagaaattccagagttacagatacaattgagggtgaacttgaatttgttccgtgggcacggccttttctgttgtggtaaaacaaagttaaaatgacaacggttctgaagaaagtgcttcaagaccatgtcctgtttcactctttccagatgactaaaatcaccctcatttcccaagtcttacatcgggggaagaggatatgtggtttaaaagagtggcaagtactagttaaggtcaggctttttctgaatgtgaacattcagttatgctgcatgaagataggggcaggtattgcagagtaaaattctcatacagaaaatgtctgaaagtaacaaattaggtgattaccacggtctccttatccactgtcatctttaatcgtcatgtttttttttttcaaggctgttttgtctgtttttaaatgctgttgtcttatataaatcaggctacttgctttaaagtaccagaagaatcctataatactgaaaaaattgaaatataaaaaagtgaagtaagaattctgagtcacatgttttagatacggtgttaaacaacataacacattatcttgaatggaagatgttattaccttggtgctctcatcagttcagcttgcccagaagcaatgccaacctttcactgagaatcttttaaactgaccacaaatgtccctattcttctcaatgatttaaaatgtcctgtgctaacttttctatcagtcaatatgtatttttcagtgttcttactgagttttgttatttgcttttagttcttttcactgtttatttgctggtttatgttttatgaagaaatccactttcagaagaaatgatgacttattttctgtgggtgtttcctttcttcactactttaagaattttcaagtataaataaattgtgagaatacatatgtgtgcaaggagtgtggggaagagttaactaatttttaaattgaaatgagggaaatactgggctgactctattggtgtttttcagagtgttcctcaatttaacaaagcaaagcactgagtagtatttctttctaatatagatgtttaaaaacatcttccaaagtaagtagcaagaactaatgctcaaagtgttgtctgaaaaatctagaaatatctgcatgctgttatgaacaattctgtttctttatggagagttgtttgggctttttagaaactcattaatttgattgtaagcgcctcactgttatcaggaaaagaagctttagaaaatggtttcagaatgtgtcattttctccttgttttaatctgagacagtgtgtgggcatgctggtattttaaaaggctaaaaatgttgtacatattgctgtgtcttcaaatatgagggaagattacaaacagaagttttcttcaagcctctgtctgaaattctgcttttcttctcagtagtgattcttaaatttttacggagagatctttcattcttttttttttttcattttcaatctgttgttgaaattcagcaaaacaaatattttaaaagccaagtcagctttctaccgttttgatctgaatatttaatgctttataaaataaaaccctgtgttttaattttaactagtttcattcttttttttatgaaatgatttgcggtattagactgtcatttggtttcaatattaatatataacatgaactacgtgggtgtcacttattttcagtagtaaataactgcttaaccgattactttactttaacatagttctactgttctccttgagcctcgtgatctgcatcttcaaacaatatttggtgtgtgtttttgcaaaatagcatttacatactgtgtcattaaaaactagtttcatggtgtcatggtggtcggaatcagggaatgtcgtgtagttggtttcaaaatccatcagtaggttaatcattaattatcctttttccaggaaaaaactgatgaggttgtttcagaatttgaatttactagaattcctttttttttgcattaaaaaaaaacttttgcattttaagcttaaagggggttaatttggtaagaaaaggtaccttttctgtttgtattgtggcttgttcattttctcataaactgtatttggtagctaaaatgttgaaagcagtttgggaacaaaatgtctgctcaaaccatgacaaaattggccacaatttgccgattgggctgataacaaaagccagcaacacaaaataggtagaaaaacagtttgttcggtgatgtgagaccactgaagctcttttttgcatgttttttttttttttttcattctgatgcttatgttgtgatggaaatacatgaagtctctgcttacccattgtttctgattaactatttcatctttggatttcttttaaaacttcagaaaacaagctgccccctgggcatctgagacaaatttgaaataagagccagctctgcacctaaacattgtgttttctctagaccccacttggttgtaaatgtcccaaagctcttgttttgatcgtttaaagcagcatttaaattccatttcccccaccaccccaatgttcaacattgaattgtatggcttttactacacttttgcaagtgtaaaacaaaaattctagtttgcagtttaaaagaaaagttctccacctgggtatatagttgacaaaaatgtcaacagctaaaagtacatattgactctcatattatcttcgcagactgtaagcaactattaatgttttacatgagacaatacatttttttcaaatgatagaacgagataacagcctcctctcccttgcctctgctgttgtaacttctcataccttgtgttgcctctgtgtgtgtgatggtcttatttttttggtcttaaaaatcagatcctccaggacaataattaggatgaggtttatgtttctacttatctaatctttgttttcacaaataaatacaaataactcaaactgaaacttgatggctttggtgataatataatagcagccacggggaaattttcttcattttaatgttctttcacaacccacattcagtttcggtaggaaaattattaaccttttcaacagcatgctgaaatatgggttcacaatagactcctgagtatgatttgcaggttttggttctattttgagattttggtgtacagtttttctctttttttctctctttctttcgttcgttcattctctcataccaattgctttctttgacaccaatcgcaatgacttaaaatccttcagttgatatctttttaatgtgtgcacgttatacagtgtttgcatttatttttttattatgagaagggagaattcctatttccttctctcctactgattggttctatgaaagaggacatactctttattctcactgtttttctccactctaatcctcatgtggaggttgtgagtcctccagccccatttaaaaaaatccagttgagccacatttccccgagggcacctggctccatgtcaggcatcagatctgactcctgtctgcctccagtggcctcgtgtctgtgtccatcacaccaaagcaagtccgcccgtttgggcttgctgtcctgaaggtctgcacggcctcaggcttccaaggaaggcctgggtggcggtgtctccatagctgactgctgctggggctgcaggtctggaagggctattggagggaggtgatcatgattttgtaactctggcttcttcacctgaaacacacacgagggcaggacctggggccagagaggcaggtgagtaggaggatctcggataacagtttctgttttaggcatccccttctccaagtctgggtgggacagccacacctgcagagagggccctgattggggtcgtggtcctgccccacatctggcaagcctgtgcctcatgtactcacagtcaccttttttatttgatccccatccatcctaagtccccacccccccgcagtgccctaccctacctgttcccaccgtccctgcaaagttgaatatggaaactgagaaacacatattttatctgtaacaaatgtggacatttccagtattttagcctgggtttttttcttcttcttcttctgcttctcatacttcctgtatgaggttagtttttttaaaatgataaacaaacaatttttttttttcaacttttttgggaggcctggttgtctagtgcctcctacctgtgttgttgtgagccttttgctggtgctctctacctgggcacagaggtcggtgtgagcagagcctgaaagtgggagtgggggatgtggtgttttgcacagggttgcagtgaggagggttgagctggtgaaaacacttctgttctcctatttgagagagatgcagcagaattcatggttgtcgtgttctgtgcaggcaaaatgagctgaaggatggaaggcaagggggataggagcaggggtggagcatggctagaagagacatttgatgtttagggagagaacactggtgcagattgaatatcccacagtgctcagtcccacgctgtgcagatgagcaacatctggaaaagaagattaagggatgaagcatgccaacatttctccccaggtcaccccaaaaatgagttgaaaattctggatggcttctgagctgcttgctctttccgcccccagtcgggatctcaggagagagcgtccggcaagtagcttgggtacagttgactaagtgtgaacatcagtagccagccgcatagccaacctgcagtcacccatggccctgcatacaagagtgtcactaggagcagatatcacttgccactggtggttgtgtgtatctgaatcacctgggcactgtgaaacacacattcctaggccccagccccagggtttccttcttagaatatgtgaggtgaggccggagaatttgcatttctaacaactctcaggtaatgagatgctgccagtgctgagactcccattgagaaccgcagcctagagccagggtgcttgaaatgcctaaaaaccgtgtctactggagtctgcaagttgtctccacttttttcctaatgtccctttgtgtgtcctaccacagacttaaaatccacaccagcctctcagaaggccttttgcatttctcagtaactgcacagcaaggttacctgtcatcttggccttttaccatgtccatcagactataaagtggctaaaatgtttttgaggtttggttctctgaaaaatgggttgtattttacagatagtgaaagggtcaagctgtagtgtatggtatcactagactaggaaacaatctaccaagggccaacccttgggttgctgccccttgacaatttccgcctttattataaactaagggagctgtcataggttcttccctatatagagcactcttgacataagtgacaccatcttagaaaaagactccatcttacatgtcaaaaggcatcatgccaacagggaacagatggccacctaatcaataaagaccacacccaaccagacagggacatcaccagccctcttctactatcagtccttgccagaggtctcagggctataagaagagcaggatttcaccagcttgagatggtcatcttaacagagccttgctctgttgttgctcgtgatcagcacccggcatctgctgccaaagactctgcccacatcaaagactcttgatgtctgtccggaacaggccaggacactctcatccacgttgctctcattggattggctcattaaccctttcttctatccccttctcactcttttttttttcaaagccacacttatgctctgttatcccctttctctcgatgttaaatgttactgttccatgtggaatgtttaatatagcatttatatattgattaagttaaggacactgctgtgtatggtttgcaatattgactgacttgcagagtggcttgagcctgagtgctcacagctctgactaccagttgaacaggacgtactaaggagaatcacttccttgggaactccatgtaacttgtggcttttgtgattgaaatagcatcagtaaaagtctgaccctgtggaaagacacaaatgtgcgtggacccggctatgtctgactttgtgctgctcaggacactctctgtaaccaaaagtgagagagcctggaagacctcagggggtcagatgtttgaaggagctgctgagtatcctggcaggcagcagagcctcaccatcagtttgctgcatggaaggctgtgtgcctctatttccctgctatttgttgaactcccttgagctccggtccttcctaagtgagagagatgatcccaatagcaccaacctgagagggctggggagatgtttgaaggaaagcttggctggggagctgtagctggcctgtggtacatccttggtaaatggtggccaggagacccgggtgtgtgtcctggcactgtcacactctgctgacgagggtattgaaagtccccactcaaagacacagaatcttcctgaccaagtgtaggtctgtaatgacgtgtggagcactttgcagaaactgcttctcagcgggggtccccttgaaaaggtgctaagtctgctcagagatacgtggctgaagctctagacgcgggagcctctgtcagagacaagggcagggggactcaagtgctgctgcctggctcccctgccctgacagctctagcagcacacgagtctgatttatacaaagaacccatctcatatctccctaaaattagtctgtgataagcaatatacatttcctgagtgtgcggtctaggttttaatattctgaaaaataaaaacagtggtctcttgagagctgaacagtttggtagttactgagcaggctccatcctccttggcaattcttttgaaatctcaaaaagttggcttcctatactgttagaatctggtgtgagtcaagaatggacagggtgtgagttcctcactcgtcccttttctatgcattgaggaagacctcggtgctgccaatggggcagaggaagctcaagtgtgtttttgcatgaggctggctggaagctctggcttgggctctcagcagtgaggtactggcagttccttggatgtcacagcaaatcgaagcttgtggtcttcacttcctcctaccttgagacttactgcacagaaagtagaggcttggatggttcaacttcaggggcaaaacagcctgccttgggggtgggactgggggtatgcatctgtgccactgcttctctccctttgtcagtttaccatgccagcagccttctgtctgttatcgggaagagaaagagcatgatttgggagctagctggggagcttcctgaaggttgcctgagctgcatttggggcccctgatgagggcttctattcagggtgatgtgtgtgaccctgaggccatctctcagatctggggggaagtgaggttttgtacccacagtggggagacctacctggcggctcatcaatattagacacctgcaggaacagcaggtcagccaagccaaagagtaagagtggccctgtctgtgactagatgcttcttcagggttgcctcaacaccggagtggcgctggtggtctccacccactcccagtgtacactggcatctaggaagccatgtgtgtgatcggccctgaattaggggcaaaacttttagttctcagatgaactgtcgtgggtttattcagtgataactagacagccaggccaacatggagttgattcatccatgcaaaacttcccagacaaggcctttcagtggagaactggaattcagggtcttctcagctttggccagaagccaaaggtaggagaggtaggagagacccaggtcctggtcccagctgtgtcccatccagagtgaccttgggaaggttgccaacttcctttttcggtgagccttgctttcttcacctgcaaggtgaagggttggttggatgatccgtaagggccggccacctctcactctgtgactttggcccaaggtccacatggttgggtgttccatactgtagccctcctgggctattacattttggtttttcattgcactcaaaagtgggggtaactggtgaggggcacgggttggtaaaccacctctctatttcagtgatgaaactaaagaaaccaggtttccccttccacccctacaggccactgatgcattacttagttcctgtttctctttgcccacccaggaagacactgcgtatgaaatcctgggcccagatgctggactttaagccacattagaaaatgctagctcataggactcaaaacgggaagctggctttcccaacagattcatctgggcagtgttcttcccagaatgtgtaggaatcatggggccaggttcgccaaggctcaggaagctcggtatttcactgtcactagccaatgaggcctttaaggaaaaaacagataagactgtaggagtttatatggatccgttaactcacttgtacaagacattgggaaagatactgggggtggggggaaacaatacagagtttcaaaagataaatagagactgtcataatcaccacatgtcctggcagccagggctacggggtcaggagaagctttattccctggcctgcagcactgcaagagaccctaggaggaggagagctccgccaggccctgcaggctgggcagcctgccttcggccacatttcctaacaccactcagcagagccctgccagcaaaggccagtgtgcaaaaaatgttatgccctatatatgtttgggaagtgcacaataatttaaacagctttcttatttcttaacttctctgggtattttgtgtgctactgtatcttgtgaatgaatctcaagaggaaggatgaagcttttccaaaatcacatgccttcatctcattttacagaaaaatttgtgcctaatattaaccaaaggaaatggggagcggcagggccagtgggttttcatggtgaactgagggttgcatcttggacaggttgcatgtggaagggacagcagggttcccaaggaagctttgcacggtcatgggtagagccatcccttcttcatccatagtgaatatggctggaaatagcgggtagtcttggatttgacctccctcccatggaagtgctgtctccagctcactcctggaaaaactgctttctccccaaagtgtgtctgagcagcagatttaagcatgaagttggttttgtggggctacagtatggactttgggaagatggtgccatctgtatttctgattctaccgtccctctgtctgtctttggaagtatcctttcacttgtttgggagactgagaatgattttctgcaaacagtgagccagaccatgctggtctcaagcggcagagcagttattaacagaatcacagtctttctggagctgctgtcagtcctgtgctgtcctcagggcctttgcttggtcaggggccccacttcttatccacccttccctctacctcaccgaggctgctaggcccaggtgtattgtgattatttgatgcacctgggaggccatgtctcccggggagtctcaggacctcattgggctggaattccacggggatctctcattgggtctctttgggcctttggagaggggagtgcagggcaccacctgggcgaacacctgtgccatcctgtaagtccttgtgtgactcttcatccaagtcaacaggggcatgtaggggaagagcctcagggcccatcaggagtcagaccctgaccaggaagtcagaactgaatcaacttttcaataaacacacaggctggccccaaacaaagcagcaggcttttgggaacatctgccttttcagtctcttctgaattctgtttatgtggacaccccatgtcccgcaccaccattgccgccagcaatgtttgttgcttgccaatatttgaatagatgctgataaatttgattctctggcttattgtggcattcatgatatgtctttcccttttcagtttccatgtactagagcgactgtcagtgtggttggcagtgacctgtgtttttcatgcatgtttttgtttcagaataactgggagatgaaacaggaagctctatgacacacttgatcgaatatgacagacactgaaaatcacgactcatccccctccagcacctctacctgttgcccgccgatcacagccggaatgcagctgaaagattccctggggcctggttccaactgcccactgtggactctgaggcctctgcatttgcgggtggtctgcctgtgatattttggtcatgggctggtctggtcggtttcccatttgtctggccagtctctgtgtgtcttaatcccttgtccttcattaaaagcaaaactaaagaaaacagaattgtttgcttattagctatctttaaacgctgattgaaaggatatcgaatagtgtttgagggaaccctggcacgtccacacagctcatctgacatgtttaaatgtgtgttgggcttgactctctcataactcagccacgcttgtcttgctgcttctcatacctctccagattgctgtagagtcagtgtgggcagactgacatttgagagaaacgtcaggcttcatctggaagcctctttccacacccaccctgatcgtggcctgtaaactgtgaccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatgcctccgtcccatttcacttagatgccccgatttcctaaatgctttcttgaactctgacactctgggactggcacctgaacagtctataaaacggtgaaatgtcgaagcattcctgctgtgtaatcccactctcttccctaacctcaagcaggacaatttgaccccctcctgaggacatggccagacaggccattagtagaagccttccagaactttctggcaatcttcacttttaagcttagcaaacatctaagaatgattttaaatgaccatgtttactcttttgtacttgttggaattcgtttaccaataggccatgatggtgatcacaaaaccccctatgtacatgcacagtgttcattgcaatgcatatccaggtctcaacccaatgtccccttctcgaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccggcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttacgtaatttgcccccatcctggaagataaagaccactgtgttgtggagggaaatagcctcagctgggcgtctctggatgctactttctccagcagaacactaagaagatcagatgagatgaatacaaagattccaccctgccctgagtttctgctggttctacctggctaggttctagcagaagagaaggaagtatacaagggtaacatgtgcaagggcagtgtacaagggtaacatgggcatcagggacagtcctcctgaggatgtgaggagccaggcccaactgtgggctggcagcctgccccaggggttgctcacactcacctaactccggcccctctggacacacccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatgaaagtcacaggtgcagggaggaccagacgtaacccatatgatgcctgcaggatagttagttcacaaggatattaggagaaagagcaaaagagaagtgaccacacaattctagatggttaaagcaatagttctgaccctggccagacattagaattacccagatgttataaaaaatccagacacccaggatccacttggaccaatcacatcagaatctggggattgagggggtgtagacatccgtattttttacaactctgcaggtaatttcaatgcatagccaagactgagaaacattggtctctcaacgtaccatccaatgtagtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaaggtaattctgtctgttaacttcactaacaagccctcctgtcttgggtttgttgtatatttttcatctatgtttcaagccagggcttgtgcagcagcaagggtgacaaactttcaaagcactgcactgtaggattgaaaagcattgaaaatacagttatgcactcactaatgtctcagtcaacaatggactgcatatacaatagtggtcccataagattataatggagctgaaaaattcctatcacctagtgatgttgcaactgtcataatgttgtagcacaatgcattatcttttctgtgtgaagacatgtttagatgcacatattcttaccgttgtgttacaattgcctacagtatttagtgcactgaaatgccgtacgagtgcgtagcctagaagcaataggccataccatatagcctaggcaggtagtaggctatgccatctaggattgtgtaagtatactctgtgatgttcgcatcacaaagaaattgcctaacgatgcatttctcagactgtatccctctcattagcaatgcatgattgtatctgtaaaaatctaaggcccagacctcagtcttttggtgttcattctgctggtttactcagtttgcaccgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactcaactcgttggggttagagatggagaattagaaccaaagctgaatcactttctgcttatcactcatagactgccagattttctttttttgttggagggaaagcaccttacaacaaataataatactattttgaatttcagagctttccctttttcaaagcactttaccacctctgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatagacactagagcttcacatttgttctctttggttccatcccaggtttctaaccttgtgcctaaatttttgggggccctttcttcctcagagctttgtgtgttctgcaaatttggtaaatatgccttcatttaccatgtctctttccaaggtgggtttcaccatgttggccaggatggtcttgatctcttgacctcgtgatccacccacctcagcctcccaaagtgctaggattataggcgtgagccaccgcacccaacctccaaggtgttttttaaatggtgaatgggacagaacacaggacagagtcccatggctctccatgaagaaagtcctgtgtcacttcaaaggatgtcccctgtgcagaaccaaccacgctaggctgacatcctcacttttgggtccccaaccttctcatgggtagagctgcagagagtcatttcaaaccacacttgcctgtgggcagaaagcacggaattgtctgtccaactggggactcaggagcagcctggctgtctgcagcagctgcaaagggagcaaaggcaagcaggacttccatgagttaggaggtggccttctttggagatgagtgtcctgccaattgcaagtcctcctggtcacaccatcatctggcccatcttttgtatcttagatcggatagggtgagaggttttcaaaggctttactgaaatcaagacacactttctggggcattcccctaatcgactgttctggtgaagctcgtcaaaacaggaaatgaggttagcatggaatgactttctcttagagaacttatgttgcttccttgagaccaccaatttcttcccaaaagcttgtgagccttatttcgtgtctcttttgggttttcttggaacttggaggaagtctgttcttctgtagtttttagaatccattcctctggaaaatggtggtggtgtttgcttattcccagccttccagactctctccctttttctccagtatctctaagatgtttgcaagtttgtctgaagtgagatctgcacatacttgaactacagcaagaatgggattgacccacatgctctgtgcccacgaccaggctgacagggccgcatgtgggctctctggcatgggctttaggcagctccttcccctgagaagctgttggatccacatgttctcacggtatcaaaaacggcaggaagagaaaactaacctggtggagatgaaacttagtgggaacactccgctttcctcccctgctccgtgtgtgagcacttggctcagaaatgcactgtggctgagacagccctatctggcttcacctaagcctacccccgtgttgagttctttaacttagttatcaaagcggcaagggtttcagatctagacaagctgcatcatgcttatttttgctgaggttttctgacaaatggctctacttgaaatttccagatttaaatgtctgttttattaaaactaaagtacttttgagtcatatttgcttttatgtagtagaagcaagtagaagagagtccatgggaaggaatagctggctttgcctcacaggtgtttagggaggactgctgtctccaatgcaagacctggattaccgtttagagatccacctacccctcatgatgctcttgttgctggaatcatggtctgtttcatgctttacgtgacttagcaggaccttgaaagctgtcctgagtgcccatgctggaatggggtagatttcagttccctctccctcactcccgcatgaacctcagcctcactctactcaggtctagggtacttagtgtgttcagtgatgattgtctacatagatggattaatacatatgcacctttataatcatcccagctaccatctaaggttctagctttctctggagacatttttggtggtttacaatgttattttccagtgcgcatagcaggccccagaggcaaggtgatcacctctttgtttcagttaagaaaactgagttttagtgaggacaatcaatttttcccatatcacaaaactggtcatgtgatgctgcatcccatatttaagtccagagcagtgagcttctccctatccctctattatgctgccattttgtattttgtaggtgtgtaaaatcaaatgtcattcttccttaaaaaggactgtgaatggtaagcaacagttgggaagggtgacaccagacaatggctgaaaacagggcgactggaagttgactgatgggtgctgagcgcttggcatccgttcctgctgcagaccccactggagtctcctcagaaggggacactggtggcttccattggccctgcctcccgccagggctgtgtgaggatccacatgggctgggatgagggtggatgttgttctctgaaaactgtccactactcaaaagtgatgttgtggctgggcacggtggctcacaactataatcccagcactttgggaggctgaggccggtggatcacgaggtcaggagttcaagaccagcctggccaacatggtgaaaccctgtctctactaaagatacaaaaaattagccaggcttggtggcgtgtgcctgtaatcccagctacttgggaggctaaggcaggagaatcacttgaacccaggaggtggaggttgcagtgagccgagattatgccattgcactccagcctgggtgacaggggagactccatctcaaaaaaatttaaataaataaataaataaataaatagatgttgctgggtcaaaaagggagaggccccacgctgaccccctagcaccagaatctgcatttcagcaagatcccagggggctgtcacagttgctagctctgctctttatgctcgcctcagctaggtgccgagtacctgctagaggagtgaattcggtctttattcttcagaggcactggtcagagggtggaaacatcagacagggactcctgggcccccaggcaggactccagggggatggagcgggggatggaacatttgagaatcaccaacatgcagcaaggacattagtgagaaatgagttccacctgccagaagggaatctgagaagggaatgcacaaatcaggaaaatataccatcaaaaactacgactcttctacctccagccctcgccaccaactcctatcccattattttatatccgagagggttgataggcagcagacacactgattctgtaagcattgtccctagtccctgtaggcgaggtgaccatgtacccaagttcactcaaggtggtcctgtccatgcctattagaaatgagttcataattcctttcagctccgcctttcactctcgagcgtgcccttgcttgatgattcctatctggcttggataccctcacttatattaccttatatctgctattatatttccccaagaagttgctttacaaacactgactcctcaacacacggtcatctctaaaagaaagggtgtttggcagttcctcgacagttctggaaaggctgccttactagaagcagagtcagccatgggggggtgagaacaaaagtgtgcactcaagcatgtgtgtgttcggggtgtgtgggtatgggtgtgagacatggtcatatgggttctgtgtacctgcatgtgtgacacaggtgtgggtgcagaagaggacacggggtgtctggtgcatgggtgcctgtatgcacgtggggtggttgcgtgcatctgtgagtgcacatctatggtatgtgtgtatgcttgtgcatacatgcctgtgtgtttgcatgtgtggtgtggtatggtgtgcgggaatgcatgggcggatataagtgtgggtgtcttagtggatgtgtgcatggatgtagtatgtgatgtggctggatgtgggtatgacgtgtgcagtatgagagtagggttctgtagcacgtgtgtgtatgcagtatgtatgtttgtggtacatgtgcattgtgtgtggctgggggtgggttgcatatgttgcatatggagtgaggtgtttgtgatgtgtgtgggtgtgtgcggtgggtatatgctggtacctgtgtgcatgtgtgttggtgtgtggagtggctataggtgacatgtgatgccatgtgtgcttcctgagcttgtttgtggttgttcccagacccactgcagactcaagcatggctccacatggcaccaccacaggataagcctctgtgtgtatgcagtatgtatgtttgcggtatgtctgtgccttgggagctggtggggaggagggtctcacccttgtctgtccctgggcatccactatggctgcactgggaagccactgggtgcaatggtgttgctgtgtgggacggggcctcaggcccacaggcagcaagcatagaccagatccacccagcaccctgactgttgaggatgggccctggctgtgtctctctagcccagctagctcctactgcatagtcaggccttgggagggaggaatcactgaatggatttccttcctcctgccctgcttggataggggcacttgtggatgcttctggctccaacttttgtgtgcagtgactatgatggagaagtgatgagctccctcttcagccttctgggctgctggcatccccagtatgtttctccctggagacactctcagtgaggccaattccaggctgctgggggcttttccttctgtcactgtcgggcctccacagggatctgcctggctgcaagatgctgatgggtggaggggtggcccacctggcctccagaagcaggagctccctgcccactgcccgcatggccctcagccctggccctcacctgttgcccttctggaagaacgttgctcttgttagctaacaaccacctgactttccttgatctgtctctccctgaggcaagaatgacctaggtctgaagactgaagaccagtgctggggcccctcttggaaggccaaggaagtggagaagtgcccaggtctggtctgcttagcctcctgctagttgttggagctctttgagccttggtttccaaacccataaactgggagaatgacacctaccccagcagcacagagggatctttgcaataatgtgcaaacccactcagcatgatgcgtggcacaaagcacaaacccaataaatggtggctattatcactattattttatttcatagattcaaatattgagaatgaaataaatatatcagaaagtagtagcatcgtgccatcagaaaaatactctgatggggtcctagcgatcttatccatgaaaataaaatatcaaaagaaagacaagacgatctagaaagaagggatgccggcagtcttagaaaaaacaaataaacaaaaacaaacaaacaacaaaaaacaaaactggtggcagagagtgagacaacaggagcaaatatagggccagccagacagacactgcttcctctccctttgacaggcaggacagcggcccgctcccaaatctgcagggtcagacgcggtagatgaacagtgatttgcctgagtgtaaatattgtgatgtctttcttttcttgaacttttaaccttgctggtaaacagggtgcatccagaattgtttttctgagaactgagttttgaggaaatggggggaaaagggtttttattagctaattttcagtcttgtgcgtgactcaaaaccttcttattctgtttcttaactttgcttcaggagacacttggccaaaaaatagctttgtttttaattgatggaagaaaaatcattacaatgtgtaagtatgccaattcaaacatggcaaaactttcaaagacaaagcaggggtggggaggtcattctgaagaagatttctgagacaagaaaaacaaccaatccaaatccccatttgtgttttctaatgagaaactcctcacacgccattgccctgctgaccccggtcttaccttgaccacctcgccccatcttcatctgttataacttctgagatattgtaatggaagtatagagtaagcctgagatacactctcagcattcaaggtgctgccttcctttctccaggcaggaggctgacacagccgcctttatttacaaatgccgtaaattgactgcaggatcctttcgtgagaaaggagaataacggcagggaaccatcccagcaaaatgaagttctgggctccaccgccagcttttccctcgaaggtcatatttcacgtctgccctgtaatttcatgaattgttcaatgaagatgtgacttattggcttccaagcttcatggaggtgttgtccaaatacaaggtccataaagtgctttggaaggtttggaggaacaaagaaacacttttgatctgaggttgtgatggagtctcctcaacattgtagccgatgatggcgagtgctggagggttcatcagacctgacagcaaccccagccttcaaaccactctctcccctcactattcatacctgcatttgtgtctgttcagttgaatgctggcaggccgtctttcaaataatgctccagttgcaaagtaaactgaggacattgagaataaatatctccagtcttctaagctatacggcagtgttgctgggacctgtaagaaagtttctctctgccatcttagaagaaggaggaagaggagaaggaagcaggaaaatggaacaaattgccgtacctttgtaaaagatgagattgaaataaatcacaaggagtgttaaaacaggcagcttgcgggaagccaattgctaacactctcaggccccatcctttcctcctcctcttcctttcagaataaattaaagaatgggcccaagtccaagttgtgtgtatggtatctttatctgattgacctcgtactcctaataatatcttatcttcgcttgtaaatcattagcacccttttccgttctcccggcatgttacttctttaaatgtgatgaacactcacaggagtccgctctgcagacagacaaagctactgcaaggatcctctgtcattcatttggcgatttggtcccgaaggcctcagctggcttcactagcaaagtgtttcacaaattcccatagccctgcaaacagccactcccccaaagcaaacaacctgagacatcaggtaaacactgaagaatggaaatttcattcattttcctgcctgcatcctctctagttgacagagaatgtcagtcaatacaagatttgttgagagtggtacatttgaggatttatttgtaggctgtgttaatatacttttgagaaattcagttgtatctaattaatgcttttttccctttgattcattccaaactatttaaattggaaaattgtgtgctatttgaagatgcactttaaaactccttttgttgtcatggtgcctgttgtcactgctttttgttggttggttcttgtttctacagggcccctcctctttgggatcatgtgggtacagatgagactcacagttccctagccagatgatctatagtagtttttcaaagactgcataggtagtgttactgaacatagttcaaatgtgtgtgtgtgtgtgtgtttctaaccttgcaagctccttgcaaaactacataaatacttgtatttaagttgtgctgtgcatatgagcataccttattatgagaaaggtagattttaaagtattccttccatgggtaaataagtcttccctgatgataaatcattacagttgctttcacctcccaaactcctttagctctcctctcccattcagcccctgtagaaaagggctccctttatttactgccccacttgttgcaagttgggggctatttctttaagtctaacttaatattccttgtatttagttcaaactgaaaaattctcatgtgtaactgccgggcagggcagagggaagtagtgtctactttaaatccgttgcagcacatgaacttaaatgacaaaacaaacacagaagactgaaaagtcagagaccctcttaaagaaaagcttacaaaattatagtgtccactctaggcaggactttcatatcctttatctaactgtcacatgatggggtgacatgttgatccccccacagcctggatgatagaaatatttgtggtttgatatgcgtcagcgcttatgactttggcataaaatacaatctcctttgtttcttccccaaattcaagaagtgcatctttccataatattgagaatagaacctaacatttattgaaaatctactagcatattttgtcttaaaaaaaaaaaaaaaagcacttccacatactcagcaatggcccagtgaggcagataatagcttcatcccatctcacaatggtgaaataaagatcagagggagccagtaacttacccaaaatgactcccttaggaggtggcagagcccatactcaaagttggtttgtttaaccaaactgcttaaaatgtcaacttagtttgcaaaacagccctatgtggttggtggtattatctgcaattcatcaccaacacaccaggcccagggcaaagctaaaagcaaagctaacagccagagtgaccagaactgggtctcacctctgctacacctgtgccagggagaggagatgaacactgtaaagtgctttcatgcacttgggggccttcctgtccaagtgcagtataaatgttctttgtgccacatcttaaaggaatcctcttacagaaagggcttcccatctgagtggcaagacccaaggctaggctgatgcctcttcctttgctatgtgagacctgaaggcaaagtctgcctggactgacagagatggatgtggcctccgtctgtctgtgtgtcatgacagaaaggaggtgggaaaacttggaaaatgggaaccctcactttcctgaaattcccagcaatcagttccaagaattgtaaccttgaagcacaggaaagcaagaccctcagccgggaacatgaaagcttttgtcgggaattctttgaggtcctgatgaggtgacacagtgaccagatgttccagattcaacatcaaggccggtgggggtggcactgcaccggtcacttcaggaagagcagtgtagtcagagagcatggcaaccaccattcgcctggtagacagctcattccatctgccttgcatattttcctacttccgctgagctcagaatggagaagatcgaatacagtctgctcttatcaccctgaagacttttaaaaaggctctgcatactcacacaaaaatcgggaacttgatcactgtggcctgacaatgtgttttgaaaaggcgggggttgggggcggtcagtctttccctgaaagttcccatccattgttgagtaaacatcataaatctatcgcagagagacaggctgcctgtactcaaattaccgcctgctacaattttagcttcaagttttaatgccctaaacatgaataacgtcgtatcccagcacaggtctgattaatgaggcaactttgccaacttcagggtcggagagtggctccccacctccttcctttttttccccctgtggcttagtaaccatttcagcaaatttcctcattaaatatacaaggcgactgagtgcaataaaaactaaaggatgtggcagataaacaccagcgtctctctgagcagacctcgctgcccaacagagcaggccagctcaggtttgctgggaggaatccagaatgttccatcatgaattccagcataaaaatcatgcacgcattgccctttgccatgggtcattttcagtctgtgggttacacttacaggaccgtctgctttccgagctgtcacgtggtttatacatggaatgccactcatgccctacttgcacgtaaggtgaccaatggctggctgaaggtcacactcaggagatgacccaaattagcacgtaatgtccaaccttgaaaggaaagagggaagttttatcttgcccagatattgtctgttccccaaataagattgtgtgtcgcttgagtaattcccgaataggagcccgtttgttgagcacttaatgcaccctgggcactgaagaagaaatgcggaggagtccccaggacttgctgagtctcctagagacagcagaggtgctctgctcacaggagctcattttctgcccacaacaaccctgtgccatcagctacattatctccaggtttctcatacaaccaaagctgaggcttatagggtggcacaacttcccctgctctggctccgaattcaatattcctaagccataaagcatttctctttcctccccatcctgttcctattcccagtctctccatgaacacacacacacacacacacacacacacacacacacacccttgtctacacttgagctgtagtctgggcccgttacatcaacaacacaaccacggcagaacgtggattggtccaaattgcagagattttaaatctaaatttcccatgctattgagactttacagaaccagtccttcaggtgagttttgattttctgtttaagccagggttcagcaaacattttttctaaaggccagagagtaaacattttaggctttgctgggctgcatggtctctatcacaacggctcaactctgccattgtagcatgaagcagccaccggtaatacatagaggaatggcccaaggtgtgttttaatacaactttatttttaaaaacaggcagagggccagatttggcctacgggccatagtttgagaccccatagtttgagatctaagtcatcactaaaagtgttatcagtaattgagggttttagacattgcatctgtctaacctatcagaagtaagattgggggccagggccattgcagtgaggctgtggaagttcacagctgcttaagaagcactgtgaccaacatcgctccttaccccagatgggccaggccagcagtcacaacatgtgctccatggggagacagcaataggcatttcgctagaaaagagttctctggactagtaagtttagaaaaccttgggctattattatcgttattattatattattccatgactgcaggacttctcagggctttcataatgctgatgaacatgaatcttcctagatattctggatctctaggaagggaaggtttgtgtgcagagcatgtctgcacgatattctttgggaagactgcgctggctcccgtcctagagattctcatgctgtcttttctttctacctgttttcccaactgttcccacttgagagtactggcctgagttgctgccaaccttacaatatccagctccgtcctcagagccacactgcggtcccactggggactttggtggccctgcctccctgcaaccccaggtactcagtttggagggtgtggagagggcagggttgaaatgcaggctgctgtgtctctttccttcaattttatcaccagctgctgaccatgcttgcttaaaggtctggtatttatggtctcctagagtctcccagaacctcacaaatacccccgggctcctggtttgagggactagatgggaagcccccctccctgggagaacacaggcctagagcttcctggaacttaggcagcttggtcagggagtgtgaggactctgacaggagcacgggtgtgggacattcatgcctggaaggccctcgccacctgagacctcggtgtggaggcgggacttggaggaaaggagtccctgctatagtggaaaaaccagccagggtaggtagttttgtataagactcttaactctgtggagacttctgttcattatctgcaaaatagaaatgtgtatcccagcagcctaggcttagactgtgaaggactagctgaggggtgtgtgagaaagttttgcaaacatggctgggcacagaaggctgagctattgtctggaggaaaactctcagggcaattcagacctttctgggcccttctgaggcaagaggcattgaggcaaagtttgagatttgacttcagggacactgttctctaagcatatgcttcagtcacgagcgctgaacccactctcaaaagctaagtagtagcaatgaaatgcttaaaaagttcgacccagactgcaaagacccacagaaaatagagcacagtggctggcttggggagggaccctcggtccagacagcagccaaggagttcttgagccttatttatcacgttgtagtattttacaaggagggctatgcgttatttctctaattgaacgttacttttaaaaacagacaaagagaatcaggaaaaatgatgtgaggaccttaggcccagatctgtttccgtttcaacaagatgtgtcaggatgatgaaaatgtcgtttggttgagccgtggtcatcaccccgcattgttgttctttcatgtgtttgtgtgtgtgtgtgtgtgtgtgtgtgtatgtgtttccctctgagtttcccagtagtcattactaaaaaaaactcctaaactgactcaaaacaacaatgacaaaaacaaaagcaaacaaaaagacccaatcaccacaggcgccattcaggccctcttgtctgacggtgttcacagactgtgcttgtgtttctggatgtacccgcttccttttctctcttactcaccagatatcactgggaatccctccttcttgctccaggactctaaaggagacactggggtaagactcatgtgggtcttggggcagcccatttccaggagagcatgacccccaccccccaagccccaggaggacggacccttcccagctgaggcctcctctgcatccggaccagggccctgggcctgaagccaggttttagtgaaggccttttgtgggtgcctctcttgcccaggaaacacaaggtctttaagctaagcctgtttgtggggagagcaacccatttcttagagggactcaatccatagggaggacactagtccatcagggggcccttgtattttcatcctggaaagcacagtcccctgtttccttctgggacatgagaagttgcttctaatggttcatccccacaacctcacttccccatccttgatttgcaaatgggtccatagagaggtcccaggcagctacttgacccaggcagcgaaggtgagcgtgggtctcctcactgccatgagccaggcagaagagcaagcaaaacagctaagaaccagacaggccagagttcaggttgcagctctgaacctgactaagctgtgtgacccaaggcaactcacccaacctctctgagcctcagtttccccacttaaagtggaaacaagaccagcccctgcctcatggaattgtcatgaggaagagtgaaggggtgctcgtgcagagctggtgcccagggaaggggctccggtgccaggcctgacagctcgtcagggaagcctgctgccggccatcccagggagacagtgccagatcagagggaagctcagcaagccacttaaaagggaccttgactcattttgtggtaaccgaatgtgcagttcaggaagtgcttcgcaaaagcgaactgggctccagccgccccctcgtccccctgccctctgctcaggattcactgtgcgaggacccacctgacaccacctgatgcatgccagcagcgtggatggcaggccccacgtgttctcaagcccaccaaaggctggtgggtgtcggctctcggaaagacagcctgacctcctggactgaaattccactcctctctttagtcgaggtgctcaatctccctgagcctctgtttcctcctctgtaactggcactaccgcatactagggccggtgcaaagcccttggcaactaggtatcatttaatccccacaagcagctctaaaggcaagtacgaaaccttgccatttaaggatggggaagctgagggcaccttgagttatgccagggcacacacagggtgagtcttggagctggaatttgaacctggggaatggcactcctgggccttccctcctaactcatagtatctacaacctggattgtagacctagctagtaggtcttgggggtccttccctcctaacccctggtatctagaacctggatcgtaaacctagctagtaggtcttggtggttcctcacatggatagaagagatgccaatttccattaaccatgcacactgctgcttggtgggcaggtgaggaagtggtctgagtgtggaggaagcccaggacaggaccctctttgcctccccgtgggatgtcctggctgccctgggaggatatgtgtggtgttctctacacccacctgaacctctagctccccagagcctctgactgcatgttctgagggcagtggcatcgggaacccatgggcgcagtgtgcagagactggccgaggagagctgtaggggttacctattaaggaggcaggtcccagcaggtactagggactgaagagggtggagggagacccgaggggggaagaggctgccctcgtcattagcccagatccatcccacccacttcttcccatctccctgtacttgccccatagggattcccaaagagagggaagtagagggggagaggagtacatgggcacaggagagcgagtgagcaccccaccccacaacagtgtcctgaggaaggcccctcttttgtctcctgcttcacaagccttgggaacggggaactctgcaggctgagcggcatccctgctgggaaatgagggcctgtcttagttcctcatttaaggcacccaccctcattcccaaggcagttaaaagccccaagttgcccaactcggtcagaggaagcctgtcccatcagtctcacacacccagaacttgattctctggcctccgagactgggcagggaccagctctgtgtccccgagcccacatgtagaggagggagccgcgaagctgatagcccaggaacttctattccccacttgtcattgtcaaactctgatgtcttctgggactaaatttgaaggacagtttttactgttgtaaccaaaaaagcaaaaggaagcaaacaattaacaggcccccttcttttcgggacttttttctttgtcagtagaaagccatctcagtaaacaagagctgttacgaaatgtacctcaccccacactatgcctgtaaagcatctcccttccccccgctgcacaacccattgtacaagaaatattgtgatagatacctttgggttgaggctggaacaaaatgagccatcaggaagcattccattttcagctggacttgtttctgcatcttttggaggatttctgcaaacccacagcccagtatggcatttcccatactctgtgataagaacctccaggataacgttggtggctcagggatcatctgagccttgagcagcttccattctgatctggatgtctctgatgtgtgcttgttcaagcaatcgatgagccagtcgtgggccccagactcatgggaactgggggagtgcccaggtcaaccctgcttgcttttacagctttcctataaaagcttctccactctttgcctgggcaagcccatgcccagatctccagcacacactccagctgccagagggggtgggggggctccctcctgcgtctggaacctattcagccagcctgagattcagaagggcctacctgctggagctgagggtgggtgaacccacccacttggggctagcgaaagattgcatcttgtcccaaggctctgctggaccttggaggattcccaccattgtctttttgggatttgagggaggtgtttcagactgggagactgggagaatgtttcccagcaaaaggcagaggttggggttcctgggatgtggctccccacagaccaggaggctgacacagttcctctctctgtcttcctgcttttctcatgcaaacagcacccctttcccatggctgctctaacatccttggtagcttaacacaaaacacaaatgtattctctcacagttcccaaaggccagaagcctgaaatctgtttcaatgggctaaagtcaaggtttcggcagggctttggggagatcagcttccttgtctgttccggcttttagacatggccaacgttccttggcttgtggacccttcctccacttaaagtccatcactccagtgtctgccccatcgtcacatggctatcccttctttaaccttcttgcctccttcatataaggaccccagtggttacgttaagggcccactcagataatccaggactacctctctatctcaagatcttcaacttaatcacatctgcaaagtcccttttgccgtgtaaggtaacattctcaggttccagggatttgtggatgtctttgggagccattattcagactcagatagttatagttaagacctatgagacagtcttctacatccctgagtgatacttgaagcagcctagcaacaaaaaaagccacaaaactttgtcaggagagctgtttttggggccaccccacattgacccttacctctgcagcccctggtttcctctggcccctgcacttgtgtgataccttgagaaggggtggatccacatgccagcctacgcaggagcaagaggaccagtgcttcttctcctttcttggtacatgccagcacggtctgtggctgggatgctgctctctgagacttgggagcttacttgttcacctcagcaatgaactctgaccacattttgccattcctattctcaggcccctagcaatctcattcccaaactcgatgacccagtcttttgcatggctcagagaactgccagaactgttagcacctaggccctctgctggagttcacagatgcaaattctgttgcttgcactccaaatctgtgatgcaggattgtctgctatgtggaattaattcagaacttgaggaatccttgtagtgccaccttacaaatgggttggtgccttggaaacccagtcctggcatcaaggccttggcatctgtcaagcagaagtgtgcctggggtgtattgggggaggggcagtgttggagccgatttcaccgatttctgttcctggctctctattgtgcaacaacaggctcttctattccttaagacggcagcattattgccaggtccttctatttgctcataaaactcccatttacacagcagtttgcaggacacatcaaatacaaaaatggatgtgaggtttagtacagggagaccacagccataatgaatcctggcagggtttttattttggttgcatctcagaagcactttgccaagcaatgtatatgtgttgaatgaatgaatgaataaatgaatgaatgaatgccggtggactgacatggccgtatagaactgtagtcacccttcagagagaagcctctgcaatgcacctgaaaagcaatgaccatctacatgttcttccttttcttgttactatgttttaccccaccaggatgcccactgaccagaaactaaacaaaaaaactcatgttcctgaattcatcttttacttgagggtaaaagcttggggtagtgaagtgaatgttggtgccatatcatgttcaagcattttggaattatatagctctaatttagacaacagcaacaacaaagaaaagagactccatcatcagaattgataggttagtaaatttacagatcactcaaagatgttaaaacaaaaaaacaaaaaactttctaaactctcggtgttcttgggaagtagcctgctgtcgttgggctagagataccaagaagagccaaggcagcagattgtggttgaaatttaacacggtgtggcggtggtaggctggcggcacaggggctgccgtcagagataacacacagcccggagaaccagggtgtagatcagtgcatcagagccctttccaacggtcaggagaggaggcagctgccctgggggcagggaggacctctgacccacaagtcctgacctactggcaggagaaccattcctggtttgcttgctgggtctgagacatttccggagatgtgggactttcagtgttaacacccaaatagccctggggaaactaggatggttgctcacccaagctccaacttgtctatagaattatctggctttgaaagaatgtcacgtgcttttatcttgaatctaaggtcactggcatgcccctctcatccactggttattcttgatggtaagggggcggggtgggtagggtgaggggagggtgaaggggaggttcctcctgccattccttcctggagaagagaccagggcctttccaggattttggactctgacatggaaggaaaacacttaaagaccttcaggatttcgtgagaataacaagattttattttaaccataaattgtaatatttgagaaaatgcagacatattgtttctcagagcccatactaagtcagtgtggaaaacagcctttctctggaggcaaaattgcactgattaacttgaattacaaagggagcattgcttaccttaagctaagacagctcaatgagacctgctgtagcatttttattacatgtgcaattgtgcacatgtaccctagaacttaaaagtattataataataataataggaacctgaaaatctagacgtggagtgcttgcggtctctggacactcaggtctctcctcttacctcctttcacctcctctcagagcccatcgctgacatttagatcctctagaaacacaagcgtagctcagctgcatgtcagaagtgcaaaaatatttaactttaatttttttatgtatatgtctaaacttgtcttacacttaaggtccctgtattagtctgttttcacactgctaataaagacatacctgagaatgggtaatttataaaggataggggtttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggtgagatttgggtggggacacagaaccaaaccatatcagcccctttctattggtggcaacaaaatatttcattttactaactaaagattagtaatctctactgtattaaaacttacgttcattaaggttctaagtttctgatgccactcaaggattccccactcccctcctttcccaaaatgcagcccaggtgccaggagaagtgggtgtgtgtgccctgtggcatctggggagaaggggctggcctcccaaggaagcagagcttctccctcctggtcttcaggtgccaccctcatggggtccctgcctaggtgtctatggctggggttgctcatgacctgttctcaccacaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggacagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccactaacaaagtatgagaattgcttcatgtcctcaccaacattttgtgtctttaatctctataatttgagctgttctagtacatgggaaacggcatttagttctggttttaatttgcatttccccaattactcattatgttgactacctttgcaagtgcttattgaccatttgcaaagtgtctgttttaggccttttcttagacctatctctaggctgttccaggcctatttttatatttggccatgtattttttattatggatttatagaaattcttcatgtatacttgatataagtcctttgccaaataaatatattgtgaatattttctcctagtctttggcttatctctttttcattttctttctttcaaagagaagaatttcatgaaaataaatttattactaaaataaatgtataattaatgtatgagtagtgttttttgtatcctaagaaatctttgcctaacccaaggtagcagagatcgtttatgctttcttccacaagttttatagttttaggcttttatttttaagtctatattgataaacctaaaagtgtgttacttaatttttgcatgaaaatttttaagatattatatggttgttgatttctaatacccacttagttagagaatacactttgcataacatgacatagacaacagggataagcaatgggcaattattttttaaagaaattagagaaagacaaagagagtagtcttttatggttacagacatattttacctatccatggttgttaacatcttggtatctgctttccattctcaatacccaagtttccatctgatgtcatttctcttcaacctgaagaactttctttcatatatcctggtgatgaattctctcagcttcacttaactgaaaatgtctatattaccttcattttttgaatgatatattttactggacatagaatttcagcatttattatttcgttaccacaaaattttgtcatctctgacctcattgcttctgataaaaaaaccgatatgatttatatcattggccccacacaggtaatgtgcctctggctgctcaagatttttctctttctcttaatttttcaacagtttgactgtgttgtgcatgtgtgtgtgagtgtgtgtgtgccctgtgtgtgtgtgtgttcatcttcttcggagtgttttgagatccttgggtttataagttagtgcttttcatcaaatataagacattttcaattacattttctctctattcctcttctgaaattataattacacatatgttaaactatgtgatattatgccagatgtcgctgatactcttttattaaaaaatattttctatatgttcttaagattggatagcgtatattgagctctctgccagttcactgaccttttcttctgttgcctccaatctaatgttaggcttatccactgaaattttcatttctgagttctagaagctctatttgtttttgttttttgttttaccccaagttgttgctattttcttctctgattttctatctgttccttcattattaaaatattttcctttatgtccttgaacatatttataatagctactcaaaaattcttgtctactaattccaacacctagagtaccttggagtttgttgctattaactttttttttctttcgagtatgagtcacttttttctgtttctttgcatgtttataagtttttattatatactgtgttttgtggataatagatttagagattctggattctattgttttcctttggcaacatcaatcagttaattatggaatgtcaccttaaagttgcagaaccttggttttatactctttagggtaggcctatttagatttttcgttagtcttagggaggatctttaatcctgggggcatagttattactcttaggtatgaccccttcctaggattttagtgaaatgcccaagatgtttccaaacagctcttttggaaaaattgataggatttaaactccaaaatctgtctcccaatcattgagcaatgggcaattggttgaaatcattattcagctttaaaaactttagctctttccaggatttatccccctcaatttccagtcactctggcagccccaaactctgtcctctgacacctcaagcaataagatcacagctttctgcctggcggactagagagagcccttagataaaaacagggtaagcataggaagcacgggtgcagttccttctttcaaaggtcaaactccagtttctctctgccagtgctttcaattttttaaaaatattttgttcagagtttataaatcttatctgcaggaggattgggccagtggaggatactccatcatcattaaaactagaacttcttctatacccactttatggttcttaaaatgtattccaaaattgaccttcacaaagattagacattctcactggcaagaaatgagagtccctgatatcctttccccttggcagccagaatttcttagaccaaattgcatagaatgccagaaccttagaaaacaccagacccagtacttcccagctcaaggctcctgaatcccaaaagcgtttatgagggtagcacagggtcaaatggcagcttctataagttataagcactatgtatttttccaagcataaaatatacagttattcataacacaaatcttaaatgtcattacttttggttggaattacatcatagttttcctgcagacataggttttctcttgctcatcagaagcactgctttatagttaagtacatttttggtcaacctcaaatggcaaggtgtattattattattgataagtgacatgtggcttttaggacataggaacctcagaaagaaagtttattagaagaattcttggtggccctgggcactttgaatagtaatgagtgtttctggttgatgaatttagatttaatcattggatctatctttgtttataagagctgctatagctttagcttcattatttgctgaggccccaagacatgaaagcacttgcctggagtgacacagactgacaccccttgtgggttcagagatcagaaactaagatcagactttgttctgaacacagcagcatttataactgtgaaggactaattctgatacctaccatgtttcagagacaaaatataaaagggtaaacttagagaagagcactttagagaggcatccagagagaatgttgatgattggatggacatgaccttttgaaatgcctgtgatttctgttccatttcttaccccggcaagaataaaccaattggaattcaggcgaatgaattttgattgagcacagattcatcatatcttgccaggtttgtcctttatttgtctccaatgctgatgcatctggattcacatcaactccatccactacacttacaaaggcaagtgcttccccaccttctgtaatcatggaggaaatgtatggtatagggcaagcacataggtggctttttctttataactcctgtaatatccaggccaatgttacatattccttaatatatatttactgcagcaaaatttagatttatttcaccatatttttccccagaaaagccagcatccccatttacagaagcaatcacagaaacatggagaaattcattacagtcttagtgcctcagaaggacataaatcaacttttaattacctctacctggagatgcttggtgcaatgcgctgtgtgtgtgagactgaatgtgtgtgtgtgtgtgtgtgtcggagattgagtgtgtgagtgtctgagaagtgtgtgagggtgtgaggtgggtgtatgtgagattgtgtgtgagagttagctacgcatctcctctgtctcctcagagccatttcttttctaattgtgctctcagacaaccagccagctaagcagggtctggcgagtctgagacattcatgctggggtttgcatgaagcttgtctccaggaatccaggacacagtttagatttgctcagacccgtctcagcagcctggagttaggatgaccagatcctttgaaaggtaaagaagctgctgcataggaaacagaaatgagtcaatttctgggaagttgctagagtttgaatatttgtcccctccaaaacatgtgttgaaatttaattctcggtatgtcagtattgagagacagtgcctttaacaggtaactgagtcatgaaggttcttcccttatgaatcacagggttatcataggagtgggactgatgtcttcataaaaaaggaagcgagacctgagctagcaggtgagcatgctcagcccccttgccatttgatgctctgtgctgcctcaggactctatagagagtccccaccagcaagacagccctactagatgtggcccctccaccttggatttcttggcctccagaagaaaataataaatgcctggtttcgagtgctctgttatatgccacagaaaaagacagaagtggagaggcttataacccccaggatggccacaggcttatatccgttttatcctcaggggcgaacccttgcctacctgtttttccatccagccaggccagcactgtagcagagggaaaacccaagggccccgtatcctggcaatgcagccaggactagtgtccaaaaatatactgggaatggtgctgtgactacatgctgtgaatggaaacagcctgactgcagagggaggagtcaggaggggcttcccagaggacagggtggggtggggttcacccctagtgcagcctcagcaggagaatggggggttgttctctctccactgtgaacctggtgttcttcccttctctggggtctggctcttctactgagagaacaaggtgggcaacagaagtcaccaaaacctcctccagttgtgcaatgctaaccttgagagcagggccaggctgagacaaacacagaacccagcttcttgcagataagatgtgaaaagagtctgttactcattccaggtcctgtggcacttttagcagagatggatgtttccagctggggcttgccttagtttactagagacactgtaacaaaacaccttagactgggtaatttgtaggtaatagacatttatttctcagttttggaggctggaagtccaagatcaaggcacaggcagatttggcgtctggtgagggcccactctgtacttcatagatggtgccccttgctgtgtcctcacaaggtggaaggggcaagcaagctctgctgcagctgttttataagggcactaatcccatctaggaggcctccaccctcatgacttaatcatctcctaaaggcccacctcttaatactattacacttgtagttgtctcaacatatacatttcaaggggacacattcaggccttgcagggctttagatcccaccacttcatcttatcctctttcttgtcccttctcccttctcctgaagcttgaactgaaagatgcttgattttggcctctactttgtcctcattgccatttgtgacaaatgaagaaattctatgtatggtgaggacagcaccatggagccccttagactttaggcttgtccatttggctctgtggatatgagttgtattttctctacttttctttgagctctccaaataaaaacagttgataatctgaatacattgaccatgtattctagaggtatacagaaacatgtgtggactctgaagccaaactttctggtttagtcctaacttcaacacatattagaagtatgacttgggcataaattatctgggtctcagttttctcgtctgttaaaaaagacagtgatacagccaggtgcggtggctcacgcctgtaatcccagcactttgggaggctgaggagggcagatcacttgaggtcaggagtttgagaccagcctggccaacatggcaaaaccccgtctctactaaaaatacaaaaattagcccggcgtggtggctggtgcctgtaatcccagatactctggaggctgaggtgggaggcggaggttgcagtgagctgagattgccgccactgcacccaagcctgggcgacagagcaagactccatctcaaaaaaaaaaaaagaaaagaaaaaaaagacagttatataatagcaaagacatggaatcaacttaaatgcccatcaatgatagactggacaaagaaaatgtggtacatatacaccatggaatactatgaagccataaaaagaatgagatcatttcctttgcaggcacatggatggcgctagaggccattgtccttagcaaactaatgcaggaacagaaaaccaagtatcacatgttctcacttacaagtgggaacaaaatgatgacaacatatggatacttagggggaacaacacacattggggtctgttgggtgagtaggggatggaaagagggagaagatcaggaaaaataactaatgggtgctagtcttaatacctgggtgataaaataatctgtacaacaaatccccatgacataagtttacctatgtaacaaacctgcacatgtacccgtgaacttaaaataaaaatgaaaaaaaacagtgatagtacctatctcatagtattgttcttggaattatgttagccattatataattcttaaagagttcctggcatgtagaaagtactatgtaagtgacagccatcgttgcttttgtaatgattattttgcttcctttctttttgttcattgcacacttaaatttctaaaagagattccaatgtctttattattaaggtgagaggaaagcctgaatttaccttccccctcttcccagctctgcccctcacagcccccagacctttgctttgcttgctggacccaaagacacacaattctcgtccctgtgcctgggaaggggtgttgggattcagggcagatgtatttaccagactgtggtttgggcccctgtgttgtcttttaacttataaaatatctgtataattatttttcattactagccaccacattcctttgttataactgcttttttgaaaatgaatatatgcacattgtaaacaatttcaagtgaaaccccctccccatcccttgtctgatggctagtctccctcccctgagggccgacgccactgcttgccaattttgacataaggcttgaaaccaatgagtgtcaagtgactgggtgagtttgattcctcctacttgtcttggcaatcccaaacagttccaggagaagattgtttcttggagagtgggtggcaatgaaataatagcaatggtggtcaacctttattgagcaggaattgtctgccaggcacccttccaggagctttgcctgagggatctcgtgatctttgtgatgagctatcgaggcggctactgctgcgacctgggatggagatgcccaggtggaggcccagagaacggaagtgtccttctaaggcctaactaacagataggggacttccatctgctccaaggatatctagttccagagtccacactcttggaatctagaaaactccatcaggactaatttatgagcatcttagaaccactttccctgaaatttcctttctacaaacctaggaagggttttttctcccttcttcctagcaagttcttagctttttatggaataagaaaatgcacagagtggccttcatcctggacaggctcctttgatgtgagccacgaggcacctagggctgggtcatctgtggcctctgcaggtggccaccacgtgtccttgggcttccccatctgctccaggctttggtcttttaatttcaaaagcagggaaagagcaggctcacctgaaccttctccagagttctttctattactcagagtccatctagctaaacatgtttttaaaaatatttatttgcactggtgagcccatggccatggtggaagtggggacatgggtaagcaagagtccaccctgccccacggagctcacgttccgcaggagtggaacacacagcagcccggggcaaggcacctctggcctgtccctcacctgctttgcacctggttatgcttcccttactcccagtagcaagtgccccaggaaccccgtgggtgacctactcagtggtaggctgtgcctgcttgcaggagggaccagaaggctacctggggttatttctcaggcatgagccaagggtcacattataaaagctatgccagattccccatagatgatcctctatccaaaaattaggagctcttaagtcataagatgagtcaaatcttccccgttaggactcaacatagctatgttcagttttactggaaaataagtcactggaaagcactttttatggttttctaaatctctcttatgcccaaagaagtggttcagccgtggtctaaggcactgctcacttactctgattgccatcttcagcatcatcgtgatgatgataatgatgatgatgatgatgatataacaagatagtagcaataacaagagctgcctcctcccagttgtgaaattatgtttatggatatctggggctcactgttctctttaggaatgacccctgagggctcatggctcccagcccccagtactgcaggtaaagcagaaacgtgggtaccaccaccacagtcatagcttagatggggcaaagagtgctgactccagaagccgccatcatcaccgactgtgtcgaatttggaaatggggacagaaatgtacacatacccatgggctttgcagagaggccatcaaatctactgtttctttttggttgtaaaaccctgaggatctctctgcatttcttcccttcccacccccattgtttaagcctcagtttctcctttgagctacctgggattctgatgggcaggattgctctgtaagcgctaagctctgtccacaactcagccattttgtgtctctggtttgctttggatggcagttttccccttatcctgcccagatttccagtatccaagcccgttattttcttattttcttctttatgacctgtatttttccaaagattgggaagcaaaaatgtcaaggtgatagatgcatatagataggtaaaaagatgacagtcagttttaatcctcattttgcttttctgtatttccaaaatttctacaaggaacatctattgtatttgtaataagaaaaatagtctaatgaggctgggcgcggtggctcacacctgtaatcacagcactttgggaggccgagggggcggatcacgaggtcaggagattgagaccatcctggctaacacggtgaaaccccgcctctactaaaaatacaaaaaaattagccaggcgtggtggtgggcgcctgtagtcccagctactcgggaggctgaggcaggagaatggcatgaaccctggaggcagagcttgcagtgagctgagatcgcgccactgcactccagcctggacgacagagcgagactccgtctcaaaaaaaaaaaaaaaaaaaaaaaaagagaaaatagtctaatgaaaagcaagttggtgccttgaagttgagtgttttggttgaatgttggctaaggatccagtcccccagaggttagttaaaagcttttcctccagccctatgaccacgggggtaacaactcaactcctcaggccatgaaatttcagagggttatctttgtcctgagcctcagacttctgtggatccaacaagggaagggctgtccggcagtggagacttgacatctcactggctcccaatacttgcagctgcagtgtttcttgagcactactgtgtcacacacggcctgagtgcctgcccccatcttcagagaatggcacccgggtctggttggctcacctcactcaaagtggcaggaccgtctctactgcatgcattttctgtgtggtatgtttttctttctttggtagctcataaaattcccctatctgtgctgggcctcttggtctttaatcttcaacctctgctggagctgtccctatttctttttaattatgcctctttttttatggaagtttcctattaaatttttatgactatatagagctgtggatagactccaacaaaaatgaaatctttatggaatagtcatttctctccaggagcccctgatagatgttcctctgtggatagacacacatgtgtggtgggggtggggaaagtccctctggtcttggctgcagctcggcaggatgcgggagaggcagctgagctgcttattcctcagcgtgagggctgctgggagcgtggggtgcagctcagctggggggggtgggggtgacgtgggatgcagaggataagaagtaaatcttccctaggtgtaatttctttgccttggtgtctgctgaattagcactgctccctaatcccaagccatcaagctacatggctgcatatgagcggagacatgccccgttactccttattcagaaccttcatggccaggcacgttggctcatgcctgtaatcccatcactttgggaggccaagtagcagatcgcttgagcccaggagttcgagaccagcctgggcaacatagtgagacccttctctatataatataaaaattaaaaaaaaaaaaaaaagagaagaaaagaaaagaatttcctgcccaggtctgccagctgagcttgcaaaaatgttatccttggggctaacattctgtattagttcattttctcgctgctgataaagacatacctgaaactgggaacaaaaagaggtttaattggacttacagttccacatggctgtggaggcctcagaatcatggcaggagatgaagggcacttcttacatggcagtggcaagaatataatgaggaaaaagcaaaagtggaaacccctgataaacccatcagatctcgtgagacttataaactatcacgagaataacacaggaaagactggcccccgtgattcaattgcctcacccctgggtccctcccacaacacgtgggaattctgggagatacaattcaagttgagatttggatggggacacagccaaaccatatcacatcctaagtgactgtctggggtcactggaccctggcatgcttccccctgtgccagctaccagctatgtggtctgggaatggcttgggatccacagatagctctccaggggggtcacggaccagagttgctgttgcagggtgtgagtccccttgccagggagggaagggacagtcattcacttataaacagatgttgggactcacccaaattgagtgctgggcctagatcagggcaccagggatttctcattcttagtcccgtggagctgatgttcctgaaggaggaaatggagaaaactcaagaaagcttgtaaacgagtgaggtggttttagattgtggtgaatgctggggggcaaacggagaaattaagagggctgccaagggaggaggagggaggagttctcatttcaacaatgttcagggaaggctgcctgctggggcgatcctggagctgggacaggatgatgaggggcttgcatactcagatcaggggcagagccttccaggcagcaggaccaacaagtgcaaaggccctgaggtggaatgagtttgtcaagttgagaaacttgtcaagatgagcgtggctgggacagtgtaagccatggggagagtggagagacaggaggctgggtcaggcatgggagatttttaatccttgctaacttactttaaatgtctaaagacaccattttgactgctggacaaagaatggactatggaattgcattaaagtccagaggtccagtttttggaaccaccaggaaggcaacacaatgcgcctactctcaaagggatttggggaatggaagaaggtggggttattgtttcatcaggctgcttggatttagacctgttttcttaagctgcaagatctcctacaaaactggatcctcacctaagtttggaggacaactgagaagtgatagttatgtttgcctccctgcagagaataaactctcaggagaggatggagcactgcagctcttacctatgaaagttgataaggaagggagtctccaatgtgagtgtggcaactgtctactcactggaaggaacagtgatacatatcataatagggaaggaaatgaacagcatccattatgtgatggcgtctatcccatgtgttaggtcctgtaactgacaacagccgccctgaaaagtattattgcatatgagactggagaccagagaggttaagtaaattgcccaagatcacatagctactaagaggcagagctggggtttggactcacgtcggcctgactccaatgcccttgcatctgtcactcgtgcccatagccctagtcaacacccacatgctaaaggcgtcagtggtcccctctaacaaaagctgttatggcttctcagagagactggagtccatggctgggagaggcaggggtaccctgggagaaccatgtgtcatcagggttctttccaggcccttccagccacccacccatgggcataaggcctaccccagctctgcaaggtttcaaaaaaacatgcttgacacttgaacaaaaattggctccaaaacataagaagaaagctgcaaaaccataattagtaatttagatcaataaagaataaggactataaagaagagagtaggggaagtagggaaaaaaaggaacacgatgtatttattaccattgaacaatacacttaaaatggtaaagatggtaaatcatatatgtatattttacctcaataaaaaaagaattaaattaaaaaaataagcaaaacaaacgatcttattttgccttcatttatgctttctctgccctgcatctctgcctgatgctgaccccagtttctgactaataaggttttccttctgcctgaagagcttctgcaaagctgtccttaggacagatctactcgctaggaattccctcagtttttgtttgagaaaaatatttatttctgtctcactttttaaaaattaagctttgttttgttttgttttactataattatctttttgtttgtttgtttgttttgagatacggtttgactctcccacccaggctgaagttcagtggctcaaacatggctcactgcagcctcaaccatctgggcttaagcaatcctcccaactcagcctctcaagttgctggaaccagaggcacacgccaatacatcatgctattttttttttttttttttacttttgtagaggtaatgtcttgctatgttgcccaggcttgtctcaaactcctgggctcaagcgatcctcctgccttggcctcccaaagtgctgggattacaggcgtgagccaccacgcccaggccaaaattaagcttttttatctggagatcattgtaaattattctgcagttttaggaaataaatcagataatatactgtgtgccctttatccagtttcccctaaagataacatcttatatgatagtataatagcacagccagaatattggcattgatatacttttacttgtcctcattgtgtgtatgtgcacacatgcatgtgtatttatttccatgcaatcttatcccacatgtagggtctgtgtatccatcaccacagggttcctcttgctgcctttttatagccatacctccttccatcctcttctccttaacccctggcaaccaataatctgttcttcatttttataatgttgtcatttcaggaataatagactcgtggtgtgcatgtcttttttgctcagcacaattctctggagatttgtccacactgttgggcacatcattatccaatgcccccttttcttgctgagtaggactctatggagtgaatgctccacagtttatttaatcagtcaccgaccacacagagtgaggctggagagaatggcagatgagagaggggaggggtcgggacagggaaagaaaaccctctcagagatgtctcacgatatctgcagtaaaacctatactctcaaacaaaaactttcttggtggactcttttcttcttctgggaaaagaggcaacataaatggacgcagatcacctgccacatacacatgtgcatactgatatgtcccctcgtgtgctcatgtgtacacatttttgcacatgcatacacacacacacacacacacagacatgcctgtgaagaggccaaccccagtgtacagcagctgtgagggggctctgcccctcctctcctagaatggaacatacgttcttgtgaacatagagagtggcattttcttatgtcgatgtaatgtgaacaactcctggtcaccagcccccttgaccactgatgcctcttcatgggtcggtgagtgagggagacacagccatttattcctggcatcttgaattaaacttgaaattactgcccactagaaataaggcctggggcatagagtcttattattaaaatcttttgtggaaagtcacagggctccaatcaccccaaaaacattgtgtctatgggaaaatgcaccttgagttccatcttacaaatggatttgtaacagtttaggtttcatgtaagctgttcacagtatcctagtgatacatgtttatggtaaaaaatcttggagggtaaagaacaaacactgcccataattttttactgtatacacttttttttcttataaaaatgttactctattgcacatagtgttttgaatcatgccaatttttatttggcaattatataaaggcagaactttaaatatcatccccaacattctgtgcctacgcctcagagcctatgcttaaaaagagcaatcatattcatgactacgtatttaatgcaacattagaaaactaatgcagtcataacccacaagcgttttccatgccaatgacctttttgccatctggtttagtgactgcagagtatcccattacatggttgtctcacaccttggcaagcatcccttaaggatggacactaaatcatcatggggtttaatactctcatccacagaagggactcccaagccagtcctcacatatcttgctctcattactagggcagagtgttctaagaattttcctcttatgggccaccaccagagcagaccagactcactgtttccatgcctgctggctcttgctgccaccatgccctgatttcaaataaccactccatccatgagctaactgaccttagaaagatatacttttaaaatgcatatcctcccaattttcaattaaggccaaaaggagtagtagagaccaaatatatcctctttcatgaaacaaacaaaaaatggcaaaaatatgtgaatctacgaaaagatactagaactcttaagtgaatttagaaaggatacaagctgttatatcaatatttaaaaagtcaatttcatttatatgattaacaatgaacaatcagaaagtgaaatagagagtgtcatttataatagtatcagaaatataaaatacttagaataaacctgacaaaggatggggaagacctgtatactgaaaactacaaagtattcctgagaggaattaaataaaacttaaataacataccacattcatgtgttcagtctgaattacaatgtctaaagttaaacatactgaccacaccaagtgttggtgtggatgtggaggaactggaactcttatatgttgctggtaagaatgcaacatggtacctccactttggagaacagataggcagtttcttaaaagttaaacatacatttactatattactcagccattccactcctaagtatttactcaagagaaatgaaagcatttgtccacacaaacattcttacatgattgttaataacagctttattttcaatcacttgaaactgaaaatgatccaaaggtatagcaacagataaatggactgtggcatatccatataatggagtactatcaagcaataagaagaaacagacagctgggcagtggctcacatctgtaataccagcactttgggagattgaggcagatcacttgagctcaggagtttgagaccagtctgggcaacatggtgaaaccccatctctactaaaaatacaaaaaattacccaggtgtggtggcgcacacttgtaatcccagctactgggaaggctgaggcaggaaaattgcttgaacccaggaggtggaggtttcagtgagccgagatcacgccactgctctccagcctgggcaggcgacagagagagactgtgtctcaaaaaaaaaaaaaaaaaaaaaaaaaaagaaagaaagaaagaaaagaaaagaaaagaaaagaaaattagcagggtgtggaggtgcacacctgtagtcccagctactcatgaggccaaggtgggaggattacttgagcacaggaggtcaaggctgcagtgagttgtgattacattgctgcactacagcttgggtgacagagtgagactctgtctaaaaaagaaagaaaagaaagactattgatacgtgcaaggatatggatgaatctgagaacaattttgctgagcgaaagaaagcagaggaaaaaacatacaagcagcatgatttcatttacataaaatttttaaaaatgcaaactaacctatagtgacaaaaagcagaacaatgggaatttataatgttaaacacatatgtttattagaaaaaaaaagatctacagtcaatcattcaggtttccatcttaggaaactaaagaaagaggcctaatttaatttaagcctgaagcaaggaaaataagataagtaattaaaaattagaacagaaattaataaaattgtaaacaggaaaacagtagagaaaaatcataaaacaaaagctggttcttggaaaagatcaataaaattgataaacatttagtcaggccaatgaagagagaaaagacacaaattattaacattagaaacaaaagagaggtcatcacaactgatcccatagacattaaaaggttaattaagtaatacaacaaacaactttatgctcataaatataattaaggtgaagtgcaacaattccttgaaagacacaaactattaaaaccccccaaagagagtagtcttatattcgaagagattgaataatttaaaaccttccagaaaagagagcactaggctcagatagtttcactggtactttcaacagaatacttaaagaggaaataataacaattctccacaatatcttccaaaaaatagaggcagaggcattgcttccaaactcattttatgaggccagttatcttagtctgtttaggctgctgtaacagaacaccacacaaactgggtggctcataaacaatagaaatttatttttcacaattctgaaggttgggaagtccctgagcaaggcactggcagatttggtatccagtgagggcctgctctctgcttcataaatggttccttctagctgtgtcctcacatggtagaggggatgaggagtctcccttaggcctctactataagggcatttaggtctcttctacaagggatcacccattcatgagggctccgccctcatgatctaattacttcccaaaggccccacttcttaatacaatcaccttggaagttagaattccaacatatgaatttgggggaacacaaacattcagaccatagcacagtatattaccctaacactaaaacctgctaatgacattttaagaaaggaaaaactacagaccaatatctctcataatcatagatacaaaaaaatctttgaaaaaattattgaatcatattcagtaatattatataacataaccaagtgggattcattccatgtgtacaaagctggtttgacattcaaaaatcaacgtaatttaccatatcaatgggctaaagaagataaatcacatgactatatcaactgctagagaaagtatttcaaaaaaatcaatacctatctacaataaaatctctcggcaaactagaaacagagggtatttcttcaacttgataaagaacatgcacaaaaagcctgcactaaatgtcatacttattggtgagaggctgggcattttccccctaaaatcaagaataaggcaaggatgtcctctctcaccactcctatcgaacatcatactggaagtcccagctacagcaataagaaaaagaattaaaagaaagatatacagactggacaaaaagaaacaaaaatggtctttattagtagatacactgtctatgtaggaaatgccaaataatctgtgcacacaaaaaaaggtgaaaacctcattggaaaaggtgagtataacaaggacacagcatacaaagaaaatataccaaagtcaattgctttcccatatacaatgaacaattagaatttgaaatgaaatttacattaccatttacaatagcatccccccaaatcagtatttagttataaatttgacacaatctatggaaactgtaggcaaaaagctagaaaatactggcaaaataaaataatccaaataaatggcaagatagtccctgcttatctgttggaagacttggtattgttaagatgtgaagtatttataacttgatcagagcagtccaattcaaaatcccagcaggttattttttagatattgataaactgattctaaaattaatataaacaagcagaaggcctagaatagctaacacaatactaaagaagatcaaagttggagtactcagagtccttcatttcaagaattactataaagctataataatcaagatggtgtggtattggcaaaaaaaggacacataaatcaacaaatggagatgccagaaatagacccccccacacaatataataacctgacttttgacagaggcgcaaaggcaactcaatggagcaagtgaagtcttttcaccaagtggtgctggaacaattggatgttcataggctaaatgaatctggacacagaacttgcaacttacacaaaaaataactctaaatggatcataaacctaaatttaaaatgcaaatttataaaacttttagaagaaaacataagaaaaaaatttatgtgaccttgggtttggtgaggaatttttagatacacgaccaaaagcatgaaccatgaaagaaaaaaaaaatagagaagttggactttattaaaattaaaaacttctgctctatgaacgattctgttaagataatgaaaacacaagctgcagactgaaaagaaatatttgcaaaacatgaacctgataagaaacttgtatccaaaatattttaagaaatcttaaaagtcaacaaaaagaccataagtaatccaattgaaaaaatgaataaatctgaacagacacctccaaatcaccaccaaagatgatatttgtgtgtgtgtatacatatgacatatacatatgtacatatatgtatatatatatatcttacaaatgggaaataagcatgtgaaacatcatctgtcattaaagaaatgcaaatgaatacaacaatgagctttcaccacacacctattagaatggctagtatacaaaaaaccaacaataccaattgctatgagaatttagaagaataagaacccacatgcgtttctggtgggaaggcaaaatagtacagctactttaaaagatgtttggaagtttcttaaaaagttaaatattattttactgtatgaaccagcaagcatactcctagatgtttacccaactgattgaaaactacgtccacaaaatacctgcatgcaaatgtgtgtagcaacgttattcataaccaccaatatctggaaaaccaggatgtctttcagtaggtgaatagattaataaactgtagtacatgcatataaaggaatactattcagagatataaataaatgaactatcaggctatgtaaaaacatagataaaacttaaatggatattgtttactgaaaaaagcttatccatttatattatgttctagaaaaggtagaattatcgagatggtcaacggatcagtggtttccaggggcctgtagagatggaagagtagagtcagcaaagcacaagagatttttttttagaatggtaaaattattgtgtatgatactgtggtggtgaatacatgacactgcatttttcgaaacccatggaattttacatcacaaagagtgaaccttaacatatgcaaattaaaaaaataattaaagatgttgggggattccaagatggggtgctgagtatgacagaagactaactgtattacaaatgtataaaataattccactgaaggggtgggaggaaagcgtactgaccaagtggcattggaagtgagtggagactgtaagattaaggcataaggaactgtccacaaccctgtattctagtagataaagctctttcccaaaaggatataaattctgaagccactagtcacacgctctgaaatgtgaagtcactggatggaggatggtgggagccaggtttctctttgttggaggggaggctaccaacaagcaagcaggaaaggttgcagtgattcatatggcagtggttagtgttggggacatcaacgtggaatcgagttcagctcaaaatagatgcagacggatatgtacaatacacttacagatatgggttggtatatatttccttgttctgtctcctgacagggcctgaataagtgtcatcccagtagcaatgagcacacctactgtttacgtcttagtttttgatgctgttcttttttttttctttgtaacatttaataagctcaatctacatccagaataatttacatgaaaggacaatatttatttaaacagagctcagtggggtagccatggtatcatcagagtgcatccagaggaaaagagggaggaagggccgaagaagacacaatcaacggcactcccacacttttactgtttgagccacgctgccagtgaccacatagggtgctgtcttgtggaaatccaatgaggtaacaaagtgttcatacgcattgagggtcttcatgcattgcctgttcttgtaatcccatacgtgtagggtcttgtcatcagcacaactcagaataaatttccccccagaactgaacagaacttcacatacccagttaccatgacccacgagggtcatgaggcacatgccggtactgacatcccacatcttaatagtcttgtccctggatccagacagcaagaatggcccagatttaccacttttttttagtctcagagcctgttgcttcagagatggaagaatatgagctttctggagcccaggaaatgcattctaccacatgctcatgttctcggagctcagccttgcattgcattgttgctacaacccatacacgcacagtctggtcattggaacagctggctatcagagtgccatcttgatttggttgtacaatatgtacccattctctctgtcctgtgaacatcttcacacagtagccagtttgcacttcccacatttttatagttttatcccttgaggcggacactatatgatctccactggccatgatgactactgaggaaacattatggtcatggggaaccatgactatgcatggttctgatgcattcaaagtcctgaaaatcccatggtttaatggtcatagctgcagaacaggaagccagaaacttgccactgtggtcaaatgaaatgtcctgtacagagtctgtgtgtccttcctttaagagttctttcaaaatctccagtctcataatcccacaccttaattgtagcatcctctgaagcagagaccataacactgaacacaggatggaaaatgactcgaatgattggactcctgtgaccactcaatgtgtatttttctggcagaaaatacccattcttttgggtcttgtttctgaccaagaggtccacctgacgtaaattcttcttttgcttcatttagtgttgattctaattccataaacttcttttgtaatctaataacagatgtccattttttcccccaaaacaccagcctactttatttcttcattcatatctaattcagcttcctttttaaaaactgaatatgcctcttcgtagccatttgaacgaagataatctgctttagcttgatttagttcatctcattgtctctgggacagcaccatcttggctgtaatgtcaagcttatctcatatagtggtatgtccctcctttgggaaatcaaaaagctttttgatccgtggacgtataatataaatatgacactaagtgtcttccactcagcggaaaatgattcttttacaaatgaatccaactagtaaccagaagatattcaacaagtaagattcattccactctcccggccgctggattctgccaccaccccgccgctccagctctgtctgtcacaggagctgccccaacgccctgacgtcactgtgccaccactgccactgcccccaccaccgcccccactgttcttaataccatttaataaaaggaagtaagccttcctggagaaatggctgattctaggacaggcggggaatgtacaaaatgagcctggaggagcattttacagggccagaaagtaagaacgtgttcagaagaacaaacaataacacacaggtcaaggagacacagtgaccacttgaaaaagctttcaatggcctaagctggaacaatttgagcaataaagtagtattggattataaataacccaagtataaaataaatatgcatgattccatactgatttacatttatatatttatttaatcacatacatatgaataagtaaatggcagagaataggcacatctccagagtggtggaatttcaggtaatttatgtaatactgcacccccaaggaggtggagcataattccccctccttaaatatgggctgcacacagtgacttcctttcaaagtgtacagtgtggaaagggggcaggggagaaacttcacagtggagacgtacaacaaacactgcctcagccagatgatcatggtcaacatcacgagtgacgtcatgttgataggatgtgctcctgatagaatgtgatgaaagtagcactttacttctgtggtcttctcccaataatcataggagaaaacaccaggcaaatcccaatgttgggacattctacgaaatacctgactagtgttcctcaaaactgtcaaggtcatcaaaaacaaggaaagtctaagaaattgtcacagccaagagaagcctaaggagatgggacaactcagtgtaacatgatgttctatggtggaagaaggacagctgggtcaactaaggatatctgaatgaagggtgactttagttaatatgcatcaacattggccattaattgtgacaaaggtacctcattaatgtaagatagtaacaatgagagaaactgggtgtgatatctagggaaactctctggactattctcaacttttctggaaatttaaaactattctaaaataaaaagtttatttttttaaaaaggaaggcaatcccctttctcctccctctttctcctttccctctctttcctcatttctcccttttccttcctcctcttcctcctgccccctcctcttttcctttaacaataacaataatgtgtagtccattctcacactgtgataaagaactacctgcaactgggtaatttatgaaggaaagaggtttaattgacttgcagttccacaggctttacaggatgcatggctgggaggtctcaggaaacttgcaatcatggcggaagacgaaggggaagctaacacatcttcacgccggagagagagagagataagggggaagtgctacacactttcaaacagccagatctcgtgaactctatcaagagcacagcaaggcggaagtccacacccgtgattcacttacctcccactaggcccctcctccaacactgggaattgtaattcaacatgagatttgaggggggacacagagccaaaccacatcaaatggcatcacacatgtgaccagtacgttgtcgtttccagctctcttcccttgcattattctgcaggagcccttgccacagtgcagtgctggatgtggtattcttgaattcacagttgggccagggaggtgaaatgacccacctaggaggtagcagaggtgctagcagcactcccaagactcatagtgaattctcctgggcctgtccgtcaccctgttatgccacttttcagtttccctctgatcacaaatgactcagcacacagtgtaagtgctacaattttactccagaatttgacttgtattgtcctacagactgcaggtaccctcttgttgctcctttcccttgaaaaaaaatacatcatctcaaaagaacgcaaccaggagctggcaatggcactggaatcccttcctggtcacagaattgatgctcatctgccctgtgcacagcacttttacaagaaatcttatttggtcaaccccccaaatatcacagaaggacattattattatctccagtctgcagttgagaatgctgaggctagagagtggttaccactaaaagcaaaccttttctctctttcccattgcctatccaccctgactctgggctctgacccatacccacctgctcaaggtcccaggtaggagttgcccattcctttaagtatgagttcattcatacacatcaccatgtgaggcttgatgtgacctcactaacaagcaggtctcatctgccctgtgcatgtgaatgtgccttaggaagcttatcaaatcccaaaggagaaattacatcctctaggaaaagtacagtgaggtgactgtcccgtttcctttactggctctggaccacagctgagttcccacgcacgcactgtggcacacgagagtgtgggcagaggcacttctgctgagtgggatgaaacatcttaagtgctctgagggttgaaactttgaagaggttgagatctgtgagagctgaagaacctttgaatctcccttcagctctccctaccccaaccacagcccttctcttgatgtaaaacatgtgttcagatagaaaacaaatgaggcttacttctatgccagtaggactgtttggctttaagcttccccagtggttgaaaacagcaatctccgagatttgcccaaaactttaaatggaagtcactcccatgggtcacatccatggatttgtgagatagggcaggaggctgtgtctctgctacccagcggtgggagcaggagtctgtgcagcctggttgtattggggatgggcccctcgtccagttgcctatgaggataacctgcggagaagatctgatggagatacctggacttatgcagaggcgtgtttgggttaaatagaaatgcccagggtccaatagagggaaccttccaacaagtgtatgagttggcctctcacccaacgctggccacccagatgacagcttcttggacatgatgaatggcctcacttccaccagaacatcttcctgccaggccctgctgctgcttccccagctgtgtggccttggatgagtaacatggcctcttattaaagaaatggatgaaatactttctaaagaatcttccaactctgaagatctgtgacatcttgtcactgaattaataggaaatcagctccttatagatttggtctatgttaggagacaacctctgttgatgggctgaccgaatgtctgaagtgggaaggatttggggaccaaaacaggtaacaagagtagacgaacacaagaaattcaggttgaattaaccttcaacagatatttattgagtaacttctacatgtaagtcaccaaaatctgggaaggggaaatggataaaagtacgattctctctctggaaagcctatagtctaattaattgatgtattaagtaatgctgggtggaggaacaataacccaggacttgtataaacaataggaaactctgggggaagagcaaggctagaagagacattatctgggaggcaattctagagcaggtagatttcaggaacaggacaatcaaagaaaaggagagtggcattcacacatcaagtctaataatatggccttattttatggtccacctgagtactgcagaatttagccctaggtactaccaggtccaaagctgcttctttaagctacactttaagctcctgtcactagaaggggctgtcagagtgccagggattttggtaggttccgtgcagacttccctagtcctagaggacgttggagtcactggggtgtgaggacattggagagacaggaatagagttccacgctgcgatgaggagatggagcctgatgcaaagccacagggaggctggcgttgttggggtgggaggaattcccacccagtgggagagttttacattgaggactacatacctggtcagggtataaggcaaagtgggctcccactcctgacatgttcctctttaccgatgttccttgtgagcttattccccacctaggacagctaacactttaagctcttgactgtcatttatactttattcatgtgaatgagtttttagttttctcttgaaagcaagttgggatactaggaaagttgacaagagtttgagtttctatgttggttgggaaagagtgatgtctccacatgtaatttgtagagggtcccatcagtttccaaaagaggaagtgggtgtttgtcttgcttttgagacattttgggagacttagacacaatataatttctattgagaacaaagtagggttaggatttggagaaggaagacagatatttccttctctctgctaaagagatggtctggagtagaaaacttgtggactgtgtttacaattgtggagtactactcttggtaaaaacaataaagcagaatcgatgtctgtagaacagagctggaaggggcctcatggttggttttcaaggtaaactaaccacagacatcagttttccactcctcagcctttttagcatctgggttcatcttccaggaaggccataacaaagctccacaatctgaggatcttaacaactgaaattgattgcctggaagttctggaggatgaaagttcaaggtcagcttgggcagcgtaggtttcttccgggtgccatgagggagaatcattcgtgcttctggtgtttgctggcagccgctggtgttccttggctggcagaagcaccaccccaacctgtctctgcatcttcacagggcattctccctgtctgtgtgtgtgtctgaatttcccccttttataaggacaccagtcatgttggattaggggcccaccctactctagtataatctcatcttaactaattataccggcaatggtactagttccagataaggtcacatcctgaggaactgaaggttcagacttaaacacatgaatgtgggggaggagacgcaactcagcccataaccacattctttctacacagggagttcaagttagagagcccatcaaatcatgcagggaaaggagatgaaatcctctgggtccgtcactgtttgaggcagccctagacacatgctgagctattgtccccactttgccaatgcagactaagcttgtgtccatggaaaagcccagtgtgaactaagatcactggatgcccaccttggtgctgggggccggggcccacacagaagtcccaggcccaacctgaggggagcaggctataccaggccgaggatggcccccttgatttgggtgcacactcaaatgtacaaactactgcctgcaccacagagactggcccggaggtgttatcttcccagagggctgggcaaagggctatctttgaaccagctgttcccactcaggcaagagtggctttgctgggcctccacttcctccacagtaaaacgagggtgatgctctgccctgcccgacccatctagggtcaggtgaagatcaaatgggataataagatagaatgtcttttgaaagacccacacacgaaggtggcatgagggattgtctttatgactatcatgttctatgcagccctgactgttacgtgctagctggctgtctcatctcctcgaggtgtcctgcgtgcctgctgatggggatgattccaatgactaaaaggtacctggccttctccatgcccagctttacatccagtagaggctcaggccacactcgatggcagcctgcccgctgcgggcctgcttgtctgctcaaagcagaggttgacttgcacccaggttgcattccagaagtcctggcctgctttctccacatggttagcttcgagcagtgagcttgggagcagcctttctgcgagttctgccaggtgagccagcccgcaggagtagggggtatcccaggcacgcacctgtggctcaggtttctcccttgtggcccgctctctccccactgctgttttccagagcacctccatcctgcaagattgacagctcactcttggtagggaacagagtgtaggaagtgatcgtttcaaacttctcttgcagctccatctgccaaaagcccctctaccagttgccgtatttaccctggctgccaggcctctctcagctgccctaagaaaacagattaccgtccagagcaaagtcctcgtgtgtttcctttctggagatgaatcaagttctgaaagaaaggtttcctgtagcccattacaccatttcagtttgttttatctgtctccacctgcggagcagggaattaacctgctgcccagggccaggccagcgaatgcttggaaggaaagcaaagcgcacgggtgtgcgttttttgacaacagaccatggccttgttctcctcagcagagcattgtccccatgaggcccaggcccaaatctgaataggactttgtgtaactcgatctgttttccttcttggctatagtctctgtgccaaatttaactgtggtctgtatatatagtgttgtgggagggtgggggtagaccagggaaggttgggggaggggagtatatccatgcagtttttttcctgtcttcctttttttgtgcttgcctgctttgctcactgtttgctatatataactcaacatgactgtcctcgcatctccagtcattaaccctttagggataactaatgcacctctttatgtaggcccctggctgggaagcgctggcactgttggagttaacgactggcccctggaaagtgaacttccccagaagtgcttgtgaagcaattaacagggccccactcagatagtaaaaatatcccctggcttacaaacaagcagagaagcgcctccaagccaagagtcaccgctgtgccccaggcatgtagtgggcgctccctctttgaaagtcttgtatcttagactttgcagaaatgctacgaaagctggtgatgcagcaacgatttcaggggagactgaaatctattgtccaactgaaagcctgtcagagctgggcctctctcaggaggtgaaccatcccaagggtcatggaaagagctactcattgtgggcctggggtgacagtgacccatgctgggtgaacagaagcctcacttcactttgccggagggagacagtaggctgacaaactattgtggaatctcctaaaattggttgctaaagggagcttctcaccagggccagcttgcctgggctcttctttcaaagggtggagtgttgtctgccagtccccaggctcaggggatgcaagtgaaagggcttcgggctttactgttcatttcctcagaatcatagaagtgccgaaaattacaaaactgcggtctccctgcaagggactcaagatgtcttgggtcatcttaggctatatttagaatggaaaatgtgttggctctgaggaaacagggtatgtgtccttctccaagcaggatgctatgaaccttgccccataggccctcctacccatcctcacagagccctgaaactcctcctccaggaacccttccagccagtgggaagaccccacagataggacccagtttcccctgtgaatcaacttctctagcatgtcccactgcccagggctgggaaggtccagtgtgcctagtgtggcactgttttccagggctggatgcatgtttggtcctccagtgggaactctgctatcgtccctgcttcaccaggagtgatgatggggacaggcacggcagagagtggacacagggatcctggccttagggggcagtcactcatccagctcacttgtacatacgtcaccatggacacagaggttttcagtatgttaacgatttgcacagtccacatcagcatcccgttaactttctttttgtaaccctcagcatggttttaagaacctggaagtttattgcgtaactgttttgcttgtgaagttgcacatgatttctcagaaagatcaattcaaacccgccttgtcacccctctccacccaggccccacttcctgctttgctggggctggggggtcagaagtaacatagctagagacagatgtccatcatctgtgcttgtgatgacaaaaggaggtaacaggagcacagccagaccctcactccttggagccctgttgtgagccactcatggcatgcaccattctctgtcctcacaacagctcagacgggtaggaattattggattctttctctaaatgggaaaccaggggttttaggtgccttatccatggaccctgccctcacctccctcacccagtgcccccctgtgccttgctggctctatctgtgaaatttatccatggaccctgccctcaccttcctcacccagtgcctccctgtgccttgctgactctatctgtgaaatgtctcaagagtccatcctgttgtctcccatcccatgtctcccacttggcccacagtccagactcttacctgtccagactcctactccagagagacccggcaagatctttgggaaaggcacattgagccatgtccttctcccccttggaactcaacagtggcttcctgtcactctgagaacagaatgcagcctcctccctgtgcatgacaagcacctccctgaggtcacagctgtggctccctgactctgcactggtccagtccagcctcaaggccttaaatttgccactccagaaccctggtttggaccctggactctgaatacattctggtcttttcctcagggaggtcgaggcactgtcctagcttgtgacctgctcccatacctattttctcagggtggaagcagacgctccaactcccacactatgaggctggtaccattacctccaagacccaaagcctgtaggaagtatagcaggcctcacccaataccctgcagttccctcacttgctccaagtgggaggtgggtcttcacgggtccccaagatgagggccagtggctttcctctttcacaggctacagtgggagcgagtcttccaccatgggacctctggccagatctcagggctctgtggttgggggaaaatggctctcttttatggggctttaagacatgaactgacatgacatgtcctagagactatccagagagcatgtggatcactttttgctgctttagatcaccttctttaaaatcaatgcattgacatactttcagcacttaaattttcgtattctattatcgcatcatctcagaagaaaagtctttcataattaatgaatctcaggctgggttaaatatgcagtggctgcccacacaccacttactctattgcttcaaaataattggctttcacttatcaggtctactagaatgactgtcttaaaccagtcacgtggtggaagcatcaccatgtttcttgctcagaaaataccctttcaagggcttttctaggggagccggaacagtagccaattctagtgggacctttaagaaacaactttgcccaggatgatatttgagccctctaaagggccaataggggtccctctattcaactttccctccgagtcccaccaacctccccactttggttccatacagcttggattattgccctactagttcaaaactgaaagtttcaaataaaaaccaaaagacaaatgttaaatcacattgaattgataactgagacaatccgtcaagcatattttgctttcctgatttttcaaagaaaccctaatgttgcaccttccttgttgtcagtttagtacgttaacatttttttaattaaacttcagtatcattgaacaggtcatagagtgtgagcaatattgtctttgttccaaaactccaaatgtaatgaagctgccattcacaattgttttccgctgggctgcttattttaaaaaaatgattttgatgaataaaaataggtgcattttcacagcgtggggtccagcaagaatgaaaaccttacggatcacagcccggcccctgggggtgcgggaggaggtgttgtcagatgtcaattttggctgattgtttttgaggccatgagactgccattcctgtgtcccgtggtgcattttagagactgatgtcacttttttgagataaattattagagaaatgtttatagatgaatatacatttcacagtgtgccagagttgaggagtctaatgaagtttagaagggacactgggatgagggtgctgagctgcggtgcctgtggcctgtgacagacacctcctgcaccaggaggcaaggatcctgatggtcagatgctcagtccccaacaagagggggttcaaagccagtgcagccccttcctcccaccgctgggggcagcaaaggacccacagtggagattgcaaactatagcaggggctgtgctttgtgtttgttttcaatatttgagccatcatacaaaaatctagtgatttctcattctctatacaaaaaccagaagatctgggccacaaggtctgcattttccccagtatcagtctgctatggccccatattagctgcctagggcccctcactcctgctcctgctagactctgtggatatttgagtcatgaccttgcctcaaggcttattcacgtattatttatttattgttaatataggaagggtcttgctctgttgcccaggctggagtgcagtggcacaatcataactcactgcagccttgaactcctgggctcaagtgatgctcctgttaaggcatatttagatgggaggaaacatctttcttcctttagagcatctaattatcggcatggccctggacaaattatcctagagcctggagcctcaatttgctcatctctgtaaggggggtgacaatgcaacctcatagggtggttgtgagtactacatagaaaaagactccagaaggagcacagggcctccattgggagcccctcagccaacactccctccttgctgcctgcacaacctcaagagaacatggagtcctttgggatgctgaaaactttaaggaagacaactgtgcattctctgtgtaagcagtgtgcacactgtcttcctcctaaatggctagttggaggagtgaagacagactcactcagaaatgggtgattccctggctgcagtctcctctctgataacaaaggactgggcccagattagagacgaggcaggaattatgtgctgcagaaaggcggtggggacatcttgagtttgtttgtagctaatctcaaataattcaggtcttttccatttgcagcaaatctgattccctcaacacatctgtggtaaaatgttatgagtgcttgcggagaccaagtgtggaggggattttttttttccaccaccaaatccatagttaccctccaagttgtaatcttatcatatttaactggttccacataaacagatctatgtatattttcagtagtttcagctgaaacctgttaagaacagatgtgccaatggttccctggcactgatccatttaaatatattttttccacgaacaggtttttctctctccctttccttagaggggagaaaaaatatgaaagtggaaccaccattaaagtggatattacatgcttctgtgttctctgcaaccagtgtttgccattggttttccaacagcaatttggcacatgaggctgtgaacacagagtgtgcatttgatggacagtatttgctctgaggctgtgtggctgggagaatgggctgagagctctgtagttgctacctaagctagggtcagccagggttagtttttccctgctgctgctgctaagcagcccctgggcaaaggcttcagcaggccgtctgcctctttgagcctttagtttttcagttgcaaacaaaaaaaaaaggtccagggagtgggaagataaagaactcctataactcagcaacaacaacctgattagaaaatgggcaaaggacttagatagatatttctacaaagatgatatatattaataaatggccaaaaagcatgtgaaaagatgactggcatcactaatgattagagaaaagcaaataaaaactaaaatgagacatcacccccacaccgttagaatggctaatagcaataaaacggaaaatatcaagtgttggcaaggttgtggggaaattggaacccttctgcacttttggtgagaatatgaaatgctacagccactgtggaaaacaggatggcagttcttcaaaaaattacaaatagaacaaccatatgacccagaagttccacttctaggtgtgtattaaaaaaaattgaaagcaagatctcaaataaatatttgcacatccttattccaatatagcagcattgtttgccatatccaaaaggtagaaacaacccgagtgtttacagatggatgaataaacaaaatgtggtctatacatacagtggaatattattcagccttaaaaggaaaagaaacagtgctatatgctacagtatggaagaacctggaaggctttatgctaagcgactgaagccagacaaaaaaggacaaatacactatagttccacttatatgaggtacctagagtagtccactgcatagagatggaaagcagaatggtgtgctaggcacggtggctcacgcctataatcctagccctttgggaggccgaggcaggcagatcacttgaggtcaagagttcgagaccagcctggccaacatagtgaaacccctctctactaaaaatacaaaaattagccaggtgtggtggtgtgcacctgtaatcccagctactcggggggctgaggtataagaatcggttgaacccaggaggcagaagtggtggtgagctgagatcgcaccactgcactccagcctgggtgatagagactctgtctcaaaaaagaatggtggcttccaggactggggaatggagagttgtttaatgcctaagaatttcagttttgggggatgaaatgagttttggagattggtcacataacaatgtgaatgtacataacactactgaactgtacacttaaaatggttaagattgttgaaaagaagaaaataggggagagggtctaatttgtgacaccaacctcatcgatgggggagggattcaaaagagaggtgcacattcagccagacactgagcctgttgcccgtggggattatgcctaagaggaatgagataggaggggttaggttttctcagctttgaatttctttctcaagaacactcctctgtccaccttcccattgcccacacgacagagttcaccaggcctcctagctctctaccagcctatagccatctgcaggaatgtcctcactgggccctttgggccatgccctgtgtctgtgactctggggcctagcactctgacccactggcctgtgttcctctctggttggaagacagtgcaaaagggacctattccaccttcagtggcctccgagtaacccacctgctccagtctgcagatttccatctcactgactttgccctggcactgggaggggggaagtgagggctgcaggtaggagtttgatggcagatgagcctcaggggttcaatgtcagctgggagaagcaaggccacttccagactcagttctgccactgtctggcagtgaggctctgggcaaaccattttgctttgtctctggtaaaagaaggctgtgggcaggattgggctttgtaattgccaaagattccagatctttgaggggctctgtcttcctaaattctgtgcagcctgctagcctctgcaggagagtatcagggaaacttaacatgcctgtgtttcgtagtgaacaggatatctagggttgagaattactgcgaacactgttatgttgtcacgtgagctggggctccatggtgatgcaccctgggctcccagaacaatgtgaagcactgagatgccctgcacctgggcctgggtcagaatcctggtagaggggtctttggcaaggacaggagaggacctccttgggattggactcagctgagcagcaggatgcctgtttggcttgggaggtgagattagcttcctgggggcaaaaaggagccatatttgtcttaatgaggagaaaagagcaaaatcaaagcattcgttaacacttcaaagaggataaaagaacatgttcggttcacaattactgcctccctaaccaggcaagtgtatgatggagaatcctgttatcctaattcaagaggacgatgccaaaggcttctcttgctggctgagaattgttggggagctccctgcccacggagggcctgtttgccagatccccagccccctgcagacctctgatctgtgaggagctggttctagtgattcacacttgtttgtgaaaaccttgatcttcatcaagcttttaaaaaaatctcatccgtattttttcccaattattttcctgcctgctcttttttttttcaaaagtaaacactcaaaagccttcatttctataactaattctggagtttacagaagcaaaaatcaataggctcaaaactccattcctttattcacttggctcagactggcttggggcagcacctctgagcccaagccagaaattgccaaaagggggttcctgtcggaatcttggagctcatcccccaaacttgagattactgagcaagtgagcaagatgtctctgtctggtccaggaagatgtcagccccacactgcccctcccagataaagagatcaacacgggacaggtcagtctctcccattctgtctccacctttgccagtctgcttctagatccccttcatgtactcatgttgctgccctccattcactagattttcaggatctatttatatccatccaccacatccaccactctgttttccaaatattatcacaatcagcgcagtagtgcttccccccgaaagactggcagctctctgacctttcttttcagctacaaatgaaaggggacttaaaagctgtgtgtgcatgtgtgtgcacacgcctgactaatggacacactcctcatgaaaaacaggataaattacagagaatggcaaagtaatgattacagaaaggtatatgaggcagaacccattagtgagctgcattttgttcaaaaccgagatactggcaggcagaataacatgcctttgtaccagaacgcattcagctgtagcaatgactaataaagtagcgaggatctgtgcacattttcccccttttgtgcctattttcataagttaataactcaagcatgaaaattgttttaaggctgaagactggtggtaagatctggtcaaactgtgtgggaaacaacttttgttgttgttgttacttaatttagtttggctgtttttaagttagaggagtggaaatgtcaatgtcaatgtgagtcttgcaatgtgtttttgttaagcccaagagcatttgggattgcatcatacaaagcacatttttaatgactagagatcatagtttctcttcctacaggtgtatgttcctatttggtacaggttgggattgttggggagggaggaggagatggaagcaaaatcttataaatgacatcatcctgggcttacccttcttcagctagaaaattcctatcccaccagcaaatcagcccggtgagcaaacagctgccttagacaaatggggttgagtgtaggggtgaaacctgctgcaggattttagtaaattcccagagcaatggaaggaacagaaatatcatgaataattgtcatacctctcattcctacaggactcaggttttgtgagcattttcctgtccatagaaccagagaaagtctaagttaagggtaccagattttgcataactcctctttcttcttgcctcttcttttctttttattggatgagaagactttgaaagacacagaaaaacacagagaataacataaatacctgtgtagccacattctgggagtaacaactgtaatattttataatgcttactgcaatttattttttaaaaataaagtaactgaagcattactgataaagatgtatcatctcctttatctcacagacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaatgcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcaccgctaaagaaaacaaaatatgctgccactaatttgccaccaccctgtgagcatgattggatgatgtttattttgattaggagattgctccatttataaatcttcaatacatcctgtccccctaaaacggcatctgggtcttttgagggttaaaaaaaaaaaaaagtgaaattggatgagggatgagagctggacttctgtgtgtcccggggtccctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaactacccggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttcctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggtcagtcttttctattgtattcattttaatgggtgcatagccgtatctcgttgtgattttaatgtgcatctccctagtgactaataatgatgggacgcttttcatatacttgtttgtcattcataactcttccttggtgaaatgtctgtttagatattttgtccattttttttatttggattgtttgatttcttattattgagttttgggagttctttatgtattgtggatacaagttccttattaggtatatgatttgcaaatattttcttcaagcctgtagcttgttctttcattttcttaacaatgtcttttgtttttaatttcaaagaaatccaatttgtcaatattttcttttacagattatgcttttgatgtaagaaatctttgcctaacctaagtcacaacaatattctcctagaagctgtagaaatttcaatctgtaatgatcaattttgaactcgtttttatatttatttatttatttatttattctttgagatggagtctcactctgtcgcccaggctggagtgcaatggcactatcttggctcactgcaacttccacttcccaggttcaagcgattctcctgtctcagcttcctgagtagctgggattacaggtgtgtgccatcacgcctggctaattttttgtattttagtagagacggagttccaccatgttgcccaggctggtctcgaattcctgagctcaggccatccacccgcctcggcctcccaaggtgctaggattgcaggcgtgagccaccatgcccgacccagaacttatttttaaatatggtgtgaggcatggagcaaagtttacttttttacatgtgtttacccaattgttccctcaacatttgttgaaaagacatttctccactgcattgttttatgtctttgtcgaaaatcagtgtatgtttggactcttgattgttagttccattgatgtttgtcttgatttattttttggccttgaaacaacaatttattatcatctctcatgatattggaggttggccaggttcagctgggcaattcttacttgggttctctcatgcatttgcagttggatgatggctggagcagcaatctggaggctcaaggaggctgaaggccccatatgactccttcatttccatatctagcacctcagtggagtaggctggaacagctggggaatgattgagcttctaattctctccctacctcctatctatgtgtctagttttcacttcttcacagtacggcattctcaggaaagtcagacttcttagtagtggcttaccctagaatggcttttccaaaagcacatgtttcaagagacccaggcagaagctgcaaagtttcctgtgacctagcttacacatcctatagtttcttttgccatattctgtaaggaaagcaagttgctatggccagaccaggttgaaggagaagggtatgagactctacctctcgatttcaggagcattattacggagagggaaggattgttggttgcttctgtataagcaatgccaataatagaaggctccactgtcctgattaatgtagctttataacaagtctcaaaatcaagcaatgttagtccttcaactttgttcttcctttacaaagttgttttgactgtgctaggtcccttccatttacatttgaattttagaatcagtttgtcaatttctaccaaaaagaaagcccttatgaaattttgatcaagattgaattgaatttatggatcaatttaatgagaacttacaattcaaattattttaagatcaatttggtgaaaatttacaccttaaaaatattgagtcttttgacctatgaacctacttaggttttctttaatttattttagcaattacattataattctcaatgtatagatctttctatcttttatcacatttgccctattttatacgttttgacccactataaatggtatttttaaaatttcaatttccggttgttcattgcaagtatatagaaacataattgatttctgtacattagccttatattctatatttttgctaaagtcacatttttagttctagtagtctttttttcataggattttctgcatacacactcatgtcatctacaaataaagatggcttttcttctttatttccaatctcaatctcttttgtttccatttcttgctgttgcactggatagcaccttcagtacaatgttgaatttgtgagagtttctgatcttaagaggaaaacactcagtctttcaccgttaagaatgatgttacctataggcttttcatagatgttcccttagcaggttgaagaagtttccatctattcttagtttgctagactttttatcaggaacgtttgttgagttttatcaaatttttttctgcatctattgagacatgcaatcttctagtgccgtcattttacaagctcaagtgaagtgtagggcacttacctttctttacgtcctactatcctctctgtttataatataattgcttaaatattttctctgcatatatttaggatcacattagatagttataatttttacttcaactgtcaacataatttagaaaagtccagtgaagaaggaaagtctattatacataccaatatttttgcttactattatgttaatatgttaatatgttctttcttccttactgatgctccaatattccttcctttactgtttgctttttgtttagaaaacttttttttagctgttcatttatagtatgtctgctggtgacagacacttttagttttccctctcctgagaatgcctttatttccattttattcctgaaggacctgtgattggggtggggctgtggtattttaagtggtgtttggctagagtggagcggttattgcccaaagcttttctgtcttgctgggctgccactgtccagctccttaggctggagagagcaggcttttgttggggccttcttggtctcatttggaatttctgagttcagtttcttcaactatatatctgggatatacaagacagaaagaaaccagggcactctccaccatgttgttcctccagtctcaagatctctagacagtctgtcttctctccatctttcagagtcttcttgtgcatgttttttatataacatctacactttttagtggcgcttagcagaagcaatgggacaagtatgtctactgcagctttctggaagagaagctcctcatttctttttttggatacatttcaaaagaagttgcaaatatatgaccctacacatttcagtatgcatatcattaactacagctcaacattagtttatatttttctttttcttgtgtgagatgaaaactatacatacattgccgtcaggctttgcccaggcatcagaactcactagacagcagaatatacatctttgagaggaaccacagaaatgtaatgtgcatgctaaggcttttacctgaacatcaaaatggaaacatcagagtattcatattagagagcaaccttacaattgtaatggatgtggtaaggctttttaaaaaatcaaatgttcaaagacatagaatcaaccaaaatggccatcagtgatagactggataaagaaaatgtggtacatatacaccatggaatactatgcagccgtagaaagaaacgagatcatgtccgttgcagggacatggatggagctggaagccattatcctcagaaaactaacccaggaacagaaaagcaaacaccacatgttctcactcataagtgggagctgaagactgagaacacatggaaccagggagaggaacaacacacactgaggcctgccactgcaggtgggggttcaggggagggagagcatcaggaaaatagctaatgcatgtcaggcttaataagtaggtgattggctgataggtgcagcaaactgccatggcacacgtttacctatgtaacaaacctacaaatactacacatgtaccccagaactaaaagtaaaataaaagaaaacaaatttcaaaaaataaaaagaaaattctaggtacattgaaatatacaattcttacgtgcaccatttgatgagtaccacccacccctctgtcaagatacagaactcatccatcaccccacaagttccttcttcctccttcacagtctaatcccttccccagccacctcgcggggacaaacattgttttgttttgtttttttacacctcctagattagtttcatcttttctagaatgcagtatgaatagaagggatatcatgcactcttttctgtctggcttctttgtttcagcctaatgtttttcatatttagcaagttttataagtcattcgtttctgttgctgagtagtattccgttgtgtgcatataccacagcttgttgatccattcttctattgatggatatctgagctgtttccaggttttggctagtatgaataaagccaaagagagccattttaatctggggcatttaaaaaatggtgtgaataaactttcatctgaacacagggttccgtggtaataatttttgaaaatatcacctccagctctgacgtgccgagtttgtaattttcgtaaatgatataagaagtcatttcttcatccattcatttgttcactcaacccttatttagtgggcctattccctgtgccaggaatcattcaaggctcagtggggaagagaacaaatgtaagtcggcctggtgcagttgacatgctagtgagggaaaagacaaaaacatcagttagtgaatacctgttatgacggaaaagaagccaggtaagtgggtagggcattacagttggtccagaggtaggcagggtgtcattttagctctggaagtagggagaggaacttagggagatggtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagcgtgtagcatgtccctctgtctctcttcctcctgctctggtcatgtgaagatgcctgctctggctttgcattctgccatgagtaaaagtttcctgaggactccccagccatgcttcctgtacagcctgtaaaactgtgagccaattaaacctatgttctttataaattacccagtctcaggcatttccttatagcaatgtgagaataaactaatacagaaaataggtaccaagagtggggtattaccataatgatactgaaaatgtggaagcagctttagaactgggtaatgggcagaggttggaggagtttggaggactcagaagaagaagggaagatgaaggaaaatttggaactttctagagacttgttaaattgttatgaccaaaatgctggtagtgatatgaagagtaaagtctaggctgatgaagtctcagttggaaatgagggacttattggaaactggagcaaggtcacttttgttacgcattagcaagaggttggctgcattgtgcccctgctttagggatctgtggaactttgaacttgagagtcatgatttagggtatctggcagaagaaatttctaagcagcaaagcattcaagatgtagcctggctgtttctaataacctatgcttatttgcatgaacaaagaaatgatctgaaattggaacttacatttaaaagggaagcagagcatagaagtttggaaacttgcagcctggccatgtggtagaaaagaaaaacccattttcagggggaggaattcatgcaggttgcagaaatttacataactaaaaagaaggcaagtactaatagccaagacaatgggaaaaaggccctgaagtcatttcagagagcttcatggcagcccgtcccatcataggcccagaggcccaggagggaagaatagtttcaggggccagaaccagggtctctactcccctgcacagctttgggacactgtttcctgcatcccagctgctacagctccagctgtggccaagagggcccaaggtacagctctggatgctgttccagtgggtgcaagccataagccttgatgactttcacgaggtgttaagcctgtgggtgcacatagtttaaaagttgaggcttagaagcctccacctagatttcagagaatgtatggaaaaacctggatgtccaggcagaagcatgctacagggttggagccctcatggagatcctctactagagcagtgcagaggggaaatgtagggttggaccccccacacagagtcctctttagggcactacgtagtagtgctgtgagaagagggccaccattctccagaccccagaatggtagagccacaagcagcttgcaccctgtgcctggaagagccgtaggcactcaatgccagtccatgagagcagctgtgggggttgaaccttgcaaagtcacagtggccaagctgcccatggctttgggagcccaccccttgcaccagcatattctggatgtgggacatggagccaaaggataatattttggagctttaaggtttaatgactaccctgctgggttttggacttgcatggggcctgtagcccctttcttttggctgatttctcccttttggaaagggtatatttacccaatgcttataccgccattgtgtcttggaagtaactaacttcttttttattttacaggctcataggtagaaaggacttgctttgtctcagatgagactttggactttaaacttttgagttaatgctgaaatgagttaaaagactttgagggactgtagggaaggcatgattgtattttgcaatgtgagaaggacatgagatttggggaggagccagggtcagaatgatatggtttggatatgtgtccccacccaaatcttatgttgaactgtaatccctagtgttggaggtgggacctggtgggaggtgattggatcatgggggtggtttcttatggcttaacaccagcccccttggtattgccatagtaagagtaagttatcacaagatctggttgtttaaaagtgtgtagcaccttccccctctctctcttcctcctgctctggctatgtgaagatacctgctctggctttgtcttctgtcatgagtaagtttcctgaggcctccctagccatgcttcttgtatagcctgtagaactgtgagccaattaaatctcttttctttacaaattactcagtctcaggcatttctttacagcaatgtgagagtggactaatacagggaccttttaggaggaagtcataggagagttcttggagaaggtaaggttggaagaaggtacaaagaaaaaagcttatgtctttaaatcatcttcattcctgataattcagcacactttagaggcaacttccaagtcagctgttgatggtagtgaagacccaaggcccagagagggagcaactggccctagagttgcatgatgagtcttcagtggcaaggccgagattagaggtctgtactcagcattcagctattggtggacagaactcgtcctttgcttcctaagtgcggcttcagtcctgtcatggccctgcacttccccgattccctgcccactccgtccccacttcttcaggtgcttccccatgggaactggtagaatagtgttagaaagccacatccatagtatggcctcttgaggatttctggtttgtgtgactttgagcaagtcctcccctgatgttggaggattcttacccctgaagttggggaaggagtgaaatcttgatggtaggacatctgctcacatgtcctttgagacttaccacgtttgtcaccatgtatttagcacagctgcctttcatctgcaaatacagcctgggagctctttatgttttatctaattttaattcttataacaatcccatggagttgttaggtagtaaagtgctctctctgtttttacagatggaaatctggagactgagtgaggttgagtaatttgcccgaggttggcaagaggctaaagtagaattctaaaccagatctgtttgattctgatgctcttgcttttagccacaatgttttagcatctgttcaattctgaacagacggacagaatttgcagaggtcagagggaggttctagaataaagctgttctctagtttacaggacagaaatggaggtagtgatatgcctgtgccagttctgggatgtgtagctgggagggaagccttctgtggaccaccatgtaggagggagagcatagcagggtatgatgggaggagcatgggttctggaattgaaaaatcctgtgttcaaatccacactgtaccacaaatcccacgaatggaggacatttggacaaattgttgaagccctctaagcttccatttccatgtctgtaaaacgggataataatggtatctccctagagggttgctgggtaggtacaatgagatgatgcaaataaagtacttagacaataccaggctcacagtaaatgcctaataaatgctggctgttgtttttattcgctattgttttgaaaaatggcaggcactacagacatacaaagtgcagagagtggaaagacaacaatgtgttttagggccaggcagcccagagctgcccaggctggcaccctgcccagaagtgggagtgatctggcagaggccagggccttgcaggaggatttttgcagacacccaacttcctgcatcagtggggtcgagtgatctctggagtgccttccgacctggagaggtcatttcaagtctctgcaatggtagcgatggtagctccagcaagggagggaaaaggggcttccactggctcttggacactccagctgtcatttttgggaatgtgcttatctgccccagagggaaatagatgattgagaaaggaggcaaccaggggacttaggctttaccagcagtgacctactagctccggtgtgtttgcctcagacagcaggccaaggctagtgtcacggcagtttagggggtcctgcacattcactgtgccaacgagcggtattttgcaaacttattataaacagattatatttcttatcctaatgtggctgttggctacctgcccatgaattttagcctccaggagaaaaacaattgcttgagctgagtgttctgtgcttttactttccatacattactcagggctccttccagttcccccaacccttaatctctctctttctctctctctctcgctttcattctctctctctctccatctttttccttcttttcagaaagtcctctttcatcttgggcataactagaaaatctgtaagctgtgctttctgccatgcattagccaacagggtcctttcctcccaagccagggaagaaagcacaaaaagcaatgtccaggctgggcctctcagggtccacagcatcacaggcaaaggaagcaactgtctccatgcctaccaacggatccacacacatctcgctgggcagcatctctgccccaggaagcagcgcgcttactacactgggcacccagatgtctggtcttgcgtggcaggcagccactttctcccggccttttcttgtcccaaaagtcagaggggcaggccagttccagaatgggattccaggcagaccaggagactaggagtgcatgtgaacaactgcaaggggatgcgtctgtctgcctggtgtccgtgtgttcatgtgcacacctgtgcacgcgctcccccagacttacacacactcgtgaacacatgctcacacaagttcatgcacgggagtagctccaagcctctcactcagcactttgctattaatagctcacttttctaaaaaagtctgcttagccgtttgtaagaataaccaccactgcctgtgtgacagcccaggcccccgcagggaggacaggaccggccctctgctaggactgcctgactgcctgcctcacgttagaatccagagggagggccaagaggggagatgaaaacccttcctgagtggccagggcagcctccagtgcctgtgcccagggacaaggcaactcactggtaatgtctgcgggcagttggccaggcccctgagagccaagatgccaccttcttcatggtgacagcagggagcatgctccatgaaaccagaatgagcctgttctccactctggggtcctgctgtaaaagccaagaagcagagagccaagctgagcccaccaagagcttggcacgaggctgtcacccacaacttctcgctgatccaaaagacaggctctgaggctggaaattcaagtgtggtggtgctgtgacacagcacacagccaccgtgcacttgtgtccctggcagccgcaatccgggcctgagagggcccagtgtctgtgggtgtttgtatttaattgcagtggggtgagaaaggccaatggttgggttttatttcaaacctgctttgaggagaagtaacattaggtggcccagagctgtgaaatgtgtcctggtcataaatgcttcaccatcaattaacacctccagaatacctaagagttgccagcaacttcccattcaaataacctcttaaaccttcctccacaccacactgcccattccctcgcaggcagacctgcatggtttgatgacgactggtcacactgctggccctatctgtataaaagtccagacagttgggctgtgaggggaaatgcctacctcagagtagcttaagaaagaaagatattggtttacttctgaaaagctcaagaccagctgagtttaatggcatcattaaactcattagacatggggctgggaagtggctgccagcagtttggtgcacagcctgtcctctcagcagcccaggtggcaggtgtcttgggagtggcaatgatgagaccagctgctcatcctgggctggtcattgtgactcagatgtggagtgggctggttagtggttctgggccacttgtccatctctggatctggcagctccatctacacagtgtcgggctaggcatgggagcattctgggccaggagaaaggggattggatcctggatggtgggaaccgcaggtgtccccctccacgtgcctgggtccaagactgctctgctctggaccttctacgccttcagaggtacaagttgcagtgctacccttgctgaacctacaaccctgttcaagtgacaacttctctgagtctcatacgaggatattgaaagaaccttctgcacagggctgttgtgaggattaaccgtaataatacaagaatatctggcacttgcattcagcaactcaccgcttacttgttcaaccaggtaaaaaggttctgatcccagtgttgcaggacagaaagacctccccctctgtagctgcaggtgtgacccagcacagaaaaaatggcaggtgaaagacaggcaggaagagcaactaagaaggtgggaggcacctccataagatgcctgaggccatggggatgactgttcacagagctagtccctcgagcaatgtgttaaatctactgaactgtgataaagcaacttctgggtgaattttgtcctgctacaaggtgtcatggaatggcaaggtggcagatctcagaagtggatccaatggtttttttttagttaaagcagaacattcctggggatggtgtcaaactcccttccatactgttgagtctgctgatgattacactggcttctcctctttgccccatcatttcacaggttcccatcttaaagaggaagagaaaggaaggagggaacgaaggaagggagggagggagggaggaaggaaggaaggaaggaaggaaggaaggaaggaaggaaggaaggaaggaaagcgagagagggagggaagaagagagggaaggaagttatcaaacccaagctctgtgcagagcaggagacgtttccatgggacccctagaatagataggttcttgctgctctcctggtggatgaagatgcccaccagtagctgtgagagtctccccgaaggcctgattgtggctccaagttccgtaggactcactagtctttttttccctagagggtcttgccattgagaggcaggtgatgtgctgtttcagaaaacaaaattgggacatgtcctgatatgacatccatcaaatatatacagataggtgtcacagcccccgaaaaagcttatctcttctaggccacacatagctatttcctccaactgtgtcagacattacaaagtttctagcaatcaaaacaagtcaaatgccattctcaggacccgttggaggattttttgctttgttttggctttgtacggtatccataccattttccaaattcttttgtccttacatattttgtttttcttaaaaaaaaaaaaatcacctataatcccatcaccagacaaaaccactagaaagaaaccaacattttagccatgtttttctgtatataaaaaaagtgtgtgtggaatttttcataacaatattgggaccatgacatctatcacattttttattaggaaatggccttcaacaatatgcatttaacaatatgcttgatgtctgtgtaatatttcatctaacaaatatatcatgatttatttaagtattccctgattgcttgcttctaactagaaaaaacaatttttctaagtgtcaccactgggttagagtaatctcagccaatcctcctaatagcactgtgagaccagagttatgataatcttcagttaatggacaagggacatgatggtgtggaaggataaataaactacccaaagacaactagctagtgagaccagcatggacagtcaagcccagtgcatgtaatctgtgctcccctgcactgttgctcatatacttggacccttgcatacatgattttcttattcatcttgaaagagaaatgttagcttactgtttttatttgcatttatttcgttgcttttgagtttgagcatctttccatttcttatagaccatttgcatttgttttcctacaaaatgcctgttgatggcttttgcccatttttctgttagccttgtcctatgtatacacacatgtatattattagttcactatctgtcaggtaaattccccagttttcttcttgccttttaatgttgttatggtcatttaggactagaaagttttaaatcttgtatgcctatcagtattttactgtgtgactattcccattatttttatgcttagaaagttttcattcctatcaagtatagataaatgttcagttctactattttattttaattgtgcagtgggttcatttttggcattgaattaattaatctatctggatgttatcattagtttccttctgaaaaagtcagtccaggctgggtgtggtgactcacacctgtaatcccagcactttggaaggcctgagtccaggagttcaagaaccagcctgagcaacatggcaaaactgtgtctctatcaaaaatacaaaaattagctgggagtggtggcacatgcctgtgttcttagctactcaggaggataaagtgggaggattgctggggcctaggaagttgaggctgcagtgagccatgattgcacccctgcactccagcctcggtgacagagcaagaccctgactcaaaaaaaaaaaaaaaatgcagtccagatgtactggaacaagcttgtgtgggatggctacactcctttcctgttctaacacacctgttacctggatgagctcctatatccttatccaggtaccagatctgccacacctggtaccggcatgagccctgtggggaacataccagcagagacattacacttccaccgagacaaaataaagccacattgacttttagtactcatattattgactgacattaaacccatggcaactaaaatctcgttgtttttttttttttattctgggggtgagggtacaacttttagagaaagtatctctccctaagactgccaatcactctaaatttgcatctaacacttctacataactttatctaccgagtaggcagtatttaccgtctgctgtttcatcttgtagcataattttcttttatatttccaggtgtgaaaatattcaaactgacccctaattctcagctttcagagctatctgctacttcccaggtcactttggtttttaagcgctttcacatgctgttgttggacatctgggttattcccaaatcttgttttcacgtaggcagctgtcaagtcaagatagccatggccctgcctggcatgttctttaagattgcattttatttttattattttattttatttttcttggagacaagagtttcactctgttgcccaggctggagtacagtggcatgatcttggcttactgcaacagatcttgacttactgtaacctccgagtcccaagttcaaatgattctcctgcctcagcctcctgagtagctgggattacaggcaccagccactatgcctggctaatttttgtatttttagtagagatggggtttcaccatgttggccaggctggtctcgaactgctgacctcaggggatccacccagcttggcctcccaaagtgctgggattacagatgtaagccactgtgccaggctgcatttttaatactgtgtttttcttgacatatattccaactaaattcttctgggtgttgttggtttgacctcatattcggtcctattgaaatgaatttgaatcattcatgatttggttatttattgcattcattgtccttctcagcttctggttacccacacagtagacacaagtgcctttggcatcttttttcaaatctacagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatggtatgtatgtcacacacccagctcactcaatcctgaccacaaccccccactgctctgattcctgccccatcagtagcgtctgaaaggacatctccaagttcaccttcaaggacactgttaaggctgggccagtggaaggaatatgacccctggcactgtcccccttcataagacttcaaagttcatcatttcatttgggcatcattttacaatttgctaggaatccctcttatcttattttcatctggtccatattcctccgtttcaaaaacaagactatcctgaaaaactgtcagctgcttgctgaggttatttttggtatacagtacttaccagagtcacctggtcagcattaatcaccccatcatgaaagatttatggttgtttggggggtactgaacccatgttgtaccctatgttttttctgaaatattttcaatctagatggtcagtagttctagaatattccctcagggattgccatcgacaattgaccatttttataaatgttagaaatggaccgtttgcccaggagagggcttccctgtgttgagtttctgtgttgctgccaggtcatcgaagagttttcattgttaaacttgtgtagggcatccaagcaccaccttgctgtcttctcaccaggccaggggtccaccttttggaagagcatctttctaactagaagagagagacgtgaagttgaaattacttggctctgcctccttttttttttttttctcaagtttctacattttagcatctttcctgtgtaatccctttcttgtcccactcttcaaatagctttgaaaacccttctgagatcacgggcctattttcagcctctgcttggtgtgggcttttggtttcccagtgtggttctcacaggttcaggcccccccaaccccggtattgactccatgtcaacttcttatcttctgggtatgcctttctgaaagtctgagatcaccagtggtaccctgtgtggcccacactggatttttctaactatttcctctttttggtcctcactgggcttattcaggattattgacgatacatatgcagaatttggggttttctcctaatctcttttctcacttgggatctgtgtgtgttcagactccctagccccagccctccaggttaatattgtgtggcactaggacattagcctcagtttcttcaatttgatataattgtgtatgataacagaatttacctcctggagttgttatgaggattgaaggaaatagtgcttagttgtggttagtattaatattattatctacctattcctgacacactttgtggttataagtgacagaaaactacctcaaactggcttaaacacgaaaagagaatctgttgctcagagaagtttcccctaggaattaccatcaagcaacatccaaaggtagacctggctttcggcacagctgggttcacagccctggtaatgtcctcaggactcagttgtgtccatctggttcctctgacgctctgtgtggaaggaggaggtggcgcagcagcagcctccagcttggcatagccatggtggggagcaggaccccagcgcttaggtttggctcctatctcagcaaactggtgctctgccaaactgaatttggaagacttgctttcccagagaagagagcacatgagccttcctgactgcgagtgatattgctgacacaaactggacacttcctccactctgtagctaaggggcagctgggcctttcaatgcagctcttttctagcaagggagaccccaccagaattgagatgggtaaccccgagccctgtgcacaggtgcctgcttttattccctcattcatctcggtctgaacattcctgaccttgactcttgcctgcgacatcctctgcactcctccacatgctccactcagctcgctcctgagagctggtaattaatcggccttgtctttaccctctgaccccactgagcctcccagatgggtttccacacctggcaaatgaccttggagttactcctaactttgtcccacaggcctgctggattggatttaatgtttgcttgctaacttctctgactcttgacctggtctggtcacttgctgtggttgtgtgtgacacctctgtgttatacacagtgccgggcattgctttttcagcagcctggaatccactgcctcttctttccccaattcgatgtccttttgtggcactactctctcactgggcgccgtcttcatggtaaatccaggtgcttttccccctgcgtggaagtggaaagttgtccacagtgtctcctcccttgccccagggtggtcctgagctgagctgagctgagtggtcccagggggagggacagcaggctgtttgttccctgtagaggcgcttgatggtggagcgctcttgtcccagttgaacctggttctccagctcagaatccagcacccctgttgacctcacaagctccttcatagcttccaattcattcccctccctgcttgagtcagcaagggtcgttccttctgctttcaagagtcctagctcatattcctgtgctgtgctctatcttccctggctttatagatttacttgggctcttttcactcctccctctgaagttaccaattgcactttttctggtctcatgggctggcctcctgcagcatgctctgctcttcccagctttgggccagcacttcctgcttcctgccaggcccccgctgttctgaggtggatctgggctgcagtccaggagacaaaattctccactgtgacaccatctacatgcccagatgttccctccatgtacttcctctttctccttttcttttccaaactcacaaccttccagtgagagaaggaatgaaaacaccacctgtaacaccaattcctccaatttcctccccagaacttcaaagtaaacagaaatgtattgggcttagactgggacttatggatggtcagagttggaagaagccttagaaaccatcacaagcctttgctcccagggctgtctctgatcgtttggttgtggctgactgggttgtcacatctggacacaggaagaaaagtgctgggagtgattcccaatgtctgagtggatgagggaagggggagtgacagcatatgagctagttatttgcccgtcctttaacaatctgctctgtgttttacaaaatggggaaactgagtcacacatctatcaagctgtctaaggccacacaggaagtcagggcagatttgggggtagaatccaggttgtccagccttctctatcaacaacaatgacttctctttcccattggaattcactgtcataggatgtcatctaagtccacttcctgacagcatgtgtgtctcccagtctgtgatgtcatgctatactcggccacctctgtacaggacagtgtggcacgaaagggatcctgctggtgcctgtggggctggggctaatactctgggacaactttcagaatcacagttcttctaccctaggacaagagggtggtatacagccaaggaaaggtggtcctgggctctgcagccatggagctccagggtttggaaggtgccgtggaatcttactccttagtttggacttttgtcaaactgcagctggaaaaaaattagaaattgctgctccaaatggaacatactccatttcattccaaatgagaagtaaacaaatagacgggtgagcctccccaaaatgataaaactcttcacacttaagatgagaagtcagttcaagtgcagtcctggcgtgactcactggggtttgctgcaggaagataggggcgaaatgtcctcatcctgcctgtagaagccagctccttattttaaatcccatcctgcttgactatcaaagtcagacagagccttcctaaaagctgaaacacacgcacagaatgagaagtccctgcgggagcaagctcactgtggtgagaaccttgcagagcagacagctccaggggccagcggctgcctgcaaacacttgctgagcaagtccctgggagaggggcctttctcccaggccaggaacgccaaagtggggtttcctgataaggaacacagaactgctgtttcttggagagggagttcacacggactgggatccattctcaggctgggccttagtagtgggacagcatcctgttttattaaaagcctgttgctggcagggaaagccgtctgcctgctgagtgggcaggggcccaagatcgctgtgggcaattccaagccagtactgggagctgacatcaaaccaggaaagaacacgactgtttttagctgatgtagcagtacattttctttctttctttctttcttttttttttttttaatagttctattgcccggtttcactgtgtacattttgtgtgtgcaggcatgcgtgtgacatcctgtacccagctacagccgaggttcactctgagatgagcccaccccacttattctccccttctccctcctttccccacctccccctcttccccatccttcccccactgacctccccagctctaaaacccctgatagacataaagaacagagggaaacccaggctgtaacctggggttattcacagggttggggtgggtgagagaagaaaaacagacttctttgtttatcttttgagtcttgaaattctaaaaaattcattcatttccaaggaagccttaatttgtaggattccaagaaatttaaaaaaagtaaagggagattcacttcaaaagaaactaggggaaaagctgttttcttttttagctgatttgttcattattcttattttatttaaagttaggtttgttgaaggcaggcaaaggtagtcactttttcatatttgtattacattcttactttcttcctccattgccttatcagttaagagggcaaataatatttcaagagactgatagaatatgttctgcactctgctcatttcatagctctctggggaactggggtttttataaacttttataatcacattttctgctgaggttatagatgactccgagaatcttccattcatgctgtaaattaaagtgactcaaattgcttccacttttacaaattaaaaaaaaatgtacttctatacagatttttaacaattaacaaaaggccattttaacgctctggttggttgcctgtacgtgatttttctggcttttcttaaaatttggagtgaacagctcccatgtcaaatataacatgttaacttattggcttctctttaaccctgcacacaaacaataaacttttcatgtagagccagaaaatggtatatgttgtgaacttttttttttttttaaagatagagtttgtggtgataaagggatttcagaaaaaaaaaatgtagttgaaaatatgttacttcacattggaacattcaattttatcttaaggatataaatattcaattttaccacattaatctttgtactgagataagccaaaaataacgtaaactgacaattttttgctatacattctaatattttacatatttataggagttttccaagtcatgagatatcatataaggcacacaaaaaaagaatgacataaatcatgttaagtgcagtctactttttcctgagctatatctttaagacaaaagatatttaacaaattgaacttgttttttgtgggagggtccactctctggttacttaagagaaaaccagaggattatcttcgtggtgaaggaaagtgtatagaaggcagtatttttttttctgttataaagggccagggctctatccattggtgcagtgttctgccttttgtgtttttttctggttaatttaaaacattagctccaagtttttaatgtagtagtttcccgtgagtcactgggctgaaagcccatcctatctgtgtcaggcaagggtccaagacaagaaacaaggagaacacagatataagaaagctttattagtgcagctaaacattgataattaggaaagttccagttcttctatggtagtttatttgtagataaatgtagttgtaaccttttggtgccaaaggaaaaactcctcattcaagacaagggatacggaataggaagagctcaaagaaaacacagttttctgtgttacagacaagtatttacattactaatcaacttttggttcaggaaagaagtgataatctgtttagatttttaaaaggaattcaatatcctgttgactaaatgcagagcaggttcagaggaagacgactgttgaataatgcaattgattccttccaagaaagcatagggtgtagtttttattataggaagtgccatcgatagtactttttctgctttctggaaaatcacccacgaaataaaatttgttttaaacattatttttaaaacaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtaagttttctaagttttctttttgtctcccatatacgctgggctgtgctggaatcaccaacaggcacagaaaaaatgacaacaaaacaacaacaaaacccccaagaatatcctgttgtctttggccaaagttcaggaaaggggagccccaacagagacccagtaggaagctctagcccctgttttgtacaacccagggtccttgcagagagattgatctgccagcagtggcatcagcagcaatagtagcagcagcaaagccctggacagtcctggcccccagtccacaacttagacacagcacatggcctaattcacccacagaagcagccactgtgaagccctgtgtctccccagactccatccagtggcataaggagacccaggccctgcagcttcctccccatcatggaaggctgtccatctacagagtttccaaacataataagcactaaggaaacaacataacatgatatgccgaaaaaaaaaatcacaattaaatcaaaatgaaacatcaaaaaatgtccaagtaaaccacaggaaggcaagaaaaaagaaacaaaagtgtaataaacaaaaggatcaatcagagaacaaataataataaaatatcagacttagtcctaatatatcaataattatcttaaatgtaaatgttctaaatgcatccattaaaatgcagagattggcagagtgtattacaaaacatgacccagctatgtgttgtttacaagaaactcacttcaaattcaatgatataggtagactgacagcaaattgatggaaaaagatataacgtgtaaacattagtcagaaggaagcacaagtggctatgttaacatcagaaaaagcagacttcagagcaaagaaagttactataggcaaagagggaaattacataataacaaaaagaattaattcaccaagaagatgtagctctcctgttgtgatgttatgatatatgtcggctttcatccatgggtcctggctcataactcccacatcccgtgttagagtcttttgttatattgttgggggtgttaggcctcagggacaggcctctgaccttctcctgccttcctttcactctaatgttctcccacctttctgcctttctcattgtggatcttaagaccctcccatgagacagtcccaccctatatcctgggggaaggaatgctgacatcatgaagcttccataaaaagccaagaggacagggttgttaagcttccagatagctgaacatgtggaggttcctggagcgtggtgcacccagggagggcatggaagctccgtgaccctttctccatacctcaccctaggcatctcttcatctgtctcctttgcaatattttttaattataaacccgtaaacataggtaagcatttctctgagttctgagagctgctccagcaaattaatcaaacccaaagagggggtcatgggaaccccaccttgaagctggctagtcagaagttgtggaggcccagacttacaactggtgtgtgtatgggggcagtcttgggggctgaaccttcaacctgtgggatctgactctatctctgggtagatagtgtcagaactgcattggaggacacccagctggtgtccgctgctatattctagctgattttctccctagtagtcctagtagtcttgagtgtggggagacagtgggggattgatgccccaaccacaattgtggatttcttctttcagctgtcttagtttttgcttcagatatgtgaaagtctgttgtgtggttcataggtatgtagagaaaactctccctagctgtgtttttcttctgctgtcacaccatgacaacatcaacacagaagcctttcttcatatcgtataagggcacaaaaaaggaatgacataaatcatgttaagtgcagtctatttttcctgagctgttatctttaagacaaaagatattcaacaaatagaattttatttttttgcggtgtggggtatccactctctggttacttaggagaaaaccagaggattatctttatggtgagggagagtgtatagaaggcaatattttttttcttttataaaggcacagggctctatctgttggtgcagtgttctgacttttgtgttttttctggttaatttaaaacattagctgcaagtttttaatacagtagtttcccatgagtcactgggcctttcttctgtgttgatgattgtggtgtgacagtaaaagaaaaacacagttagtgagcattttctctacatacctatgaaccaaacaacagactttcacatgtctgaagcaaaaactaagacagctgaaagaagaaatccacaattgtggttgaggcatcaatccctgctgtctccctgcactcaggacttctaggactactagcaagaaaatcagcaagaatatagaaaaactcaaccacaccatcaactgacaggatctaattggcattcatagcacaatctgtccaacaacagcagaatacacatttttttaaaggtcccatgagacatttaccaagatagagcatatcctagatcataaaacaaacattaaaaagttcaagagaattgaaattatacagactatgttacctggccataataaaatcaaagtagaaatcaaggcagaaagtcaataggcaaatctccaaacccttggaaactaaacaaaaaacatttaaataatccatgcgtcaaagtggtaatctcaaaggaaattttaaaaagacaagaaaagaatgaacatgaaaatatgacatgttaaaatttgtaagattagctaaagcagtgctgagaataaaattgataggagtaaatgcttacattagaaaagaggaatgatctcaaattactaatctaagtttctacttcaagaaattagaaaagttgagcaaaataaactcaaagaaagcagaaaggaggaaataaaaaagagcagaaactaatgaacttgaaaactggaaaaagaaaaaatgaaacagaaagttgtctctttaaaagaattaataagattaataacttttagcaagaatggcaaatataaaaagagagaagacatgaatcaccaacatcagaaatgaaataggggacaccacaatagatgtctttagctataaaaagataatttaaaaactgtaatcaactttatgctcatatattcaacaagtttgaagaaatgggctaattcctcaaaaaccacaaagtactaaaacttagccaaggtgaaacagataatctgaatagctgtgtagatatttctaagaattggatttataataaaaatactccccaaaaagaaatctccaggtccagagggtttcatccaagaattttaccaaacattcaaataaaaattaatgccaattctatgtgtatcttccagaaaataggagagaagagaaaattaggaagttcccaattctctttatgaagccgtcattactctgatacccaaaccagctaaagaaagtatgcaaaaagaaagctacagatcaatatctctcatgaactttggatgtaaaaaccaccaatcaaatgtaattaatcaaaatccaacaatgtataaaaagactaaagcaccatgaccaagtgaaatttatgccaggtagacaaagctgattcaatatttgaaaagaaattaataaaatttatcatagcaacaggctaaagaagagaaaccatataatcatagcagttggcaacaaaaaattatttaacaaaattcaacacccattaatgatgaaaatagaaaatcctctcaaatacactaggaatagagggagacttcctcaacctcataaagaacatctattaaaaaactacatcagacattgtatttcatgataaagacagaatacattgccttatacaatccaaaacaaggcaaagatttctactttcatcagtcttattaaacacagtactagaagttctagccactgcaataaggcaggaaaagggaataaaggtcatgctcattggaaaataagaaatgaaactgtctccttttttaggcagcatgattatttaaatagaaaatcccccaaaaaatctatgaaaaataggttgtcctccttctgttggctacattgatcaggcaagtgctgctagttgttcttaggggttctgtttaagtgctgcaggagatggcagcacagaagctgaggcacagcttgggcatggtagaccagggggacacccaactccattactccctagctctatgcccctgaacaccttccttgatccagctgaactttggtcccctcatctgcaatggtgttgatgatagaacccagaggccataattcttgtgagtattaaatgagagcaagtgtgtagtaaatgtgtcattgtacttgctgcgggtactgctgctgttgctgcagttgtatgtgatactgtgctatttgttctgccactcccaggcactgccactggagcccttgttcagtgatcctatgacttgtcagctcagtgaattgctctgactcttactgctttcatttatgaaatggagacaataacccctctctcataggaagggtaagaccagaagagcctacactatggttggaataatatttgtatacagtgatcaagagaatgttctctgaaaccagactctctttaaatcttacctctatcacttattagttatatggctagctgttaaatgaggtcaaaagagtgtgttcttcataaaactatacagaagattaaattaattaaaacatgtacagtccttttaaaaaagatcaagtgaaacagcatacatgaaagtgctttcagcacgctgagaataacaatagcaatggctagagattatggagcactccccactgccagcaccaggggaactttgtacctacaactttttacttagtccacataaccatgaattcgtctcatttatgtagaccgggaaacaaaagcctagagaagtaatttgcccaaagacctagcttacaaagcaatagaatccaggtctggactctcgggatctgactgtgttctaatgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttctttccatcaataatctgcgttcatctttactggctgttcatgcattatctggagatacgctagttacagaaattcaaacaggcaactcttcctctttctccctagctttacactacagatccatgaagttttcttgactgtccctgcctagggtacaacaaggaaaccactatttggataattcccctgattccatggtactgtggaagtggtgggctctccatatgtcagggtattctatgtctatgaaaaggtatctcttttgagaccaagggtggacgggagtctaagagtctaccaatttttaaaataatttagctatatttaagtcaataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaaaaaagacccagagtcttttaacataaaaaacaggatgtgcaaatacaatgaaaaaacacacattataccaaggactaggaaaactacctaaatgagaaaagacaagtgacaccaacactgagatgaatcagatagtggaactgtctgacagactttaaaacagccattataaaaatgtttcagaaagcaattacaaattctcttgaaacaaatgaaggaatagaaaaatctcagtgaggaaatagaaattgtgaaagaagaaccaagtggaaattatagaattaaaaaatataacaatagaaatttaaaaaaaatcactggattctactcaatagtagaatggatatgacagaggatagaatcagtgaaattgaggaaagaacaatataaatcccccagtctgaataacagagagaaaatagactgaaaagctctaccttgaatgataactttgatcacaaactagtagtattaaccacgtggaagaggagttgctaaatcaacttaagagaacaaatagttttaggtgagtgacaaataattggaaaattaaaaagttaaatgatgtcatgtataataacatcaacatacagagaaataaatctaataaaatgtaattaaaaactataaaattattgtgaagaggcattaaaagaatccaaaatatatattcatggaataaaagacaatatttttatagtcagttctgtccaaattgacctatagagtcagtacaattttacaacaaattttagtggaattttgtttattttatttgaggaataaagtttatattttatttggaaatttaaaggactgaaacaatcttgagcaagaacatttgttaagacttattctgaagctttagcaaataagacagtgtgagatacacacaagcatagacaaatagaccaatggaacagaaaagagagtactagaaaacagaccacgcatattcagtcagttgatttatgacaaaagcaatactgccatgcaattggaataggacagataatgtttgcataaatgttgcagggtcagttggatcttcatacttaaaaaaaatgaatcttgactctacctcacaccacacacacaaatcaatcagatagaatgtagatctaaaagtgaaaggcaaaataataaaacttctaaaagataacataagagaataatttatgaccttggagtaaaatcttttcaaatgtaatacaaaatatactaagcacaaaggaaaagactgattgatgaattggacttcattaaaactaagaacttctgcccgggtgcgatggctcacacctgtattccaagcgcttggggaggccaggaagggaagatccctacaaaatatttaaaaaattagccaggtgtggtggcatacccttgtggtcccagctactcaagaggctgaggtgcaagaattgcttgagtccaggagtttgaggctgcagtgagccctgtttgcacaactgcactccaaaaataataaaaataaaatacataaaattttaaaacctaagaacttctgtttatcaaaagacaccattaagagagtgaagaagcaagcccttgagtaagagaagatatttgcaaatcataaacccaatacagggtttgtatctagaatatttaaagaatttccatgagtcattaataacccaatagaaaacatgggcaaaagatttgaacaagcacttcacaaaagaggctttgtaattttctaataaatgctagcaaggaagtgcaaattcaagtcataaggagataacctctacagagccaccagggttgtccaaaatgacagactaataatactaagtgccagagagaatatacaacaactacagctgccatcctctggctggtgtgagtgtaaattagtataaccacattggaaaactggcaggatctactacagctgagcatttgtgtatcttatgacccagaaattctacaaaaatgttcatgactctctagttatagtaaccaaagactggaaacaatccaaatttccatcaacagtggaatggataagatgtactgagcaatgaaattaaaggacctaatgcaacagacagtaacatggatgaatgtaataaacatcatgttcagtgaaagaagccagaaaaccaagagggtaccctgatgactccatttacatgaagttcaagaacagacaaagctaatcaatggggtcaggagtcaaaggtgatagttattttgggtatgtgactggtaggggtacaagtgagacttctgtggtgttggcaatgtcctacttcttgacctagtcagtgatttctctggtttgcctcctttgtgaaaattcatcagtgtgttctggttattatttgtgtgcttttctctatgtatcttttacttcagtaaagagtttactgaaaagaacatacttgggtttgcagagttgaaaacacccgcaacatcttcattgcctcacaaagactattttacatgatgtttaaaaactttagaagctaaaatgctgttctttcattctgagctgattacagattacagattagtaagaaagtaagtgggctacttgtttaaagatggtctatgttaagtaccctgatatcttcttttgaaagagaggtcagtcttcctttcagcagagcattctgttcacctgcctgcccacctacctcatggaccttacagagcttggttaccctgactctaggcctctcagctcttgtactgatcctcccagctgctctattctgatgccatgaccctgtctggagactagagaggctaggccacattcagctcttccttgtcactgtacaactcacctggtgacttggttgttttttttttttttttttttaattccatgccgatgtaccctgacatggagaactaaagacagaattatttagggatttcctctctctcattctgaaaacgtataaatagcctttgctgagttactttgttaaaataaccctgacatttttttaaatgagcaaaggggctctaacatggaaggtagatatactgaaggaaagagcccttaaagacaaagggctagtttatttcattatgagatgtccagggctttccagtcccttaattctatcaatgaaccgagtgagaggtaacaatgagctgtacattttttacaaaacctctctgcgtagtcccagtagtaggttgctgaaattatgttaaagtcaggtggggacttctagaatacccactgtaaccctcttgtttggatgacattgaggccagggaggggaaaagaacttgcaagttgagcagtaataacacagatcccacaggacagctggcagtgaccccacaacagggatttgaaaacaaagtaaggtcttgttgttcccttggttcctcttctttacttcctactatcaaagtcaggttctagaaacttccctaggaggcggcaagaggcagtctctgcctcctcccagtagcaaattggccacaggaagtcctcatttgggatggactggaggagagaggcagctgtgtggaaagggcaaaccttgaaaacacccaagtccttgattgggcttgcagaaggatgtggcaaagagtaaagatcttgagttctggaggcacaactcataggttcgaatcttttttttttctttttttttttttaaatggagtctggctttgtcgcccaggctggagtgcagtggcacgaccttggctcactataagctccgcctcccaggttcatgccattctcctgcctcaacctcccaagtagctgggactacagcgccactacgcccggctaattttttgtattttttagtagagacgggatttcactgtgttagccaggacggtctcaatctcctgacctcgtgatctgcccgcctcggcctcccagagtgcagggattacaggcataagccaccgcacacagcccgtaggttcaaatcttacctgcacctcttaacctctcagggcctcagtgtcctctacttgtgaagtagggataacagtcatattcacttcctggttttgctgtgcaaaatgaatagcatgtgatgctgaggcactgtaagtcgtgaggatcacccgctttaggagccattcttccaaaatcttaagtgagtgaaaaagaagcagagatagctttttgtatttgcgcatggaggcagagttcatctgttgcctgagctaacagtatactattagtgaaactctggccccagggcaggaccaactaactaggtagggcagtgatgaaaaagggagagtcttctcagtggagtctggtctgggtagagatgtcaaaggcaaaccatcacctccttgacttgttggctctaggtgatgatgctaacctgacctggagggatagcccttctatggggtgggcaggggcagccagaggtgttctgaaaaccagagaagtctcctcactggaaaacatttattcctgggatctgtcagttgatggcagaaatgttcattgttaaagagccatttctttggcttattaattggtcctctgttagccagtcaacaatactgtacccagcacagatatccttgagaaatgaaggagaaataaagtctttcctagataagcaaaaactgatggaatttatcatcactagactgaccctacaataaatgcttaagagagtcctacatctggaagcaaaagggctatattcaccatcatgaaaacccaaaagtataaaactcattggtaaagcagacacacaaataagaaagagaatggaaccacatgttatcattacagaaaaccaccaaactgcaaagataaacaaaggaaagaaagaaagaaaggaaggaagaaaggaaggaagaaaaaggattatttaaaattatcagaaaacaattaaaatgacaggaataagacctcacctatcaataacaacttttttaaatggcttaaatttcccagttaaaagatatagactggctgaatggattttaaaagtgacctaactctatgctacctacaagaaactaatttcacctgtggagacacacatagacagaaactgaagggatgaaaaaagatattgcatgcaaaaaaaaaaaaaacccaaaagtgtgcaggagtagcaatacttacagcagacaaaatagattttaagtcataaaacatagagaaaaagaggtaattatataatgataaagggatcatttgagtaagaggataaaacaattataaatatacatatactcaacactggagcacccagatataaaaagaaaatataattagagctaaagagagatagatgcttatacaatcatagtttgggactttaaaactcaattttcagctttggagagatcatctagacagaaaatcaacaaggaaacattagacttatactgcactagagactaaatgaagctaatagacatttacagaacatttcatccagtagctgcagaatcacatgcttccctcttcagtacatgaaacattctctaagatagaccatatgttaggccacaaaacaagcctcaacaaatttttaataattgaaatcatatcaaatatgttctcagaccacaatcgaataaaaccagaaatcgatgacaaaaggaactttgaaaactgtacaaatccatggaaattaaacaacgtgctcctgaatggtcaatgggtgaatgaagaaattaagaaggaggtcaaaaaagttctcaaaacaagtgaaaatagagctgcaacataccaaaaccaccagcattttttttttttagcaataatctatttttaaatcaggtgtatatattttttagacataatgctattacatgcttatgggctacagtatggtataagcataacttttatagtcactaggaaaccaaaaaatttatgtgactcactttattgcaatattcactttattgcagtggtgtggaaccaaactggcaatatctcagaggtatgcctatagttaacaagaatatattgcatatgttcacaaagctggaagagaagattttgaatattctcagcatgaaaaaatgatatatctttaggtgacgtatttcctaattatcctgatttgatcattatatgcatgtactgaaatatcactctgtgcaccataaatatgcgcaattattttgtgtcaactaaaaataaaaggaaaaataaaaggcagagccctctgggaggagaagactaattaggcttagtgattgctaattctgggagctgcatgcaagcaggttttaaagaaggcagaaaacttaaggatgtggatgtaaaaggaagttacaatgacaacacaatttacagaaatcactcagtcacctggaggactccaatttcaaatgtgccatgcttggatatttgcttacattttgcacaatgacttttctgccatctcctgtgaacctctgagcaatcctgtaaagcagggatcatgcccattttccagatgaggaaacagagtgcccatgccctgcccatggttccagaatgcagaacagtcatccttgggagatgggggtgtctggtccgagtacctccagtctcacctctgctttgtgtcgcaggtggggaggggtcactgaagacaaaggctccttgtggctataggaagggtctgcccaccaggagaggtgggaggggaggagtcttattcaggctgccaaggttaagcctggttaaccacttagacccagagttaactagcaaggggcacaggtacctgcctcagagcatttgtctctgcctggagtgtttgactagaggtcctgagagcctggaccctccgacgctcaggtctcagctgccacattcccaaaggtcatgatcatcctagaccactcaggtgctctttgttcttcaccctgcttaatttttgttaggagtgcttctgatggcttctggtccatagcctgcctctgtctctgccctgccaactccgtgctctgtctcaacgttgcacctgaaactgtgcctgccatggggtgggtattcagtagccaactgatgaatgaatcaatgaataaatgagcagataaatgaatgggcaggaaagctcctcctgtcactctctacactaacatgtaggaagtgttggagggacacacgttagtggatgtcggtcacttagtcctgataaaacagagtagatggttttcttagtaggagatcttgagggctcttctgtgaagcctcttgtggaaccagtgaagtacctgaaaggcaaggattgggcaaatcaattccttctggttgtggaggagaagcccttctagggttgatgttaatgctgcattttaatgaaagtgacttttcaggcttataattggatgacatcagctctatttctgcttttgcttctagaatttagtgtgattctattttaagagactaagaagaaaaagcaatttttagactctcataagaatactagcaacaatggcaatagctaatgtctctgcagcacttagaaaagactgtgccccctgccaagagcttgacctgggctatctcgttgaatccttgcaacacacagccccttgtatagatgagaaaactaaggcctgagccagctggccactcatccgtcacagcctcctttcctttccagtgttggggacagctcacagtgggctgtaggatgccactgggcatcagcctggcaaggtagcaggtcatctcatttttcttttttctggagggtgaggttatcctgcaaaatggaggtcatggggcctcctgccctggaatttctgcctcatccctgacatcttggatgttatcccaggctgctctggtccagttctggcttcattttctcaacatatcagatgcaagagaggcctggcctgctagctcctgtctccctgctctgctgcattccctccccacgcggtgcaggtactgactcgttctcaaaactgtcagatgggctgccacctacctgggagtttcatgacatgtcctgggatcctactacgccagaggctcaatgcctggcagagtgaacacttagtaagctgcagttgccctgaaatattttcctgttgctgattcatttcctcatctgtggataccatattccaaacttgctgtgccaccctctgaaggggcaagttctttcctaggagtagataccaagagagaggaagcccatgtcatggggacaaccacacaggccaaacacaggtgtcactgcctgcagggacagcctgcaggcatcaggcctcccaggagatagcaggcaggacaggaccatttcagactcatttcagcagtgtgtggacagaaccccactgagaaatgcaagcatgagacctggagtctattcctgtcttgtcctggggttccttccactggatgctcatcaggggaaatcctccctctggatgctgatgtggggaaaatggccaactagttttaaccttaaactcatccaaaacttattttctctccacttgagatagttgtcaggagatctgagttctcaccttccttctgctcttcccttgtatgtgaccttaggcaagttgcttaatccctctgagactcagtttcctctcttgtagctgcaggatgatggctgggctctattctagatcagtgagactcaaacctgccctgtggcatcagtcaggaacagttttgccgagtaggctccagtccagaccaatacatcacgatctgtgggagtgaggcccaggcgattcccaagcactggaagggttggaaattcaggcatatggtttctgccttaaattccatctatgaaagccgaagcgctctctttaccaccaccacctctccttcccacccttgtcttgtttgctgctgatttctcgcctgactcaagaacaaatgtgtttaagccccaagcccctaaaaatgggaagctgtctatttcccttctgtaccagctcccacatgtgtctggacacagactctgccagggaagtcccctcccatagggaccgtgtgcctccagagttgtgtggacaggacttgaagacatccaaagcccccacaagagatgatgacaacaaaactctgtgttaaagagtttccaggatggagaactcctgcctgtcaattatccttctcagacactgattttgtttgtttgttttctggctagagacgattattccacacaggaatgacagacagtccctctgttctttgtctgctggtcctgggggcctcttgcgtcagtgggaatggaaagtatcaactttcttatttctccatgttccctcttgccttgcatctttcttcctgctttcatttctaatttcttgggccctttgactttctcttcatctccctcttcattcttcacacaataatgtttatttaattttggatgttctcttctggccaaaagttgacttggtccagaccaaatggaaatatatgtgattaaatctgttctctgcggagagggactaaaacaaagatcaatgccagatattgtcgtgatgatgaaatgtcagggcagagggcaccaggaaggacagaccaggctcacagaagcgtgccattctttcacagcacatgcagcacacaatatgcagaggcatgacattccaaccttctccaacccaccgtttatcagtgtgtcccctggactggtagtatcagcatcacctgagacttattagaaacacaaattctcaggctccatcccagaccaactgaatcagaaacactgggggtggggtccagaaatctgttttcacaagccccagaagactctgatgcatgtggaagtttgagcaccactgcttctagtgcgtagacgttttgcttgctatcattgaaaactcgcttgacctctttggagaggggcatggcggcccccagatatctgaggaaggctgagcaggaggataaggtgagctgaggaaaagggagggagcaatggggtattcacggcaggggagcctgagatggtcccttaaggatttgcattggttaatgggcagactggtgcaaaagaggctgaattgaataattaggaaactgggagaattcaattcaaagaagaattcttgttcgcaaggtcaatttttatactatttaaataaaataactctggtaggttctatagcaaatgctaagtaaagtaaccgctggtttctaaattattacgataatctgagaaaattatttctttgaaaatattatagaactttcaaatatgcaaaaaactctagagagtaatataacaaatgcacttaatagggacaacctttaacattcagtagagaacattttactctattggcttcagatcttgttttgactgcagcttgattcccacagtcctctctcatccccacccatcgtgggtcctcagcctcatctcaccaccctgagttgggtatagaatttcctgtccaggtgtttagaattctatacatttatctaaaagcaatatagggtatcatgtgttgggttttatatgctgatgtaaaaggagttgttctgcaatttgctttcttctctccatgttattgagctctatcctgttgctacctgtggacgtaactcgttctcattgctgggtggtatctatcttatggtccctttctcatcatcatgagcatttaagtgaagatcgtcttcaggatttccatgtgctcatgtgggagagtaagtcctgaaagtggaacatcacctgtaaatatattaaagacagggttttccaatttaactgggaaagtctccagactcagctggagctacattatctgtttctctaagaaagaatttttctgtccataaactcattgtattagtccattcttgcactgctataaagaaatacctgagactgggtcatttacaaagaaaagaggtttacttggctcacggttctgcaggctgtagagcaagcgtagtggattctgcttctggggaggcctcagaaagcttccaatcatggcagaaagcaagggggaacaggtgtcttacatagcaggagcaggagcaagagagagtgagaggggagatgcttcacacttttaaagaccagatcttgagagaactcagtaccatgagaacaacaccaagagggtagtgctaaactattcatgagaaatccacccccatgatccaaccacctcccaccaggccccacctccaacactagggactacggtttgacaagagatttggtggggacgcaaatccaaaccctatcactcatttttttctcccttcaatcattcaaccaacaattgctgagcaactcctgtaggtcaggcactgtactgggggctgggaaccagtgggaataaatcctatgggtctctgcccttgtggagattccagagtagggctgcccggatgttcttgcattgtgcacagtgcagagacaggaggctcctggatattctggcctaggcaactctaaccctgaaaaatgaacaagcccatcacattctattcatgtggttatagtttacctgaaacctcaactgctccacagaatcagatctctccgcagctcccaaaagtgtcccaagggttagcactgaccagcttgctgggtttgaaggaaccacaatgcatcgggtgtggctctcttcctgctagctgctccgaagtgagctcctactgattctattcagttggacgctcacattcagcgagtccagggggtttttcatgctttgagcatttttaagagtctgctatttgcccagttcagtgaggggcactcaggatgtatcagtggttcaggctgacttggttcctgcctaggggaagacccacaagaccagtacccaatgcagggatggcatggatggtaggggaggcttggaggccctaacccactcttgaagggatgacagaagcctcccaggctgggattggaaggatgaaaggagcagacaggccagggtagagggcattgagtcccagtttgagcgaagggctggagcaagagagagcctggtctctgcaaagatctgaaagaacctcagagcaggggccaaagggtaagggtgtcagggcagaggctgtgccaaaagaggtgagcctcatcctaaactctgttcttgatttggggtggaagtgtccctggaaaggcagatcaacaaaggaaggagcatgagccaattctcaccacacctcttgtgcttcaagtcctctcttgggttgggtgatgtcatacagggacccacacttgattggactgccctccccaccttttaaacctctcctgtcactgagggggtacaccactggagcctggcaaaggtagccagtactcagggggtgtgcacaaacctcacacccatgtttataaggccattacaaatgctggcccagttggtgaccagacaccaatccttgtccttccacgtagccaacagtgggctagttggcaggtgcatggcaggcgctcagggctatagacaatgcaggctttaatcccatgagtggagtcggtgccaagtctagaattcaaggatgactcttcacccaactgaccctcttacccaacaaaccaatgagaacagcttgaggtctggaggacccgtgcttgatatctgtccactcttgtatttgagtaaggtagtggaggtcacaggctcacatcataaactttgtactttatttgaaacacttttctggctctgttagtgactccaacaccatacttaagcttacttcaaaatgacttatacatctctattttccttaaagtatgcgcacagataagaaaagatggggtgaattttttttttttttttgagaaggggtcttgctctgtcacccaggctagagtgcagtggtgcgatctcagttcactgcaacttccgcctcccgggttcaagcaattctcccacctcagcctccgaagtagccaggattacaggggcgtgccaccacacctggctattttttgcatttttagtagagatggggtttcactgtgttggccaggctggtcctgaactcctgacctcaggtgatccacctgcctcggcctcccaaagtgctgggattacaggcgtgagccacgtcgcccggccaagatggggtaattttgatgtccagacacaagttgtcatttaagatgaagcttcgattgtaactctatgaagccctgctgaatattaaaagcttatagaaagcagcttttctcccccaggcaaaaagagccctttgatctgtggtgggactttgcaaaaagctgagctgccactcaaagaaataattccccgctaactgcaagtttctgtcttgtttatggagggcctgttgagaaggccctccaaacctttggttccagggtctggcaaggggaatctgtcatcattcattgcaaactacacctccacccactgggctgaagacctgtgcaaggatagaccaagaacttcctctggggtggctgtgctcatggatgctgatttgacaatttccaacctccctcattaccaagatccccttccttcacctgtgaaaccaaaattccatcttcttctcttccctcctttgtgacagagtggggaaagatggggactgagggaaaggagagtagaaactcagtcccttgagagatgggagctgatgggaaggaggtagaaacttggtcctttagccaggaggctctgcaggcattcaggcctgatctaccatgtaaggtgatttctttctttttggaaagctcccatttcatggggtggacaggtccaaggactgctctggaccacttggtgatcacatgggccgaagtaggggtagaggaccccaaattgaatgtgtggaggggactctgaagcaggtgtgaatgccaggagaggtgggaggaaggacaagggcggtgcatcaagaccacagaagccggcccggccagccttcccacaaagttacttgaactgagctctccataagtacacatgcacacacacccaagaataaactggacaaatggcagcagaaagagaaagaacagaaaagagagctgatgaatacatccataatcagcactaacacagccctggaaagaaaagcaaaaagaaaaggcaagcgctgtggtgtgcagctcttattgtctaataaaagaaaatataccaattctttggggaatttaattttttctggaaataaattcttggaagaatttatgtgacagaacaccccaggggaacatccttgcgttaggaaggaggccacctcgtctggcggcctcgggcattccagtgatgcaggggaggggcccaggcagctgtgctggtccaaggggctccaggtagaatgagctgtatccttggccagaggatgttgcgcatcctctggggggatatgacgggagaatgatggggggagttggggagatgtccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggtggaacaaggctggaaaactggtgcatggaggaaagaaaaaaaatgggaagggagaatggacaggtaggaaggaaggaaaggaggaaagggaaatggaggaagaaagacatggaaagctgggaggacagagggcaaggcagaaggtaaaggaggcaaggccaaggctgtgaggaggaattccgcttttattctgctgtctggcttcatgccattgcatggggccctgtaaaataaaaaatgatacctcccagggctattggtttttatcttagaggactctgtggggagatgtggaaagctgttcaagtggcaaggcttgggagctgagtttcatgacgatggccgtctagggctgttcaaagttaagatgacagattggcagagtgcagggaggtgagagagtattggggaagttttccatacaggggaccatgtagtgttttgctgggaagatagacctgggtggaggtgagactggtgggtgccacagatgattctaactcctgctccttctcttgtccttccaacaaaccaaccacacatgtaacatagtcataagagcttgcagggaggagaaaagagagatatcaacagaccaagggagacagagggtggagggccatgctgtggacagtgaggggaggaggtccttcctctccgccactgccctcaaggctgcttgaggctcccacgctgaggtgtccacctggctgagaggctgctgcttatctgttccccaacttctccacctgctggtgcagctctcccttgctgtgctaggagagaacccactgggagggtcttggcatctccaagtggggccctcctgctgagacactgggtggctgtggagggagctcagccctcattcctccccgagctcatatctacagagcagcaagtctccccactccaccagaggagagcacaggagagctaggcagctgcctccaccaagacttcacccaaccacggtccttcactcccaccaggacaggacaacccagcctcccgggtcccaggaggacttggcatggctgaggacacccaagaggaaccaccagcctatccctgaaaaagcaaagacactttggggaacagaagagcgtcttaaaagatatcaactttgactcagagatttcaagaagacgctctatccaaaaaccaaagaagaagtgtcaaagctgttgtaaatgtttaaaagaatagccaccttgattgcattttgagtgaattgtgaattccctctccctgggtcttcctcattcttctacatcctccccatttctgtactgaatttatagcagactgaatttggaagttgatttgaatgtttaaatatatgagacactctttgttactttggaatgagtaaggcattaattcttttacgttttgatttttaaaggttttatagaaaattgcatgtttcatcaggaaaaaagttatctagttctactcaaaataatatcttatggaaactttcagagtttcaccagacaaaatgccccaggctttggctttgcagttggtgtctacagctgagcctagtccttgaagtaatcatgactcagcttattcaaaataaactcttcaagaattgcaaactctcctctcagcacatgccctgtgacctccatgtccctccattacatctcctcagagtaaggcccaatgccactgactcatgggggaaccacaggcagcaaatggccagagctcacacagagggatgagtgcacttcacctgcagtgtgactcagcaggccaacagatgctatcagggaagagcactaaaaaccaaagggtggctggctgcgtctcagcatctgtccgcgagaaacacgatgccatggttattgtgtgattttggtggtaggctgctggtcaggtgtctccaagcaagttggtcaaaatgggaacagttgtttctctgggcgggcaggggtcaaggctggtctggaaaaggccgaggcagctgcaccctcttgagccactggccagcacctgtgccctgtctggggctttcctctgcccacaggagacccttctccatgcaggtgctgcgtggcaccaggcatgagtctgaagttccttctgccacaagcaccctcgttatttgtgatagtgcaaaaaaggaagtctctgccaagaaactaactgaatgttagtgcctgttctcaggactttccataaccctgctctactaggatacctttcacccactttgaaagcagccaaagggttaagtcatcccaggtgcatctcaaagcagggctgcgagcagcaggagtttgagctttgttgcaattagaagttgagtgtgagaaaggacattcaggcacagcttatctttgaatacacacgcaggagtatcaggagcagttagagataaacagctggctaataaacacatgaaaagatgctcagcatcattggtcattagggacaggcaaatcaaaaccacaatgagactctacttgactcccattaggatggcgacaatacaaacaaacaaacaaaaaagaaggtaatcagtgtggatgaggatgtggaaaagttggaaacttcagacattgccgttgagaatggaaaatgatacagctgttttggaaaacagtttaatgtttccttaaaaagttgaatagagaattagcatatgacccagcaattccatttttatgtttgtaccccaaagaattgaaagcaaggactccaatagagactagtataccaatatttattgcagcattattcacaatagcttaaaaaaagtgtaaacaacccaagtttctgttggcagataaacaaaatgtggtatgtacacacaatggaatactattcagccataaaaaggaatcaagttcttatatatgctacaacgtggatgaaccttgaaaacatgctaagtgaaataagccaggtacaaaaggacgaatattgtataaaaacacgtatataaggtacctagattagtcaaactgattgagacagaaactagaatcgaggttgccaggggctggggagaggggagaatggggagttattggttaacaggtacggagtttcagtttgaggtgatgaaaaacgttttggaaatagtggtgctggttgtacaacattgtgaatgtacttaatgccactgcattgtatacttaaaataactgggttaggggcatttatggattttcctctcattgtaggtcactaagaacatggtgggaggaggagccactgcctttataggccccgactgccccagagcttcattcctcaccaggatgaatgacaggattctggactagagggctcttgcctgagccaccagggcatccgggggatccctgtgagcagggtgagggtgagcacccaggttccacagggctctgtcctgggcaggccagcagatgcagtgattgcaaatcctccttgtacaaatggaacaggcacgtgcatttgtggcacactcagagctgctggccactagtgtgctttggagaatcagttgtctcccaggcggggaaggtccctcagacataaaatactcacccatttagaggaatgacaacagcaaaggaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccatctctacaaaaaatgaaacaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctcttttttaaaaaaagaaagagaaaacgaaaagaaaaaaaaaaacacacgatttcacctgcttgaaggcctgtgcttctctttgttgtccccatgacactatacccaggccactgtcagggaccctggggggcttacagtggcttactgaaggctagacagtatccccttgcagtatcagttaggattctatcatcatgagaaagaggctccagcccgctcaacggagcaaactggaaggtaatgaggggctcagggaatttgtcctgggaaggcaggaagcacaaccctgtcttatggcagaggccatcagtccagggtcccagctggacctgctgatcctctgtccctgtctcactcattgcagatgccacctcttcggtgagggcctgtgagctagggttaggtcacctaccctaccctgtgtgaccacaggcagggagagacaggatttcacttcctagacttccacggtggaggccaggcacctaagattattctcccacccacaccaaacacagtgggggaaaactcatccccaaaaggaaactggggccaataggcaggggtggatgtggggcagcccaaaaaccaacacacagccaccgaccccatcagccatgatttatatccatgcctttcctggacaaaaaaccaaatcccactgccctgggcatcagcgggcagggcccacacaggcttcatagatgtctcctctccgggaagtggagggtgtgtttgtgcattcggagtagctggtgcctggtagaaaatcagtgcggttttggctttggcagagcagcccaggctccctttgcattcccacaaatcgaggcagctctgctgtgctactctcacagttttggcggctttgaccgcaggtcctcctgaggccgggagactgctggggcgtggtatatcagttgttgggggccgtgcttccccagggcagatgcatgcaggggctctggggcagagtgaccgtggaagttcgatgatgtcaccccttctcatgcagctgatcgttgggtcaggaaacgactctcctggcatgaacctgttcctggtctcagcaacccgcacattgtgctggtgccaggtcaaaggcagggcaggaagccaagggatggggcaggcccagggggcagagaagggcaggtgggtgggatgtcgggggcaggtgagggtagagcatgtgtatttacccaggcaagggtccggccaggctcgcaatcagaagagggagagaagaccctgactccaagccaaacccttcaccgagggaaatgcaccagcactcagagggttcttgtttagtaggtgagcaagcagccaagcattggccttccccagggcaggggcataaggccggtgagcagctgagccaggatttgaacagcagtcacccttggtgaggcagaagcagatgaggctatgaatggggatggctaaggaaaggtgggcttgcttgcactggggagaggccttactggggattcagaattgagggctggggtttgcttccccagggggtaatggtttcagctgcctgagtttttatctcaccccttcttacctcctcctgcaatgactgaccaacttccacttcaaagagatctttgattatgactccatgacatcagtaagctttcaagtcagtgaatttaccttctaatggtgattggaactcaaagccagttcacagcttgacctgcatacatcaagcagctgggtgactgtcagatgtgtcatctcatgtgggaggagaatttgttaaagtagggagagaggacctcaggaagaggcctcttgaaagtctgtgggtgcctgaggctggaggccacacctggcctctggccttcaggacaatcctcaaaaagggattaggattagcccacctggttctcagttggctgattggttaaaaacgtgaacaccaaatattaatttgcttttgtttttatcaagcgattctatttggggtgggatgggggagaacgagaaacattttaaaagttagagtaaaaacccagcgctacattgccaatttcaagatgaagtaataaagaactacctgggagggagaagcatttctgatgaagttaactttgcaaactgagcattatgcatttttcactcttggtggttaatattgggaaagtgtctggtggtccttggggtttagggtgctgtctaaaacctagagctgcctggttgtggccagtttttgtttttaaccacgaattaagcttggatcattcagaacagactgacttactcatcagggatgcaaactccacacgcccaaagcagtctcgagtcttcagtcctgggtctcggcttctttctgtgtttcgcaggcactcacgcccccgtgggctcggttctccaaacaagcccttatggaaaccaggccagatgtagggattaaagttcccgaatttcagcaaagttaaataataatagtagacacaaaacaaccaaccaacaccaaaagacataggtgcaaactatgctaatcccagcagtggagaggaacaggcctttgatgatgatggccctgatggatggaggacaatggaatgctctaaacacgaggcctcaggggacagccccggtcctccttgtcagagcctgctctagtttgggatccagcaggaacctcaggagcctccttcactttggtggagaggactgagactcagagcccccaagcacaccttgggacggtccccacgcttccctagggtgggtctggggcaggcctggggcatttctatactgctgtttgggagagcgccccagacctagtgtcctggctggggcagatgaagccagggcgctctggctggtagaggcaggaggggaggccagccaggccccgcatgaccccgcattgacaggaaggagaacggacactttctttcaaggtgctcaaatgtcccacatcacttctgtgaaaacccaaacacagaagccacccctctcagctgctacaggccagaaatgaaaattactgcaatccccaggagccagggaagacctctgctgacattccctatgaccactgtgacggtgccgccttgggctgcctcccccactccgtacagagagcgttccagccccaggctcccagtgcctgctcccagcgcctgctccccggcctccatcactccatgccccagggacctaaagtagaaagcttagttttctccttgtttgagtgcagttgggataatttttaatacattcctttttgctcttcatcaacttcaaatgtctcaagatgtcctgagggcaaaagagctgatttagctctcagattaaaagagagtggcctaacgcctcactcattttgaaatactgacattaacggggaaaattactcaagctctcctgttacttcctgtgcttaattaagtggctctgcaggtgactcactcccttatttttcagaatgacatcagacttattttccattttaatagcctggttacttcattgattttttaaaaaatccaatttcactttccagtgcaatttctttatctgattttttttctccacactaggaaatgctaactctcgtagtggtaaaacttcgacttacgaatgcctcaatttttttttgagtctagggccccaaatcagaatttaaagaagaaattagaggtgtaatctttatttgctaattacctaaataatttcacgaagtgttggagttgttaatattattaactattcctgagaaggggcccccggggccaccaaatgaatactttgtcttggaggcaggtctgtgtccctgcaagaagccacatctggctctcggcaccctccacacccacagaaatgcctccacttttgtcactttctccatcaatttgagaaggatgattccaaattcagaagcttgttttgagctcattcaatatgcatcaggtggcggtaacatctggaggtcagtttttcttgcagtttggtaaattctgttgtctaaagagagatgtgagaattgctcatcttcatataccacacttggcactcgtaggtttgtgaagcagcagatgcaaatgtttcacatggtgcttggcatttatttattgtttatttgtttatattttgtttttggtttgtttgttgggtgtctgggctggccaggtgaacttcattttctgccctcactgagagcttttcctccattcagctctgactctgtttccccataggagccacaccggtgagggcagggagagggtgctggttctgagccaactttgcatggaaggcccagcagaccacgctcattacttacagccagcatcatcggggaactccggcacagacctgtagtcagtgccccacagcgccccagccttctctcccgacaggagcggccaggacagggagcagaaggtgactgctgtgctgcctggagctcttctgtccggaggtttagtgaaactagagaaactcagtggacacactacaagacttcagagatactttttgtaaacccaggaagaatcaaagatatgaaacatgcagtaggcactcactaaatgttaattttcttcctttttaaatatttgcattatgatagttaaattaatgactgcacgactggaagaatacacactctaatgattcttttccctaaaataaatgtgtccactatttgctgtctaccttcttgaacatcctgcttcctctaaataactaaggagattgattctacactaacatccagttgaagcaaagttgcgtcatgataaaatctggcatgggctatcccttcaaaaagttctttctgaaccatcatgaccataaattgcactaggcaggaggtggtgctggagggacaaagaaatgccagccagtgcctgcactggagttgccagcaatcacacgggaaggcctctagtctagagagacgggtaggagagagatgggagcacatcagaggagcacagatgctagtgcatgggttaaatagtctcttacacatctggttaagatcacctcaaattgctgtggggttccatagctctctacagcccagttccaagcttctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggagtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagcggtggggggtctctgtgcgggatcacccctctcctaatacccctggtcccaggagatggggaggatggagacaaggccagtgtgggaatgaggtggcaggcttctcaggacatgagctgccttgctctgcccccttgggcctcatggcccccattctccctgctggagttgatgttctggcagaccgggctgtcccttggcccagttcctggaataccaagtaattaggtcatcatcggggcagcggaggccagcctctgatgttctgcggcatgttacgtgctcttggggcctctgtttattggggctacattgccctttctttgcacagctggctttgtgcttgctactaatttttttttaaactgaagaatccattgtttagagatcacacataaatggtaaattataaagaaaaacaagtggatgaccgacataaaaatcaggaggtttgctagccctggtgagggagggaggaagacaccatgtgagagaaacacaggaccgttttgtaagatgctgcttttttgttttgttgttttgttttgttttgtttagcattgggtgtggatactcaaatgttcatcttatgattattctttaaatcgttcaggtacattttatacagtcttctgtatgtgtgatgcattttataatatgagtggtatacttcacaatcaaaatcacttttaagaagctcttttgccttggctaactctcgtttgccgtttccccagggccagccagcccggcggagcatggggaggacctgaatctgccccggcactgtctctcctaccctccacaacatgctcaagtcacatcctgtcctgctttccattgcctctggtcactgtcacttgccaacattctgaacatcccactgccttcaaccctccccacttgttcagcacaatatggaaagtgaaaaaaaaaatgagttgcagagagccttgcttccgggtttggaatccagctccatcttgagtctgtttagagaggtatgagtgctttctgatgtagggcacttatcactttagcacacagggggctgtgtgatggcccagtaagagcctgagctttggagttacagagccggggccttctcaactccatccctcatgggtggcatagatggttcttccctccctgctttctctgactaggattaacttccccctgagcccaggacacttgttactcttgtgccctaaccttcacgtcatctttccaccatcttccatctgcagctttctcaggtcatccgctccatggaggtccccgttcctaccttggccttgcctttccccctgcatgtaaccttggtgaacttttcacaagagtctgcgcagtcttcttgtaagcagattaatgccgaggaaaagccttggtgaatgcacaccccacctaccacctccaaccttgcacagctggccggggcagtcggtgccaaggatgcctcatggcccttcggactctgaacctgctatgggtcccactggccagacacgtgctttccttttggaagtgcttgtctcaaacatagacacattgaaccaaaccattgtgtgtgggctattggaaggggtgcacagattcatttgttggttgcagcaaatgcttggtttggcaaatgcttgagggccttgtggctggaatagctccactgcatgtctgcagatctgtcacgaggatcccagctcaggtgggagaggataggggctattggtcagactttctcaggccacgctattcccttcctccatgcaaggcagcgcggtatgaatgctttagatgggcctgggtgcaaatcactgtgtgatcttggggaagttgctcagcctgtctgagcctcagtttcttgaagcatcaaatgaggatgataatctctgtttctcagggtcagcaagggacttaaatgagaaaattgaggtaacccatgggcagagcacagggcactttgtgagcactcagtaggtgcaggctcctttctcctcccctctgcctttctctccccacttacccctgtcaagtaacttcacctctcagaaagccgcaaaaattgtccagtgtctccctcattcccaagacccccactggcccctcacccagtggcctctcagggcactcccccgtcctcagaagtcctatcccagcggagatggaatccacatagctggccctttcctccacacgaccctgccagcgcaacccttccccgtatgattacgatttgtttctggttgtttaccatgagaagctcactgaagcaacgaaggcttcctaggtgcctctaaagaagcaaggtaaattttagaaccttggtttaaaaaaatgctgcgctgtgcagagaagcccgtggagagagccccgctggtgaggaagcacggggaccctgctgcagggctggtggagggctccttctgtagacttctgagcttggagcacagatgggcagcacacaggtgaaatgtgatcctctgtggggctgtgttttctgccccaggaagaaagaagagtcaacaacttaattatttcgtcatggttttgtacaaagcttgagaggaggaaaaaggttcccttttttgaataatagacaggagttacagcctgaagggagcctgctcagggcgggcagggctgctgctgtcccattggcatcagagacgtgctgctgtcccgaaggctccgccctcctctgactggctgctggccctggctcctgcactactatggccttttggctcaggtgcatccttcctggaggctggaactcatcccccgcccccggcatcacctccatagccagggggccacccaggaaacgcaagccaacatctggggaggccagccatctccaggcaagttggagaccaagagaactgtgtgaatttagactcttggtagatgctgcctgaccctgggctgcctggagcactgcatccctgttgcctggcacacagtagggttattgtctctgagtagctgggtgaatgtaggtcagagctgggaggcactgtgggctttcatagtcaaggtcacatggctcattagggacagtgctcgaaacatttcagtagggactcaccattcagtcaacaaattttggttgagcatgtattatgtgcccgccactgcattaggagctaagagtacagtcaggaacaaaagagcattcagtgtactccagacagatgttaaacaaatacatagaagccaaattatgtacagtgctaagaggaatggcatccaggccagggcagggttctcccaggtggtggcatttcaggatgagtgacattgaccacgtggagaagtgagaagagggtctcaggtgagggagcagcttgtgcaaaggccctggggaggcccgcactgcaggagctggggaaagggaaatgtggtaagaggtgaggaggagaaggacctgatggtgaggatatcacagtctgattttcattttttaaagaacaccttggttcctgcaaaggtgggaggggaggagaggggcattggtgagtctatgggtgatgattgcagggggtggtggcttgtggtgccctgtcactcaccagatcagtgactgtggcaagcaactggcctccccaggctcagcttcctccatgtgacttggggacgcatgcttcacagcactgttgtggggcatatattattgcaaggggctggtgctgggagggagccaacactgccactcttcccatgcataccatcctatgcttccaggggaaacctagactttacacactggcttttcttcttgttttaagatagagagaaattcttaattgtaatgtggtcaagtgtgtcagccttttgtcgcttggtttgtgctttttgagtcttccccaagaagtccctccttctcaccatgaggtcataaaggtgttctctcgtgactggaaagtttcacgtttccacttaggtccttgagccatctggaatttgtgtctgatttggtgcaatccagctctcctacagcctggctgggagacttggagcaagtcgggctccctgtgtccccagctaacagatgagaagattaattaggccatctctgtggcatcttcatcacctacagttgcaaacattcagtcttccttgctgcagcctgtgaccagggtgatagtccagtcagcgtgataataaaataatcccgccgacttccatgctgcaaaaatgcagccacgccgacatagcattggctgtcctccccagctctcttccagaaacaaaacaaagcacctcaaagcaggtttcccaaggcccactcacggccagaactttgctttaaatcattccccttcgacagtttagttttaactatactgtatgtacccaagccaaggatgggaggagaagcctcagtaactagaattgttattaaaaccatatatccaactccactggcttttctggaaacctctacctaaaggacgtttaagtcgtctattaaaatatttcagacttgccctgaaggaggcaccaagaagtgccacaactttgcaggctagtgaccacacagatggaaatgtgtctctggaagcaagtggctggtgttagaaacacacacacacacacacacatacacacacacactcccacaaataaaaatctagtcttccgtgttcactcgaattattgtaataatcactgaggatgtgagactctgtatttagtcagttctctaagtatgacccagcccagccgtaagaaaacatgcgagggatgggtgaagaccccacagaggagggagagcctgactgaggggagccagccttcacaggggtcccggtggggatgcaggcaagaaactcagcccaagctcatctaaggtggaaggtatgcgtctgatcaagatacaggggcagggaggggtggtgtcctacaattctcaagggcctgagaaggaggccaggagcaaagttgtctgcccatcaggtccccaggtcctaccaaggcagagaccagctggtctctctgtcccagtagaaaattcctctggagagagaatctgattggcttgagatctgtgattaattttatgtgtcaacttaactgggccacaaagtccccagatatttggttaaacattattctaaataggaggctgggtacggtggctcacgcctgtcatcccaggactttgggaggccgagatgggcagaccacaaggtcaagagtttgagaccagcctggccaacatgatgaaaccctgtctctactaaaaatacaaaaattagctggatatggtggcgggtgcctgtaatcccagctactagggaggctgaggcaggagaattgcttgaactcgggaggcagagattgcagtgagccgagattgtgccactgcactccagcctgggtgacagagcaagactccatctcaataattaattaattaattaattaattaataggggttttctggatgagtttaccatttagatcaatagactgggtcaagcagattgctactgtggtgggcctcatccaatcagtagagtcttgggtagaacaaaaaggctgaccttctgagggcaagagggaactctccccctgcctgagtacctttgaacagggacactggttcttcctgggttgggagcctgctggccttggaacaggagctacaccattgggccttctgggctcaggcctttggactccaacaaaggcctgtgtgagaaatgatgtcaagaactggtcagttctcctgggtctccagctcgctggctgcaggccttagaacttgtcagcctctgtaatcacatgagccaattaatgcacatcctactcttctctcggctccgtttctctgggggaccctgactaatccaaggtcccacagaacacaggtgactccttgaggctcacctctgtggatgggagaggcagttcccagacaagggaacatcatgagtggggcagacacccacagaggcctacagtggccacttcactccaggagcagcacacctagctgcaggaacccgagccccagtgactagcgctcatgggaagggcctgcatcccagatatgtgatgacagcccatcccaaaggccagctcagaaaatgctaggatttgccttcacccccagtggggtcatgtgtatgaggggggcaagtgggaagggagactttggacctcaggccctgcccatcagccaccccatggctgaggggtcacccccataagctcttgaatgccagcacaaggcagtctggggaaacttggtgacgtggacagagcccctccttcagggaagtttctagactgggctatgtgcttggagccactgtgctgggcacagcctcccccagttgaccatgggctctccaccatgtgctcctgccttagaatcagcctccttctctgtaagtggagatggccctggcggcccaggtatgagaggccccaatcaatggcacttctcccatccacctctgagctagtggggaaataagacacaagagtgaggcaggaaaagaccaaagcagcaacagccagggcctcttcccagtccccagggagcccctcggcccctacccactttcaaggccagcgatataataagtttgtttttgttttccaaataaaggtttatttctttctgcttaattctttttcaaaaaatttgattttattgtgctaagaacacttaccatgcaatctcccctcttagctggtttctaggggcacaatacagtcttgttaactctaggcaggtgccatgcttcatggccggtccccagggcttattcatctcactgcactgaaacttgaggctctttgagcagcagctcttcagtcccctcccccagcccctggcaggaccatgctcctgtctgtttctgcgagtttcactattttatatacggcatgttagtggaatcaaacagtattttgtgtctgccttcttcacttagcatcatgttctccagattgatcaatgttgcagcatgtgtcagagtttccttccttttttttgaggctgaataatattccattattccattgcgtgaatacaacacattttctttatccattcatctgtcggtggacatttaggttgcttccacttcttggctattgtaaataggcttctaggagcataaggatgctgactgttttggataaatacccagaaatggggttgctggatcatatggtagttctctttttaatttgtgatacatttcatctctcactctggcgatgtctgagcttctcccttgatagaggtagaaagttccagagaggcacaggcaggcccgcagtgagaaggcctgagcctccttaccagggtatttctcccccacaggctgcctctcactaactgcacagctcaatcacacgtcccttcccagggctgctgtgtgtcacacgctcacacccacactcgctccatctgtgctgggtcgaagagtgaccctgtatccacatccatccaggacctcagagtgtgaccctacttggaaatagggtctttgcgggtgtaactcattaagatgaggtcatactcttcatgttggatggtcatagtacatcaatgcctgttgttcttatgaaaggagaaaacagcagggccaggtagctcatacctgcaaccccagcaacttgggaggctgaggtgggaggcttgcttgaggtcaagaatgtgagaccagcctgggaaacatagcaagactccatctctaaaacaattttaaaaattaaaaaattagctggtggcacatgcgtataatcccagctactggggaggctgaggcaggaggattgctggagcccagctggagctgcagtgagtcgtgatcacactgctgccctctagcctgggccacagagcaagaccacgtctctataaataaataaataaataaatgttttaaaaagagagccagggtctctctcttctctctctctctctctctctctctcacacacacacacacacacacacacacacacacacacacacacgagggaatgtggtatggagacagaggcagagattggagtgactcagcccctccaaagagtgccaggaattgcaggcaaccaccagattcaggaggaggcaaggaaggacccgcccctgcaagtttcagtgggaccatgaccctgcccccacctcgatcttgcacttggagcctccatagctgagacagagtaaattgctgttgttgttagccactcagttggtgggcatttgttactgcagtcctgggaaacaaatgagctgtccactcactcatatacagcctacttctattttactggtgctttctgctaactcctctcctttccatctacatatttcctccttccagttctccctcacctccctcaagaggggctctgtggccaggaaacttttaatgagatctggaaaaagtgttacttgcacattaaatccattattttatgaatatcatggcttaagacaagctgaagtttaaaagtgagtgatttcaagttgatcagaagaaaaatatcaagtaaatggggtgcatggtgacacatgagttgctgaaatttggggagcactggaatgcaagaaacagcactgattcagggtctgtctgtaattctgggtccaaattctgctttccctactggcactgggacacacaggcattgttgaagtactggaccccagatttctcttctgtaaaatggaatcacagggtctaaattggaggctttctctgaaggatgagaataaagttagaatgagaatgttcctagcatggtgcctggcatgagcagattctcagcagatgggccctcctgtaatccgctgagggctctcctgcagtgccagcagggatcctagtcattgtctccaccactcctgtctgtcttcacccagaaccttgtctggatcctgggaggaagcaaacatctcctggtgggaatgtgaggccctgccaggttgtaggagtaactggaaaagggcaggtggccctgcccactatgtgggcacctcatgataaatgatggctctcattagccctaactcctcgggcaccttcctacctggcaccattatgctgggactaccctctcactctgggagcttcacgataaacccatcttggcttaccctggacgcctgtcagctcctggcagggtgcaggccagagggataccttttgcaccatgagattgtgcaacttgggaggctgaggcgggaggcttggttgaggccaggagtgttctggcaagttcacggaaagttctggcaagtaggcaggccagcctcttgcttagacagtgctaaaaggattctttttcactatctgccagtaaggaaagtggccatcttgttcagaggacggagtgcagcatccacatacctaccagcatgaacttggtgagcagaggccacctgcatcccagagccacagggtccctggagctattggcttcttgcctggatacttccagcattcccagtttctggaagctctggttgcagtgtgccctggttctgtggcacccagcaggtctgcaagggcagccagtgggtgtgagtctggagagtgaacatccctatgagaactgactcgtgaccctgagtttatcaccaaggggcctctgcagagacaggtcctcaaattaagagccaggcaaacctgtagagagagaggctctgggggtagactgggaggagtggaagatggtcaactgtccccacgcacttcacgaggattctccacctcccatgtcccctggcatggggagtgcaagataacaacaaaaaaaagagaaggcagtgagcaggacccactcttcctgcagcttctgcacactcttcctacagccccagctgggccacctgcaccagtctgtctgcatctggggttggggtaggtgggttctggctggtttatggagagcctgctcctccatgaggtccatatctgttatttttccgcggcatcagcataagaggtttctggttttatgtatgtattttctggctctggctcctggtctgcatttgtatgcacaagaaggcataagagagatagagcactggatttccagagacatgtgtctggcagcattcgggaaaataacattatagcctaggaatcccatcacacatatgtgcacacatgcccacatgcaggatcatggtatgttggtggtggtgcagttcgtgcccatgaaggaaattgaaaacacttgttggagagaaaacccagtcgctggcatactattcccatcacggaagaggcagagcctatgattggtgcctcactgaatcacaggaagtgttttattttatccccacatcatgatggagggccacagctgccagctatgtctatttcttatgcacaatatagaccacaagagagaataaaacaacctcaaaactacagtgtggaaaaaaacctgtcagctagaaagggggagaaggtatctccaggagccaagaaaatctcttcaaggaaaaataaaaaaagtaacccactttactttttccccaaactgacaaatttgacttgtcagatgtaagtttaacttgtggacaatccactcaagactgataatcgccatagtaactgctgtgtcacatgatcacacagaaacctagagacggggagagtggctttccaggccacttttcttctggtaaattctgtgatgtcagcctaattagcaggagtggaatcaggaccttggttgaagtaattggcagcccttctttaaaaagaacaaaggtattttagcaccttctcttcctatttatgggggcctgtgccaggaccaacagggctctggtgcggagtcttcctcacccttcttcctaactggccaagctccaagcagtgcctctaaatgtgattctttgtagagccatgtctggagaaaaactcgaatttatctcctgaagttttcaaaatatcagaaactggtgagagagggggccgggaatacatttcagggctatcccaattcttttcaattagtattgtacatttcaacttctttcatttccaactgcttctccctgcaaaataaaggtatcatgtctttaaagctctccgtccatgacaacattttgttcttatactagaaaatgccattcccttcccaaggcacatctcttttagttgggtttaatttgagatgcctcttgcctgctaaaaacattggtgacttgccccagcaaggaggtgacagggccacttgtccatgttggccccctccagtgggactgagtggccaccacccccagtggctgcctttcacaggaagagaactgccttcttcaccgccgggcatcggcctgtggaaatctgtgcccagacagctcaggtggcagcttatccaagtccccagcactctgctttgtctgccccaggacaattgccccattgtcttcaggctaatgaagtttctggtcaaaacacaatgatttcaaacatctcttgagcctctctgccctccatctggaacagatgagtacatcaatcccttcaaacctgcctcctccaagtgcattctgcagagttagtgtgtgggggtgcattttaatcaaccacgttggccaatgctgcctacctggagtgaccccaacccccaactaaactgtgagctgtggaaatgaacaaaagccagccaaatgaggagcaaaggctatttattcagagcttgtgctagcgagggagtcagccaccatcccttgtgttttggcagaaactcagaggcaggtaggggagtgggaaagcctcaaagaagaaagaaaggaagccttcgggttgccctgagtggagggtgttggcctggggaaaatgaaggtggctataagaaatgagactcccatgtgattggttagggagcatgtttggctttctttcattggtcctaagttggaagtggggacaaaaacctagggaatcaggctgggcatggtggctcatgcgtgtaatcccagcactttgggaggctgaagtgggcagatcacttgaggtcaggagtttgagaccagcctggccaacatgttgaaaccccgtctctactaaatatacaaaaaattagctgggcatggtggtgtgcacctgtaatcccagctactcaggatactgaggtggcagaatcgctcgaacccaggaggcggaggttgcagtgagctgagatcatgctgctgcactccagcctgggggacagagcaagactccatctcaaaacaaaaacaaaacaaaacaaaaaaacctaaggaatcggtcagttattaatcgagtcctagaattttggggctgattgctataggagctgttgtttggcttctgggctgattgctacagattgcgggtcagagtcctgtctttctatatggtcttgacattgtctgtatattgactctctcagtgtgtacaggctgtcttctcccagcctgcttaaaattaatgagagtttgaacagacgcgtgtgtggagggcacatcatcattagtacaaatagccacagatggaaattctgcgtgcctttgagaaaactgagtttgagaggctctacctcaacagcttcctcagcccagctgaagtctctctccctgaaggcccatgcacctttctcagccattgctgggaattcaggattgtgtgttggaggccaacattgggtaccatgagtggaaaccatgaactggggcaagtcctcctggtacacacacccagctactttttccttcctcttctgccctatcccagggaaccctctttgcagcatctcacccactggccaaacttcagggtcttgtcttcatacttactgcttttttctaagggaaaagttattgagaaggcagtcaaggttcatttatttttaaccaggagacagtgcccccaaacaagaactgagtccctagttatggaatgtcagacacctcgcagcaggtggtggttctgaaacacccggatccagatggcagccaactccacccacatgtcaggcgggcgacagcatttccggacatattccttgtttagatgaggagattctgcccccagtaacattccttcaagcagcaaaatgatgctagatctttccagaggtcacagactgaaggcttgggggctacagtctggaatgtgttttgcttggcacacatgcattttaagttgtttaatgacctatcaagatttaaagatcaggagctgacctttcatgttaaaaagaaaatctatattttccaacttgtcttggaaaatgggatgctctggaaacacttggccatcttcccacctgcagatgctcagcagaatggcagctgccctgtggagaggaagcacctgttcccttccttgccactctccctggctggcctgcagttttctcctgtgtgtcacagttatggactgactgcttgtgtcctgccaaattcatatgttgaaatcctaacccccaaggtgatcatattaggagatgaggcctttgggaagtgatgaggtcacgagggtggagccctcatgaatgggattagcgcccttatgaaagagaccccagagagctctctcactctctttccaccatgcaagaaaatgagatgttaaagtcttcaacctggaagagggtccctgccagaatccggccatgctgggacctgatcttggacttttgagaactgtgagaagtaattttcagttgtttacaagtcatcccatcaatggtattccactatggcagtccaaactgactaggtgactcaccttcttggcccagtgggcatttgatccagaataactcattactgtctgaggaaattcccactgtctcttttcccagaagtttttgtttctggtggcttcttgggggattccaggcacagtagggccaagcaatgggtatagagtgaccctacacctttgacttggcctcctgtggacttagatggatgggtgtgtttcctaggagccctctttcctgtcctcaacccttttcccatgagaaatgcctcttcttgcctcagaaacaaacgaaggggtcagtgtctgccaatgtctgctcagcccagagtgaatgtctgtgagattcagtgtgaatgtgctggttgcctgctacagatcaggcttggcaggtggtggtaggtggttaaggttccagtttcagcatcaagtgtgagttgttactgctcagagtctcagttttctcatctgtaaaatgggaagattcctagctctcaaatttataaggctccactggccgtgtgtaaaatgtggcatttaggggatactgttggctgttaactatatccgccaggacaggctggttatgctctggtaaaaaataaacccaaactcaatgtctgcgcccagcacacatttatctcttgtgcatgctatatggccatcttgactcagcagggttctattctctgtcacctttacttaggagtgttggttggaagaatcccccaaagtagtgccatcagtctctgtggcaggggaaaggggacatggtgtatcaagccttgggcttgcaggtctgttcccagaagagacgtcattaccgcaactcacgtttcattggccaaagtgagtcacaagccaagtttaacttcaaggagcatgcccccaagcctctgattctaagtgctaccgtcttaacacatttgagctcctgtaacaaaatgccataagctgggtgacttataaacaagagaaattatttctcccagttctggaggctggaaagtccaagaccaaggcactggcagatttggtttctaatgagaacctatttcctggtttatagatggtgccttcttgctgtatcattacacggtggaaggggcaaacaaactctctggggcctcttttataagggcactgatcccattaatgacagctctgcctttatgacctaatcaccttccagagcccccacctcctaatgccctcactgggggctaggtttctccatatgaattctggggggacacaaacattcagaccatggcagcgctctcttccctcacagcgtggctggctctccaactacaacaccatgccccatggctcacttccaaggagactttctggagaggtttgtcctaagagacagaagaatgcatcctgcctcaagttttagttgcataggttcaccctacagtgaggtaatagttacacattcttaatgaaaagatccaaaagcccaatacatcctgttctgcagcatataaagcatcttcttcagacctggtccaagactactctgggatttttgagtcagaagagagccagagcctattcagtatgctgtttgactctgatcccagcagccaccaccatgttaacaggatgagcagggcttccttcaactcagggttcctgtgaaattaaaaagaattctcatcttgactcaggattgttgaacactattgatatttcttccaaggtctcacaagagtttgcctcctctcattgccatgtgaagacctctgtgggggaacaatgcatgggttcttggggtattataggggactacagagaagtgtcacctccacccaacagcctgattcagtctactcctcaggaggaacacaaagtggtctctctagtgccatgaaaccccaaaaagtgtcaaccagtattaaaggcctgcctgatatacaaccctcgaatgcaacacagtgtccttctgaggccactctaaaggccaggaaaggtttgctaagaagtctgtgctgttaaaaacagaagaaaaagacccttatcccattgctctgtgtctggtggctatagggatagtatttcataaaaaaagaaaggcaaaaataattttcaaaaatgattcaagaaatgctgtcaaagatagcaaagaacagagtcctcagagaacagtgcccaggacaggataagcactcaataacatataacactgtgtagtgctgttgagtgctggctgttgttgagtgctagctattgttgagtgcttgttgttgagtgctagctgctgagtgctagctgttgttgagtgcttgttgttgagtgctagctgttgttgagtgcttgttgttgagtgctagctgttgttgagtgattgttgttgagtgctagctgttgttgagtgctagctgttgttgagtgctagctgttgttgagtgcttgttgttgagtgctagctgttgttgagtgcttgtcctgcctgggccctgtttttagcctttgatgtacatttctccatttaacttccacaatagccctattaggcagctagtattattatttctgttttacagataaagattggttttagctcagagtagttctgaatcttataaaaagaaaaaaatatccccaggaactgaatcggctccaaaatagccccatcttgggctaaatatgggatgtgacaaagccaccatgaagctaggcccccctgtcctgacagctttccaccccttccctgcccctctcaccctgctttccaggggcaatgcacctccccacttctcctgggaggggtgggcatcctctcagtcccataatctgtgccaggcccacatatgaggacttgacaggattcagcagagatgcaggcctctgctctgctctgctcatctctttgcatatagtaatttaatgaggacaaaaactgcatagagctagtaatggcacgaccaagcagcagcttaagctttgagccgctaaactatgctgcctcctattgtaatacgattatattataacccaagttcaagagaccacccactgctttctttattggatcttccaataaagtggccatgctagtagcacaattccccacggaaatagataatgactattctaaaataaatccgaggacacacccagccacaaagtgggaggtgtattatacaaatgcaaccagggcctctggatctggcatttagacccacagcaacagcttgtgtttgctcagggctaagaatgcaggactcagacactgagagcctctgagctgctgcaaactcatcaacccctccctattaaaggccattctgactaccctcagttttcctcaaagagcagttgagagctaaggtagggtagggagccaagaggaggcagggagagccagagatggcagccggcaacaggacacagaaagaaaagggacttcaaaggcagatctaagaactcacagggctttttggtgcagagtctggagataatgcacagaaatgacaccttgaaaggggaaggaaaagaaggaagaacacatcatcagccccggacttcaggtggctgaaggagagaatgtatttggcatctaccatatctttgcatccttcaatgacacatttgtccatgtcactgatctttctggcaaaaaaaaaaaaaaaaaaaaaatgtgctgtgtgactggtgggatgaaggtaaagggtggccagatgaatcctctccacatgctgccacgctggccacccaggatgtggcctagaggtgcaaggagccagacaccactggcctacatcaaactccaggccacagatggaaataggactgagatccctggacctggggcctgctcaggtatgaagatcaggtggattgaggatgtcactgccatcccctccaaaagcacctgcaggaagggggttgccatggtcaccatctgtgaacaggactcctcaaaatgttttctattaataaattgccttcaagtaaactgaaaaaaaaaaaagagggagagaattcacacaaaatgatgcccagtcttggtctgcatggtgaagggcccaggactgatgggcgggggctcatttgcataccacaacaccagggagagtcctgtcacctgccctcctgagtcctgaagaaaacccttcaccccaattccctgtacactacttctaaaggcaggaaatgtgtacagttctagaattacagtcacataaaatgctagaagaataacgtgatttatttaagtgcttagaggtacccccttgaagtttgtgttacctggaagttggcctcggggaaacacctcattgaccttctctcaaggataaatgagatgcagggacagggaagggagaaaggttattttaacatttcattcacagtccctgggattctttggagagcaccttaggaatgttcttaacctgagtcctcttactaagtattatcacatagtctgccaggctggcattattaaccctactttgcagctgaggcaactacaagagatgaccctatcgggctagtgaagtggaattcgccatgtactgcatgcagtcatgtactgcagtgaccaatccgggtctaatttctttgatgatatcattgacggggtagcaggggagaggcaagtgcaagagaagaaacggggtgaaacccactgcagggaagcttgggctggggcaggatcggggagccagggtatggggcatggttgggactgaaacccttgttaacactggctttagcaaaagaaatgggcaccacaatcccagaggacttccagaagcttcctccctcccccgcacctgggcacagagccttacctcccctgcaccctggccctgtctctctatttggcaagactcccatgtcatctgctcctctttacttcgggtccctcttggcactggaaatactaagtgaacccagcagttacacaggattctaggaatttctcctttccaacttcctgaactggttttctaattcacctcagaggtaccttaacaaatcatgttccaaggccgggcacagtggctcacgcctgtaatcccagcactttgggaggtcgaggcaggaggacctcctgagcccaggagttcaagaccagcctgggcaacatagtgagaccgtgtctctacaaaaaataaaagaattatcctggtgtggtggtgtgtgccactgcactccagcctggatgaaagtgagagatctctttcgaaaaactcacgctccacacaatcaggaggtccgccatccacagactccagacagatagttccatcagccagcaggagcggcatgggcaacgtcagtagcatgcacatcaggttagcttctctgaggtcacaaagttgcctggaagtggggaatccatgagggccaggccctccacaggaggaggacttccctctccagtcaccggcctccctgatgtggttccctcctctcagcccacatgctcctgccgaggtaacatgtccccccactccaggttagaaaaccataaagcccccaagagacgtttctaccaatcatctaaatattgagtttcaccttataaaatttataaaacgtaaagaacacttggaacagcccagttttaatgcctccaacttttgttttccaaagaacaattggtagacttggccccgaggggagcagagcccggctctcagacaacgagcctcaccagcaattctgtatcttcgaggcggcagaggtttttgtgatcttgtgtcatttctaaacacgacggtgtagatgggatcctcttcattttgcaaatgagaaaatggaaaaacccgagggacaaagggcctctctcaaggtgccatggtgagaaggaggcagaaggaagaggacctcgcccctgccttgattccactgactgctgtttatcacaccatgagtgtcttcagggagcagtcgttctcccgctggaatgtttacatgaggagcaaatgtgatgccatcacataattccagtgagggctggtcatcccctgcaaggctgaaatgaccctgtctgttttaatgctaaggaagcagcagcttttctcccactcccacacaggatgtgtgcagcatcttcaagtctctgcctcgcgtttctagatctgtagtgagctctccatggtcagggagtggatctttcagttgggtatttttctgaagcaactgtcattctttgctttttgtagcaagacatgtttttaaaatcctctgagagagaaagagggttgccagaaaaggaatgaagagtgggagaaaggtgcattgtggagctgtctgagcgttggagtatgtcccaataacgaagagactgtggagaagcatcccctgtcccgctccgtgttctaaatgtatgaaacctaacaaggtaattgcatgggaataacacactgtgaatgttatgtgggatttgaaattgtcatcccaagagtgaccaggtggagagaggaagggtgaactctttcagtctaaaagctatgttttaaaaggcagggttagactatgtttgtttctgcagtgtattttctctgcataaagggctttttttcctactttttctgctggtggacgtttcccttgggggagcctggccaatgaaaggtcacacagagaccagtcactctcaggaacaccagcagagccgggcagacacatgtcctaattttcccaggagcagactgattgaaccataggagggtctgtctgatgtttatcttggcagaattctcagatgagttagcaaatagtggctggagataaactgaaactttgagcaacctctggactgactctgattaccctccacaccctacctgcgcagggaggagagaccacaaagccagcagcaaacagtaaacttttccaagaatcagagaggaaggagttcctgacaccctgcagcaaaaacaacctcaaaattcccctgaagacagacccatgggagctggggtcaaggtggccttgcgcttcaccgaggaggtgtcattaccaaacgtgctggacattggctacctacggaagaaagattaaggactgaaagaaaatagtggagaacatgcttatgacatgggggtaggacagggaaggccttgagcaagacacaaatcacaaaagcaaatagagaaagagtgatgtctaccttcaacgaaatgtgaaacttctgattcaaaatcggaaacctctataagctgagataaaagacaagcaacagagttggagaagatatttctaacatttgtatgtgtgcaaatgtatgtgtgtaatgtgcttatacatatacatatagataaatgcgtgcgtatacacatgaattctggattgttatctaggctctatgaagaactcctatctgttaataagaaaaaagaccaagatcaacaacctcatagacaagtggataaagaagatgaccagttagtccacagaaaagaaaatgcaaatggaagtgggagggcccagaggaactcttgctttatctaaattgtgttgattacgggagcatatgcttatactaattttataggtaaaaaaacagaaaaagtacctgaagattaaacccaagcaatgcgatgtgtcagttttgccaacacacaggaaggggctctcagcctgtaaaataggagcccttttgtgtgaagctgaccagatgcggagaagtttcaacagtcctagagaagaggaccgcaggggacagagagccagggaacagggcagggaggatctaagagggcacccggccaagcggttcactgcagctggtgcagggctcagctataccctggggctgggcgcttagcacattgtggtcagatgaaggcaagcaagcagtggcagggactctccatttgagtcaaagtgacaagcagtgcccccagtccctgggaaggatgaaatccaaatttaattcccttctgaacaacattctacaatctatgcttcatttaggtatctgtaagcctaaaagagctgaaaaatcattttatttccccttccaatgtacaatttctaagacatttgaattatcgatgttgaagtttcattgagaatgagctgagtgtcctgctttcggcctgaaaacaaagcctcagccacagtcttcgtctcaccctctttctctctgtttattttcttttaaaaaatttctcccatttctttgttctttaacaaagagttgtgtgcatcttctaagctccaagtgctgcactggcttccagcagacaatggcaaccgtggccctgacctcatggcgtgactgaagggagggtctcggccaggaatgtgagggacgccagaaagaggacattggtgggcaatgaagggtcttccttgcgggggggtgttggggggtgtgctgtgcttccctagcagtccacgaccactggcaggggacaccccgggcagaccagtggtccaaatttataccagcgaaaagcaaatgttgatgccttcccaatcacggttccttcaaaggcttcagggttccttgggaagggaaaagaacattagttcagctcctgcgatgtgctgggactgtgctaggaagtttcacagatgctagttcatttagattggatatgcctcccggaccagtgtgctgtccgttatggaaaatcaaaacagccattgcatttccatagtgttcacaaggagcctcatttctgggctcaggcaggctgaggcgttccagggttgagaatcagacttggtgactgagcaggaactgttgtcctttttctcttttgagatatgaaatttgcttcacatctcagaagagtgtgtgcctccatcccacacttgggacaagcgccgttattctttttttaaaacatctgtagaacatattaaatgctctgctttcttcacgggttaaatcatgctggggcgggaggcttgtggtgtaagagcggtgcactgtgcatccactagggctctcccgtcattccagttcgtctccttgccacgccccagctcgctgcccccaggctgtcttggacagacacatctgtgttttgtaatagagcacatcatgcactattatatggggatattttataaaggagcccacgtgacacaaggaaactaggagaaaacaatcctagaaatccccaaagcttggaagcagggacatgcaagcgaggtacagcatatgctatcaagtggcaatgtccttccagtaggaaagccgctgttgtcatcagtttaggcaggtgctgggattaagcacatctaccactcagaaaataatacaaataagaaccacggtccacatccaacatgggtctcccaaattctctaaaatgtggaagtgtgcagatcttagcatctctgtcctttctctcgcttcgaggaagttgggctcctgggcactgcctcatcaatcatgcccagtacctgtgtacaggtgcctcccctgctctctggagcatcgggactggaaggattgggaacagaacggagctttgattgatcctcttgtccgcacttgtgcctttcaactccctgtggtggagggtgacagtttagtctccctgtcttctcctggggtcccaccggctcctgaatcaaatcctgctcttcccctgcgtattctgagtggcctgcacactctgggctctctctctccttgacccctggaacaccacctctttggttcttagtaatccggagccttcctacctggtagtagcactgacatcctcttcatccactggaagcttccagatcctggcccccacaacccattctctccccatagggcttccacagaaacacaacgtgtactgtgtgccaaatgactggcccagaggatgagtgagtgggggaccaacgtaggctaggggaggggtcagaagagaaaagttccaagggagtgggaacccaaggaaggcttcttagaggagctgggacacattggggcctgaaggaagtggacatttagacgagcataaagactgcagggatgtccaaccttttggtttcactgggccacattggaagaagaagtgtcttgagccacacgtaaaatacactaacactaatgttagctgatgaagaacaacaaaaataatagcaaaaagtctcataatgctttaagaaaatttatgaatttatgttggcccacattcaaagctgtcctgggccacgtgcatcctgcgggcttgggttggacagtcttgagctaaagcaagtgtgttctgagctggagagaaggccagccccacggttcatcgttcatggtatcatcaaccaatgatactaggaacagttggtgggtgcaggccctgggcagggcaataataagaaaaagcttagaaaagaaaaggaggaggaggaggggagttgcgggtcatggagggccttgaaagcgagactgagggtttggaccttaccttttcggcatactaccgagcagaaacccctgtcactgtaatttctgatgattctgtcttccatctttgggaataacaacgacatagtcgactactcctctacaaaaagagtcgtcagattctttaaccatgtggggcatcttgttttggcatccacactagttctgttacagccaaagctgggggtgttggggaatgtcgcatgcttcaggggtatctgtgtagtgtgcattttacccagctgagctcacaactttaatgtgtgaaggtgatcctccagttcaggaggacagagttggtgcccttgcctgtaccatcctaagagaggtttctgcttcctgtgtcctgctctgtgggctccccaggtacccctgcagtttttgcctaatactttggaaccaacaataataacttatgaaatctttatttcaaacacagcttgaatttcatccattttcatcttacccaaagagatagattctctagtcctcaatctggatggtcagaatggagaaatccccttacctgcaaacacaggtcttttattctgtaaccactgtctgtctggttttctgttttggagtctcccagggtgatggtgccgccagataaaagttgtaatgagagagggagggtgggagggagggtccagtggcaaggcagggcggaaggtaagcggagaccttctccaatcagaagtctagaaggcagggcacgcagtaggtctgcaggatgactcagaacccgcgtatgaatgctgtctattcatgggtccaggcttttgttaaagtctgggcctgcattttaaagagggagtcagggaactggctggactggtctgacaactaaggagtggtgaacacttcccccaggctagtactcaggtggatgaagtcatcaatattttctgggcagtcctaatctgtgattaacttttatctctgctgtgaaataacagcctccttttcagcctgctaacaataagttaacctggctgcccggctgggggatattttatgctgggctccagcagaggcacacttgagaagccatgtgggactcctgccctggagagagcccagagtggagggaggggtctgtatggtggtgggagtcctctcagcaatggtccttgtgatgccggtgtactctgatgtcctgacttcaaactcagcttacccaaagcaaatgtccactttcttccgtactcctttcttgtttaaagcctcaccactgaccaggaagtcttgatagagccatctagtaattcttaagtcctacctcatccaaccttgttttgactcctgcagtgagcacagctgccctcaccctcccctctctatgccctcacctttgcaggagactctcaatttctcagtccacatcagctctcagaccaccaaagcaagggttatttttctaaaagacatttgttcccattgctcctctgactaaagttcctactatgggacatttgcccttggcactcaaggaccttgcaatcaggctgagaacctcaggttctcaaactcaagaccatggggaatgtaataggtgaatcaggcaggtgaagtccaggactctttttggtttatattttgtttactcagttttgatggagacaagcataccagaaaattcacattcctcttaactctagcagtagacaaacaacagagcaagcaggatgtgaccatttatacatggcctcactgttggggaggcagtagggagtgttggagaccagggtcaggactagggctagggcaaggctaggaaggtgcccaggatgcatgttttaaggaagcactcactcttggggctttgcaagtacaaggctagcaatgggagatgagtgcctccttaaagttggcttcttgggccttgtttgcctgacctagtctggccttggtgaggacagtggagaaatggagcatggacctacccaaagggatggctgctgatcagcttcacctagctgttgccaaaggcaacactgtggccccacttttgccaaatcttttcaaacattctgtgggtgcttccatcatagctattatcacctggcaagggagttgtccccacaggtaaccttctcactaagtgggggtgtctgaggccagggagagctctactcattcccctgtgtgatcccagcagtgagcatagagcaggtgccctgcaatgttaagcaaaaaaaaaaaaaaaaaaaaaagactttggaaatagagttatggagccaggatgggtcttgagttagcctcactctttatttctttattcaaggaatggttgttcagggccagcggctcagccctgggagcactgactgcttcaagacacagactcctctgggatgccaggcagagtctgctcctgaaggcagactccactcttcatggggctccctccattactcattaggtcacagaataatagaaaaaggcaggaaagatgaaaaaagagaatttaaaaacaaaacacgtccaggtgtggtggctcacacccgtaatcccagcactttgggaggctgaggcaggcaggtcatctgaggtcaggagttcgagaccagtctggccaacatgaagaaaccctatctctactaaaaatacaaaaattagctgggcgtggtggtgggcacttgtaatcccagctactagggaggctgagcccagacaatcacttaaacccgggaggtggaggttgcggtgagctgagattgcaccactgcattccagcctgggtgacagagcaagactctgtctcaaaaaaacccaaaccccccccccccaaaaacccaaaacacatggtagcaaaataataacaaattgaagtatgtctgtaatgacagcaaatgggaacttacctactccaagacagaaaatgattagattagatttctaaaaagtccaggtaggtcttgcttccaagataccatctaagatgaaatcacacaggctgaaaataaaggaatggaaaaatatacactatttaaatgctagcaatagcagacagattataataggagagagactatataataatcaaggcaccaaccgactcagaagctgtcacaggcccaaatgtatatgtatgtgtctaacatacacgcacctcaaaatatagtaagcaaattgacagaactacaagtctaagattacaacccatttaactttatcaaaagttgataaatcaagcaatttaaaaagtactaggttataaaagatttgaaaaacaaaagtaacaagcattatctaatgggtgtgtgtgtgtaaaactttgcggccaaacataaatggtcatcatagatcatttaaaaacagttggtgatatacagattatttaaaaatttgaccacatactaggtcacaaagaactcaacaaatatctagaatcatcaaataacacagatcatattctctaaacacaacccaattaaattagaagtcaatactaaaatacagtctcaaactcatatatgtgggaactaaaaaattcactccctagtaactaataggctgaagaagaaattacaacagaaatttgaggagtttgagaccagcctgggcaacaatgcaaaaccctgtttctacaaaaaattagccaggtgtggtggtgggtgcctgtggtcccagctacttgggagactgagttgggaggactgcttgatcccaggaggtggaggttgcagtgagccattatcatgccattacactccagcctgggccacagagtgagaccttgttgaaaaaagaaagaatatctagaggtaaatttatagcctgacatgaatttatttcaaaatcatgagaggtttaagcgagctgagtgctcaaaatagcaattgcaaggaacttccttaatgtgataaaggttatctatcaaaagtgtatagtaaacattataattaatggtgaaactttggaagcatgcccatcaatatcagtaacaagacgaggatgtccattgtcaatatgtctattcatcagtatcctggaagccgtactgagggcaatgaaacaagcaaaagaaataggagaataagaatttagaatgaagcaagaatatttttatctgcaggaaatatgataatctatatagaaaattcaagagaattttctaataaactattcaaatgaaaatacagtccaacgaatatatatacacaaaattgggtacaatttatatgtattaattataaccaattagaaaatataacaggagaatgagtcttatatttcaactaaagctataagatctttctgcatacattaaacaaaatatgtgcacgttgcttggttttgatttttcttggttcatttggctggttttagaggaaacttggaaatacagctgagggacatgaaagaaaatattagtgagtggagtgattcaccacattcttaaatggaaaaactagtgttgatttaagaaagatgtcaggccgggcgcggtggctcacgcctgtaatcccagcactttgggaggccgaggcaggcgtatcacaagatcaggagttcaagaccagcctggccaacatattgaaaccccgtctctattaaaaataaaaaaattagcttggcttggtggccggcacctgtaatcccagctactcgggaggctgaggcaggagaatcgcttgaacctgggaggcggagtttgcagtgagccaagattgcgccattgcactccagcctgggtgacagtgtgagactccatctcaaaaaaaaaaaaaaaaaaaaaaaggaaggaaagatgtcaatatcatctcctaattattctttaaattcactacaattctatccaaaatcttgaaggggatttttttgtgtgtgaaatttgacaagctgataatcatcaagactaattatacatttataatacttaacatagtacaatatcgatatatagatagtgaatagatcaatagaaaattagagaactcagaaactgacctatgcatctgtggaaatttcatatataacggaagagtcattacagattagtaaaaagaaggggtgggctcgttcaagaaataacttaggaaaaataggttatccatacaagaataataaaattagatccttatatcaacacacatgtaaaaacaaatccttggttgattacatacctaagtgtaaaaagcaacaacttcaaataatttagaagaagatgtagaagactatctttacgaactcagagtaagaaattattttcttaaactatatacaaaaagacccttaatgcaaaaattaacagactatttggtttagtaagcaggattgtattttaaaatttttaaattattcataaaaaatgttaaatgtcaagccagaaaccagtatttgcaatgcagtcatataattgacaaaggccagaatccagaatacatgaacactggcaagtcaatggaaaaaatgaccaaaagacatgaacaagttatggatgaaggcagctcaaagggcaaatgagcatttgactagatgattacctcttagtaatcagagaaataagcaaacaaaaaagtatgccacctgtgtattagggttctccagtgaaataaaacaaataggatttacatgtatatagaaagagatttattttaagaaattaacttccatgattatgagagttaatatctcttccatgattatggaagctggtaagtccaaaatctgcatgctgggctggcaggctggagacccggagagaagacaatgctacagctcaagtcaaaaggccatcaggctgaagaccccaggaagagctgatgttgcaggtgaagtcccaagaacagtttgctggagaatttcctcttgttcagggagctcagccttttactctattcaggccttcaactgactggacgaagcctgcccaggctctggaaggcaatctgctttactgaaagcccaccaatttcaatgtaaatccccatcagaaacaccctcacagaaacattccggccaagttgacactcaaaatcaactacagaacctccaacacatcagactggccaaaacatttgtctgccactaccaagtgttgacacaaaaggcaaacataagaaactcatactgggctggtgaggatgtagagcatggatccagactggagaacctctcacacatgtgcacaaatattcactgcatcattatctgtagtgaaaaattgaaaaggaactgaaaaacaatcagcagaaaatagacaaattaattctgataaggttcatatgactgagtattatacagcagttaaaggagttagagcaacaggtatctgcatggataaatctaaaaacaatcatgagtttcaggaagatagatacaacaggacagatttccataaaatggaaaacttacaaaccaatactttatattacttaggaatgaatactgtaggaaaatctaaaaaacaggcttgagattaatacacagtaaatttaaggttgtggcatctctgaggagtagggaaagggaatgagatcaaggaggccttcatctgtgtctgtaatgttttatgtgtttttttctaaaggcttgaaacaaatatggcaaaatattaagatctgataaagccatgtgggcgtatgacatttgttatatttctctctatccttattcatgtgtttaaataattctccgaaagcagtttactgagagttcagcatgtctcctgagacatgctaggaagttatgtgcaggagtggagaatatgattcattggaagagttaagtgccctaaatgccagccaggctgtgaccccaggacagaagtagggtgggggggccttcttgcttgctagtgacaatctacaccaaccagcaccacaggagccccaggatgacaaggaaggacaaaacacagggggtgacagatgcaatgaacccctatgtggtacattgagtggtggagaccgggtgtaaaacacacgatcggtgcagggagaccagctatggaggctttggggaccatgataatgaccatccagtgtggctgtacttttctctagaagagggttggcctacatccactccagtggatccacattctctcccaagagactgataagagagtgaaagatttaagtcacctgtgtgggtggccctcaagacccctgcaatgaaaacccaaaggggtatcacagtgttttctggcaagaattggccattgcttaattttcttgtctgatttttcctagcaaccttgtatttgacctcgcctggcatcctgtgtggtcatgagccacagaggtggaaaaggcaacatggtagaggcaggaggaggcaggaggtggaaaagaagggttatcaggtgatgagttcagccatctcttgccctgagtttagttgtgctttgtttataaaaagtgcttttctacaaaaagtatttgatggtacaaaatattatcaatatggcttagatgggtttgagaagtaagaaaaggatcgtggtggtagcaggaaataagacagaaattttccatgggggctccaggtctgaaggcactggcaggtactgcagggtgcctcaagcaggcgtcacttgatagggtcaaaaatcagtaatgtctatgctcatctccaacctctgcagatagaggaggaaatgttgtgaagtatttagatgcattttcttaggtgcgttgtttttgttgaattaggacatgaagccagccacagccagctgtctctccccttcggtgagaaggggacgacgtgaagcacccaagatgtgaaccaggactcaattcacatttggggaacctgatagcctcctcagatgcccccacagaaatccagattgacccctgaggctgagctttaccctccgcagggatgacttccatccagcctgggatgggcaggggaaaccgctgctcacccgaagtgtatttaaggggtcccaacagcaacttatcaacattttttgttgtaaagcacacagagagcagtgaattctgtccattttgtgagcagcacatctggataaggcaggtgccccactgcattcagagcagctctgggaatgaggaaggaagagacaacaaaaggaacaggagccttccaataagcccagacattagacctgagccttgtccctgtcataggctagtcattattgattaaaaggtggacatcagataaacccaagagggacagccccgccaacgtccagagcaatgaggccctcactctgccctcacctctgccagtgtaaattctggggaatttctgaaacaccgtgaatacagaggtgtgactcagtgggaatcacaggaatgtcagaggacaaagcagttggtattaataaattgctttgagtctggaaacaaagaagtggccttctttgtttccaggctgaagtacagtgctgtgatcatagctcactgtaacctcgaactcctggcctaaaatgatcctcctgcctcagcctcccaaagcactgggaatacaggcatgagacaccatgcctggcctggccttcagtttctctgctctaactctgtgttgccctagaaatccttttctgaatttctcaggtattagacattcacccatgacatctgcatctttctcatcttcaccagaatcaccctgtcttaattccttaactcttcctgcttcttgccaggctaagaagctgtattagttatctattgctgtgtaacatgtcaccctaaaacgtggcagcttaaaacaaatgtgtgttatctcacactttctgtgagtcaggaatatggacacggcttagctgaatgcttgtaactcaaggctgctcatgaggctgcagtcaagctgtcacctgaggctttggtcttatctgaaggttgactggcatgggggcatctgtttccaagctcactcatgtggttctgtccctccccacctaggcgtctccacaggctgccttgtgacatgtggctggttaccctggggtcgtgtgactctggagagagtaggacagaggacccaaaatggaagccacagtgctttttataacctatgaagatgtgacatctcattacttctgccctattctagtcatagaagcaagttacttagactggtccacaccgacagggaaaggatgacatgagggtgaggatacagggagagtgggggtcattggggcccatcttagaggctgcctaccacagaatccctaattatttctctgaaaataaaaggaggagaaagagacaccatattctacatttctgctcacctctgtggtggggctgatgtgcatggttttcatggcttaaaagcacactccatctcactgggggtttcccaaatggtcatatgaagagaggaattgctccccagaaccgctggggcacctcatttcattgatgctttttcttcctctccacggagatgctctgggtagaaggaatgaagccttcaaggtggactctggagggctctcccagaggcttctgtctgaaccagtgggcttaaaaatgagcaagggagaaccttcatgaaaatcactgtcaagtactgtctcagtttgctccagctgctgtaacagaataccatagactgggtggcttgtgagcaatagaaattaatttcttgcagttctggagtctgggaagtccaaattgaggtgctggcagattctgtgtctggtgagggcccacttcctggttcatagacagcctactcctcgctgtgtcctcacctgaaggaaggggcaaggcagctctttagtgtctcttttatgatagtactaatcttatttgtgagggctccactgtcatgacccgagcacctcccaaaggtcccacctccaggtatcatcccactggggatcaggcttcaacacctgaacttgaagacaaacatttggtctatagcaaacacccaccatataccaagccccgtgcttctctgggcttgggggtgctgggataccaaggtaaattaagcctgggctccatggcaagctggtgtgatggttgagagaaggtctaaggggtcaataaggggttcttgcctggcgcggtggctcatgcctgtaatcctagcactttgggaggctgaggtgggccgatcatgaggtcaggagttcgagaccagcctggccagtatggtgaaaccccatctctaccaaaaatacaaaaaagtagccgggcatggtggcatgcacctgtaatcccagcactctgggaggccaaggcgggtggatcacgaggtcagaagttcgagaccagcctggccaacatagtgaaaccccgtctctactaaaaatacaaaaaaagtagccaggcatggtggcacatgcctgtaatcccagctactcgggaggctgaggcaggagaattgcttgaacttgggaggtggaggttgcagtgagccgattgcgctactgcactccagcctggatgacagaacgagactccgtctcaaaaaataaaataaaataaggggttcttatcctagtgctattctcagctgagtgactttgggagagtgacttgaccttcatgagcctcagtgttcaaaggatctttatgattatgtctgtgaagccctccgagtcacctctgagtctaagcatccatctaggtgctccatcagcagtaggtattcccagtgctattgcagagaaactctctaaacccacctctcaaactgggccagcctggagactggacccagtgggtctggatgctgacttgagcacacatgtacctcggctcctcaggagactctcatgcaccccagtggctgggagccactggtctagagagtgagctgcatcaaggaatggtggcacatgggaatgtgagcaggtgcaggtggacactgggccaaggtggggcgtgtctggactcagggcctcgttggccaactctcctaggacttaagaagggagaggagcccagatagaggagccagttttttttttatttccaacttttattttaggttcaaggggtaggtgtgcaggtttgttacatgagtaaattgcatatcatggggttttggtatacaaataattttgtcacccaggtaatcagcgtaatacccaataggtagtttttctgtcttcaccctcctcccatcctccccccaccaggagtccccagtgtcctctgctcccatctttatgtccatgtctactcaatgttgagcccccacttataagtaagaacatgcagtatttagttttctgttcctgcattaatttgtttaggataatggcctccagctctatccatgttgctgtaatggacatgatttcattcgtttctgtggctgcacagtattccatggtgtatatgcaccacattttctttatccaatccaccatcgatgggcatctaggtctttgctattgtgaacagtgctgtgatgaatatatgcctgtgtgtgtctttatggtagaatattttgtattcctttgggcatatacccagtaaatgggattgctaggtcaaatggtagttctagtttaagttatttgagaactctccagacagctttccacagtggctgaactaacttacattctcaccagcagtgtagaagcattgaggggccagttttaaatcctagtcccttcctgatgctttattcatgctttattcctgcctcctgtcacccgtcttagggatgattcacccagtcccttgctcctggctggaaaaaccttttaaggaaaagtcgctaatctgggtacatctagacttagctttgcccgtggaaagtctcttgcttttcacagccatttgctacccaccctgcacctccccacacccctcagacttcatgcttgagtcctgtttaccaaatgatgggatcctgttttgtcacctcagtcccctctgaggggcagtcagctggttggagcaggaggctgctcaatcccacgctgcgggctcctgcacaaggtcagatgtgcaggccatcatgaagtgagtgtcgagggtggtgtcatcctgaaggttaacgctgtagcggggagagcgtggggttgcgtgtccctctccctccttgtgcaataactatcgtgggtaattcttttatcgtcttttagataatttttacatccacaaatcagaaaaggaatgagaatcaaacaaagtaatacatgtggaagaactcagagaacagtgtcattctatagcaacaatcaacacagagcctctgctaagtgtcaggccacattctgagcacagcggagacaggactgagcaaagccaccacagagttcacattataaaaatgaaacaaatgaatgacaagtgtcacacggggtaacaggcatgataggggagacagaatgaggagagcatgtttaacagtaagaggttcgggaaggaagccggcccagacctgagtgaaattagccatgcctgtgcccgggggaagcaggtgccagcaggaggaacaccgagcccagcctcctgaggtggagggcatggggcatggtaacaggctgcacaggagctctgctctggagcacgcgatccgggcacaaccaagagcattggtggcaccacttgaacacttgcagccagctcatgacagcatttaaagtgtctttgctgatttgttgaaaacaagatgtaaaaatcactcagtgagaaggtggtatagaccatcagcctaactccaatcctgctcgggcttcacctcccacctcccagctcacgtgccctcgcagcaaacttctcattgctcctcaatttatctccagccccagttcctctgttgaatatcttctgccccatcattgcccctgttttctaagaaccagctcaaacatcaccacctcggtggagattccctcctcctggggttcacccaggaaactccacccaggaagcaggaggtgggattccttggatgaagaagaggtgagtgagtccccctatgatgtgagctagtgaagggttgtcatcagctcagagtcattccaaaatactcttaatacatttctgttttcattgtatctttaggaattagtggcgatgtttatgccattgcagaaaaaaaaagaatgatgctccatttcacagcttacagagctggtttcacatacacttgaatggtccagctatttctgacagctacaaaacacaggcgcacacaccaccttgccttctgggaagctgtaggagacacgttacctcttgacaggataaacagccacacactagagggtaaaggcagggcaagcttcaccccagcacctcctaacctggcacaggcttgaccacatgctacttcaatgacttctttttgagatcaaacacctgcccagcaccccagtctcctgacttcttgcttggagcctgcatctcagcttcctcagcagcaatgaaaaaggaagccaaccccgacctgtagaaatagtgtatttcctcaattccaaggcacacaattgttcaaattttaattattctgaaatcaggatgtgtcttacaattagtcggtacactacatgtggtgtttcttttttctttcatttttgttcaccccctacaagctgttcttaaaacaatggtgtgtcgtacaattgatgacatcttagaatcaaagaaaataatagttaaaatcatggggtggcaatttaaggtccacccgtgtcagacttctcgaagtcattgtgaaactgtgttttgttctgctttgaatgtctggtggtgtgaacccagagagactggattcctagatccctgaggcctcctggccgagccaggagcatggggcagacaaagggcaaagcatggtccctaccgacttgtcaggcctgccagccctgccactggctttgtgattttcgttcctgaattcatagagatggctgccagcaacgagaggtaatctcaggacacacaggcctgggctaggccttggaatattccggaagtcggtggccagagttgtatcaagccagacgggacacatatgggaatacaattacagcaaagccggcaaggctcagtgaggggcagagggcctggccacatgaggagccagtgctgtgggcaggcccgggtctgagtgctggctgtgtgtcctgcacaaccacatctcccagagtgcattcgtcaccatccactccagatgccccttgaacaaatgaatttcacagttgcaaaaggctgaaaaatgctctgtgacctggcacccccttggggaaccacagtgcattaaaggctctgagaagtcctgcagtaaagaaacctgatgaacttttgtttaagttaatgttttccaaacttctttgatcacagaatccttttattccagtaacaccttttacaatcttaagatgcgaattttctgcagaacagccacctgggaacaggcctgtcttgtgcagaagcctgagggactgggagccaatctcatcactccctcacttgattatggaaagatgaaaacagagagtggagaaatgaagggtaagaccagggaagagattctctctggggtcccaaaacatggccctggctatggacatacttgggggtggggggatccacttgcctgctggcctcttttgggcagttggtattggttgcccgggtatccccggggcagtagctgcagcagtggcctgatgggtgtgcaagcagctagctggtgtgtccagcacggtcttggcacacctggttgttttggaaaggtcttttcttgaacaggaacttgcatactcaaaaacaacagcaaaacacaaggccacactcaccccccaagggtaagtccgtggctcctcctgcacacccaggaaagatcccgtggaaacacagcaccggaggatatgggataagagacaacagagaggagtggtgcttcctgaatttaggaaacatagctgctactttgggccctctagatacttgaaagaaaaaatgatggaaatcactaggtgagaattaagttcttggtgaccactggctgtatgcaggacaaatagtactacaaagtactacaaagaatgcaaatctgtctgctgcacccagcaacttccagttggtaaaaggctatgtccctggagaggtaataactgccactgtaagaaattcctggggtccaatcctgaatccttctctcaacagcaggattctgggaaagggaagccaggttgttcatggacattcagtggaagaattaaggcaattaaatgttaagttttgcagggctggtcgacaagagaagaagggaatcataggtaatgagcacaactaaaatgaaggcacagaagcaagacggtcaggctttgctcagagaataacttcaatgagagcagtgagcaggtgctccagggtcctgggagacagtgggaggtgggtcacagagagcaggctgaggagtttggatctgctcatagagaaatatcttaaactaacagattccacgtcaggcaaggtctcttggcttcaaggagctggcagtcaggagggagcgatctaatgctgggtgggggttgagagcatctggcggaaagagggaggatgtgggcaaagagtttttcgataggtggtgtggttgtccgaggggaggccatgaacagagagaactgaggcagggagagggaagcccacaggccttggggttgggtcagaggaggtggtcaaggagggaaaggaaggcgagaagacaaggagaaaggaggggaagagggaggcaccccccctctcactggtgtcaggattcagattgtgactgggctttgcatagagcaggtgggcagctgtgacccacacacgatattccacccgaagatgtgtttttctgacgtgcacagtaattttcaaaagcaggaaaactttatatagatatctaggtttctctagataaatggaaaggcctggccttcctggacctgcacctggcagtgccacctggagctggtcacagctgctcccacaactcctggactgggcgcttcagttggctgtagtccccacccttcctactgcctcacacccaggtgacttcactcacgtccactgacaccgtctgcctgtccccaaggacactgaagtttgcaacctaggtgcagattatgtgcacacagggctgccattcacaggagggagatggtcagtggggtaggagggcgctgaaatccagcttgcatgcatgcccatgttctctgtatgtcccagggaaggaggtcccttctgtatttgcacaaagacatcgtactggctgaaaatggccctgcccgcaaattctcccaaaggtgtgtattctccattggtcacaatgcactatgtagcccatgagaaggagaccaactccgaggagctgagagtgagaggagactgcattctcagacacaattgtccagacacttcctttaaaaactacacgccaatgcccaataatgctcagccttggaaaacagtgagtgtctaatcaagccatttaaagcagggagaagattttaattggttgcaagggctggtgtaattatttacagcatacagaggttttccttttgaacctcacagcaatcaagtgcagcagcaatttttctttccctattttgcagatgaggaaatggaagcttatggaggttaagtgattggcctcaggccattgcatttaatactactaataatattaacagccatagtccatcctgggcaggcctgagcatctcacacacatttgctcatttcctcctcacccgatgagagcactgatgctactttttcctctctcccagaagaagacagaggcctagaagagtctgggcagactccaaagcccacccttctagtcccaatgtgagacacccccattaataacaccaaagggcccacacctaaaggcaaatcagtcaactaaaatccaggtctttggtctagaatctgtcactcttattcctgcataatttttaacactggactcatggttccttgagctgaaatggttcatgcaggatatatcaaaaatctgagcattaaccagagtgtttgtaatgacaaggaatctgtgccttttctatgagacataccagctctgtgtttgactctggtcagtgtaggcgttaacttctgatctgaatcagcaagacctgggttccagccttgccctgcaacccaccagtggtgtggccttggacccatcgcctgcctgtcaaggcctcatcttcttcctctgggacaagggcacagccacagcccctgtgttatggcaacacttgggtcaggctcaggtctggcgcttggcaatcagctgatgatggcagggaggctctgcttcctgtcccaggcagaggggatggcacggcctgtgagtaatgcaggtttgagtggtgagccagttcagagcaaggctgggaggacctttgggcacagtcaggctccagggatgcaaggcgtggctccttcaacttgtctccagcacagccacagacgccaccagtgtggggagggagcccctggtcattttctgctggggagcagaatcgctgatgaagggcccagcgccaatggggaagaggcctccccaacaaccctgggcctcctgcccgctcaagccacttaaaaatccgtaccgtgcccacaaggctttccagtctccatgtctcaggaaggtccaagacagtaggtggaggtgggcacatgacagggctttctcattgcctccaaacaatgccatgtgctgggccatattttctgctcttctagaagcttctgtgtcccgggccaggtgggtgctcattgtgttccctctgtctctgggatcccctcctgctcaggatttagggggattgggagccctgtgcccacctgccagctcccatttactcacaccaccctgcaggctggaggcttagccacttctcaggaggagcctagaaaggatattggtcgcccagctgctgaacctgccccagcatccttgagggtcttgaaaatctattttatgctgggcacctgtaatcccagaaatttgggaggccgagacgggtggatcacctgagatcaggagttcgagactagcctggccaaaatggtgaaacccaactctactaaaaatacaaaactagccaggcatgttggagcatgcctataatcccagctactcaagaggctgaggcaggagaattgcttgaacctgggaggcagaggttgcagtgagcgtgagccgagattgcgccgttgcactccagcccgggcaacagagcaagactccatctcaagaaaaagaaaatcttaaaaaaagaatgccactgtcatgtggaaacacctctaacaaacatgaggccagctaagctggggtgggggccaggtggcagcctctgaggaggcctctgcagtcctgggtggatagttcgggtacagcctgtgaatatgagaagctcttggccactgcacatggctcagttcccatcatcgtgcatcagacactggaagacagtagttggagctgctggacagggctgttttttctcaaccagacagtatccaggtgcctgtccctcagcagagggagaggtgccacaaccggctaccatgataaggagtcagctcagagcacctttgttggggggcctgaggagatgaggtggtatggggataggattctggaggaccctgctggaacaggtagaaggacaagaataactccccactgggactggaggagaggaaggcacatgggggcccttggcagggtggagtagggccataggtaaaaggaaagaggagaaaaggacagatactggggagagtgagagggaagggaggggaggagaagggaggcggacacctccagatctggcatggcagaagtctccttggaaaagatgagtgcaagatgtgggaggaagagtaggacgtgagggtctccaaagtctgctcgaattttcaggtacaaatgacctcccatcagaatagccccaatctgagttctgcagaggctgagagccaactcaagggcatggagtttctgaagccagaagggaccttgataaacaagaaagcctgaggcccaaggaagttaaagtgatgtgctgaagataacccagccaaaagggggcgcagcctggatccacacacttcatggtgctctacccactacaccataaaaggagagtccaaacatggtaaagatgaatggcagactggcagccagtgctgtctccatgacagcactgtcatggagatttacattgacattgacattgacattgacattgtcatggagatttacattgacattgacattgacattgtcatggagatttacactgtcatttacaacctggcatgctttagatggtaaagtaataaagcagaattgatgtgtctaaacaaagacctccagtaccttggaaaactgcacacctttgtttagcaattgcgttcacatttagtaattgttttctgagtaatccattcatcattcatttattcctatgtctggtattggcaatttaaaaataaacacaacagaactcccactgtataattgctaaacacaatgacagctataattgaggcactgaaggaaggtcaggggagcccaggagggcggggctgctgctgcctgctgagctgggagggttggtggcaccccttgccctgggttgccatagcagatatcataatcaattacggccgtctttcatgaggaacctggatctttcccaaggaatcagtgagaagtttcagctcacataccatctctgatttgccatccctgggatgttagctgaatcctctcattttacgtggaggagactgagggccacagagttcaatgcagggcctagtttagactccagaccagctgccaagagagatgaagggctggtggagaccagccagcaagtggccatgctgcctgctgcagaccccacttcacactctcatgccacccccttgggctcactgacaaaattatgctcacaaaagcagtgctctgatttctatgagatactgtagaaaataacttgttttttctttttgtattactttttattgtataatacatattcatttcagaaaaactagaaaatacagctaaattggaagggaaaattaaagtcactcataatctaaccactgctatttacatttataccttattggatatattttcaatatctttctaggcatttttctctctgcttatgtgcctgtggtgttatgatacatatgcataggttttcattcatggttcctggctcatcactctcatagtccttgttataatgttgggagcgttaggcctcaggagacaacgtccctctctctgagtttttcctgttctcctttctcctgcccaaggcgggactctaatccgattgtgggtcaaaagaccttcatttcagagcaggtcctgccccagcccctaaaggaagaaatgctgcacagagaggctaggaaaagtctgaacgggcaggtcttgctgggtttagattgtgttctttttgcccaatcacatttctacatggttgtcagtcatgccatgtaatgaaggctccataaaaacccaagacgggccaggtatgttggctcacaccagtaatcccggcactttgggaggccaaggtgggtggatcactttagcccaggagttcaagaccaacctgggcaacatggcaaaaccccatctccaccaaaagaaatacaaaaattagctgggcatgatggcttgtgcctgtggtcccagctgctcaggaggatcgcttgaacctgggaggtgggggttgcagtgagctgagattgtgccactgcactccagcctgagtgacagagcaagagagagagagagaaataaagaaagaaagagagaaagagaaagagaaagaaaaggaaaggaaaataaaaggaaggaaaggacaggaaaagaaaggaggaaggaaggaaagaaggaaagaaaagaaaaagaaagaaagagaaaggaaaagaaaaaagaaaaggaaacgaaaggaagggaaaaggaaagaagaaggaaagaggaaggaaggaaggaaggcaggaaggaagggagagaaaacccaagaggacagtgttcagagagctgagcacgtggagacagacaggaaggtggagtagtcatccatgtgccgagtgggtggctgccccagctccacgaggaccggactcttccagaccttgccctgtgtatctcttcatctggctgtttatttgtatcctttaaaatatctttctaacaaacctataattgttaagtgtttacccaagttctgtgagctactctagcaaatggaacccaaagagggggtcttgggaaccccagcttgaagtgggtcagtcagaagttccaaagacctggacttgagactggtggaaagtgggaggcagtcttgtgggactgagctcttaagttgtgggatctgatgctatctcctggtaggcagtgatggaagggaattggaggacacccagctggtgtccactgcttggtgtgtggggaaaatccccacacatttggtcacagaagccttcttctgttgttgattgctgttgcagtgtgagagcagaggaaaaacatgatttgagaggtttttccaaaatggttcttgagtggtaatcacagtaatccatccaccttgtgagtgtgcatgcatgcttatgtatgtgtatatgggattacataaatatggctcacatgtgtatgatcatatttgcacactcccttgtccacttacttatatatcaaagtttccctcataatgtctgctctgtgtcactatgtaccctcccctgtcctccattccccacaccaagagtattatgagtattaaatgccacgtgggcaggttccccaggcaatgagggggtgggcctgtcaaatgcaggccatgcagaatgccgcagggcgggagacgggtgagccaagggagccgagagttccagataacagagtgcacagcaaatgccatggcccgcgtccagcaaccaggagaaacagaactgctgagctcagaataggccaaggccgcgtctgctagcagggagcaagggcacagcctgctgtctggcctcttctgccccatccctccaccgggacatggcccagatgagaaagagctgccagacggcaagtcaagcgtggggcgggagaggacaacgttttatgcaagagtggattctcggagcctctgcactctccatcagggctgctggcatggaaaacacagagaaaccatcacctaggacttgattgaactactggacttcccagaagagtccaatttaaagcaaagaggtccagagaaaaaagcattctagtgacatttttatatatttaaaaactggaaaaaagaaaaaataattagaacactgagttcccactgtctatgaaaaatgggcccagccccgctgacaaccaacacgcctcacctcacaccttcccctctgccttcgttctggccgtgagccctgagccgaccatgcacatcttaccacctggagaacctcaaactctcctcttgcccacccccaccaagccccacattcaaaaggcttgcccgagaggcctgcccacttccttggcagttctggcctccagtgccctggcaggtgagtgacttctctgtcctgtgtagcatttggtacaggtatgtactgcatttataacacttaccatactggcttggggttgtgacacatcttcaagggagtccctggagagcagaaagcttgtcctattcatgttttgcccatcttgttcctgaataatacctgcacattgcaagggatcagcaatatttccaaccaaaccataaacttctccatctccccttgaagtcttctcgataactttcccagaaactcccagaaacaacaatggctgtcactcactgagaccctcctatgcgttaggccctgtgccaggccttggcattcacgtgtcacttaaacttcaggtagtttgtcagatttagcaaaaataataataaataataatttaggatatccagttagatttgaatctcagataagcaacaaataatattttagtataagtatgtcccatacaacttttataccaggcatcctatattttatctggaaatcctggccccagggcaaccctacgtgagaaacttgtaggtccattttacatgtgaaggaactgaggctcggagaggttaaacaactttcccacggtaacacctgagatggaatggcaggcagctgacttcagagtcccccaacacggcctttgcttgtctgggagagggagctccaggtggaactggtaaagggggtgaatccattggctgggagatgtcatgagtttgagactatattgggagcacccggcacatggtggccatcaagcaatttttagtctctctctcccttccttcccttgcgccaaattggaaattcccttgagaccctcacacggagtcctctgcaaacacattgaatttcagccctcataggaaagcagaaggaagaaggatgatgttggagaagatccctgccatttgatttattacaacagtctgaagcctcagagagctcagagcaaagagaccctggaatgcagccccagatccctggaagagactttacaggtgtcacgttggagagtggagagtgtgggggatggtctcaaagaacaggagcagagattatcagagacaccacaaacttgaaaagtcaggatgggtaggacttgaggagaaaaaaaaatcttacctttacaatagcttcaaggaccacaaatttaagggctctccagaggctttaggacagagtcaaggaagtgcttcctggtcgaccctttcaacaaaaactgtgcccctggtctcactgctgcaggcagtgatggtggtgtcaacatctgctcttctcgggctccctccacgcctctgaaaacatggaagtgcttttacccatccagaaagaggggcagctgaaggaaggaggaaagggggtggtccagcacaggcgcagcctgttgggaaccttctgctctgtctgcgcatttgtgatggttgaatgggctggcgcgggcgtctaaggcaagggactgcaagggaggctgcagcctgccctcgtgacccagcacacgtcagatggccggagtgggaatgcgtcagagatttgcctttggacagaactgaaaggatatgaagcagggatgagagaagttctttccataaaaatctgaaaaccaaagggccaaactgatcaacttgcagaacgggaaggactgacaaaaatctcaggaaatcaccaaggtcacaggggaagatcatgaggaaaatgtatgtgaggctcccagcccagccctgccaccacacagtgttggccctgactgccactcacccgggtgccccctggactgcaagcacctggcaggggctgggctttattcctgaaacagtagggggtcctatagcacagcaccaggagaatatatagcaatggatgtccaccccatcctgcaaagtcctgctcaagggccagcccccatatccccagctagaagccgcctctccttctgcaacgttctactgcggctctccacctctcttgggactggaagtgagaagcatttttcacggtggttcacaaggtctcagtgcagatggaaaatagagagtaggtgagttggagagggtggcacagactgaaccccagacaagaaggctgtctggggactcagccctggtctgttagcagttacgggtacccagagcaggaaagcaatgcagaagggtcactttaccccaggccccacctggagcccagctggggctgtccacctgcttcttcatttgtctttcctcccagatccacatcctcgcctcacatcaggaaggcccagtgctcacttttacccaccatccgcctcctcccagttgggcgagtagccctggctgctgcacagggtgcctcccgtatgccaggcactctgctggctgcagggcagcttaacctgcagggcggtcaggacagacagaatctttgctttttcttttcatctgatcagggacttctgtctgatcagaattaggtgtctgggctgtcccaggcaatgcacgacagtcactgggctctcctctcgaagattcaccctttccagatggccacaatggtggcggcagccaagcgcccacctccacataagtcttccctcttctgtccaagccaaatccactcacaggaaaggatctggaactacatggagctaaggagtaataactagagacagttcactaggatctcgtgtggagcaggaaatcaaagttggggactgcatcacactgctgcaatccctattaaacatttgttgttcaaagttctttctcaatggcctgctggaattttttttcattcttcctctttggcctgtcttccagcagtagcaccagcctccccagcttctcccgtctcctcctggacttcctcatagctgtaggcttccatgttctcaactctattattcagaggagttcagctcagtcacgtctgcgccagagctttgatgacccacctgtcagccacactaagggccctgccatgaataaggcctccgtcactgaggatcctgtacccctctgccataaactcagtgacctgactgccagccaccaggcagaacctactagacttctctaaaatagataccgtggcctccttcctcaatcatagtcaaggtctaagcttccttatcaaaggcaggcagtcctgggttttacggcaagaagtgtgcttcctatgtgcaaggtgctgtggggaagggctgagtgtggaggccatgtgtgcaggtctttaggattttagctgagctgccttttcttgcagtttaagaaaaaaacagccagccgttccctccttgtaataaatgcctctgcatatttgaagacagtagttaggtcattcttgagctttctcatcttcaaactaaacaacggtggcccctgtaacctttccttggcaaattgtaaggcccatatgcagaggaaaagcaaaacaaaaccatctgatggggaaggcctcctatctctaaccaagtgtctgttttgaaatgcggtctgcactcgagtctttaattacatgtaaattcagtagcttcaagtgtctgagccagtgggagaccaggtgctgctcatcaggccccttggatatgttcatgctgcaaggctgggtgatagcacttggcagacgctaggatttcttctcttcagattcattttggggcaggaaaaggggcttccgtgagtgacccaggagcacagtcagctgacacttcctccccaggttccctgagggtaggatgggccccaagagcctccagagagccagtggcctgctggaaaggctgccctctgcctccacagaagccagcaagtgtggcttccagatgtccctggtagaggctggcagcctcatcctgcagccagcgtctcccaggggaggcttcctgctgctgctaactcagagacaggggatctgctaagcgcctgccctcggtgggggtgttctgatcacatcaacttctttcccatggttctttccaggctcctttcccacatttgcagtgtgttatcttgggagaccccatgtgttagtctgtttgtgttgctgggaatacctgaatctgggtaattctttttttttttttttttttttttttttagacggagtctcgctctgtcgcccaggctggagtgcagtggtgccatcttggctcactgcaagcgccaactcccgggctcacaccattctcctgcctcagcctcctgagtagctgggactacaggtgcccgccaccacgccaggctaatttgagtctgtgtaattcttaaagaaaagaggtttatttggctcatagttctgtaggctatagaagaagcatggtgctgggcacagtggctcatgcttgtaatcccagcactttgggaagctaaggtgggtggataacgaggtcagtagttcaagaccaacctggccaagatgacgaaacgccatctctactaaaaatacaaaaaattagctgggcttggcagcaggcacctgtaatcccagctactcgggaggctgaggcagagaattgcttgaacccagaaggtggagcttgcagtgagccaggatcgtgccactgcactccagcctgggcaacagagcgagactccataaaaaaaaaaaaaaaaaaaaaaaaaaagaagaagaagaagaagcatggccaccggcatctgcttctggtaaggactcaggaagatttcagtcatgaccagtcatggtcaaaggggagcaggcatgttacatgtgagagagagagcaacagagagaaggatggaggtgccagatttaaaaaatccaatcttgcagaaataagtagagcaagactccgtaccgtggggacggcaccaggcccctcatgagggatcctcctccatgacccaaacacctcccactagggcccacctccagggcccactggagatcccatttcaatatgagatttggggggaatgaacatccaaactgtatcatccaaggtcagtgcgtttctctgtcctccagttttgcctgccatgagcagctttcctgtgagccagctgtccttttcatctccagggtcattttcttccttcagtgcccagtgtttggactttaggctgaccttcaggattgtggagtcacagaacaagctcatataagtgtgtaagcaaggcagcaaattttttaaaataaagaaaaagttatttagactgtgccagtcagtctgtgtgccatcctagctacaacccagggtggatgcagagtggagggtagaggagtgcatccctcactcttatctgtgcttgtccttcctgcatactgctgaggccaggagcacctagatttgccccagtgggactcacctttttatttatttttatttttatttttatttttatttgagatggagtctcactctgtcacccaggctggagtgcagtggtgcgatcttggctcactgcaacctccacctcccgggttcaagcaattctcctggctcagccccctgagtagctgagattacaggcgtgcatcaccacgcccagctaatttttgtatttttagtagagacggggtttcaccatgttggtcaggctggtctcgaactcctgacctcgtgatccacccacctcggcctcccaaagtgctgggattacaggcatgagccgccatgcctgacctggactcacctttgaggagacacggttttggccaagatagctgttaagtacaagtgttcaactggtgcccaaccaaagggaaagcaatcttttccaacagtgaagaagaaattggttgtgtctgcttttcaacagcaagggggtaagtctcaaatatggtgcctccattaaggtgttcaataatttcaactacatgaaaaatgtgccttgggaatgacttcagaacttaaccctccagggagagatgcctctactgtatggcccctggcctggtctcagattggatcataagctccctcattcttgtatccccatgcccaaaactgtgcctggcacttaagggcccataatacatatttttggctttgttgaatagtttaactcattagtgatgcaaagtcccaactgcatatttagagatatttatgtgtgcactacattatggatcgtatgggtgagaaggaggaactcaaggagaataaatcatactttccctccccaaaatgtttataaagccaccaagaagacaggacatagacacatcaaatataaataaaatacaaaaggatgtaccctgacatgccaaatatgtgttcacagaaacaaagttcctcttgccaaattcctgttgtctaaagcagtttttcctaaaacatattcttcagaataccagtttctcagagtgccaatgtgaggaaaagctttggtggtcagatgagtgcagggctgggttaggctgacttctttaccagagggcttcctgaagacttaaagaaatctgtattgagatataatttgtatagcataaagttcacccactttaagtaaacaactcattggcttttagtatagagttgtgtatccatcaccacaatgtcactgcagaatgtttccatcaccacccaaaacacctcatgctgtttgcagccatttcccatccacttccttcctagcccctgacaaccactaatttaccttctgcctctatagatttgcctattctggacatttcatacagatggactcatttactgtgtgatcttttgcgaccagcttctttcatttaacttaatgttttcaaggttcatccacattgttgcatgtatgcactgatggacatttgggttgtttccactttttggctatcataaataacgtcattataaacattcatgagcaagttgtatttgaccatatgttttcagttctcttgggtctatacagaggagtggaattgctgggtcatatggtaattctacattgagcttttagaggaactcccagactcttttccaaagcaggtgcactattttgcattcccaccagcagtgtacacgagttccagtttccctacattctcaccaacacttattattgtctgtccttttttattatagccatcccagtgggtatgaagtagtacctaattgtgattgtgattttgatttttgtttccctaatgactaattgttttgagcatttttcatgggttcagggcctttgatatgttgattttttcacaaatcttcaaaaggggacacagtcggcagcagttcctaaatgcgttggaccatggagccaaacttgcaaaagcagctcctggaatgcaagcccgtacccgaaagctgggaaacattggctggaaaccagcctgtgctggaaatgtgagtttggtgaatgtccttaggtcattacttctgcaaattttgctcaaagaaagggaatctgaactctccacttttgtacattaagataataataataataataataattttaccccaagatatggcaccctggcatgatgaatattttgaattaaaggcccttggagacaagcagatgctggaaaaggcttttggttatctgtataaagattggacccaccaaggacagcaattgctttccatctgttccctgaaatctcgtacctggatggaccttttcacaagataatgtctgtctctcaggctcattaaaattcaaaagagaataatttacaggttagtttctgtcccccctcccccaccatctattcattctcactaatactcatttgttgcccctaacaagaattacctacattccccacctcctctctttcctatgaggccttgctgaaggtcaccactgtgcctttacactcacccaccttcctttccctactgcttacctgccccacaagccagtcatggcctctcctctgagccctgtgagaattcttagaagttttatcctcagtataattcaaatgtgttcccttctccaatacccaaaaacatggtatgggattattttttcagtagggagacaaatagaaaggaggccattcaggtcttctatattttaagatcacaatcttgactgaacctataggtgacccagtgtgcataagctgctatttcctgtcctcctagtcatctttgtgtagaatcaaagacacccacctccttggtacctctcatttgtcacttttcaacacttcctggcaggcaggcagcataactggtcctgctgggtgatccagaccacactctgcaactctttcttctgagccaggctcccctactgtcttttcatttatgtcaaggcaggggaagacctcaaagggctcttgcatcccagtctcacttcccagagaggcacgaggccctccaggatgtggggacaggaactttggggcaagccggggttgtccagaagatcaccaggagggctaaatagtagaaaggagagtcttattggtgatatgtttgcaaactgggaaaagatagcctccagtgtggagcaaagatgctccttcttcaaagagggcaagggcagcttggattttgtgccttacagggtcggtattatataatagagtcatgcatattcagtaggtttgggggaaaagctatatatatttatgaggggagccaactacatgggcaatggataaacatacatgtaacacatcccatgttcacttaggggcaggattttagcattaaaatgaggtggaatttggctctttacatcaaaaggtgagctatcagacacaaaggcagtttgtgcacaagctctccaaagggacttgagggctacagctgctcatctggaaagaatccttgtaagaccagtcctctgtccaaccagagttaggaggcatctgacaatttgcctgattagctgtactgttgagagtttaacaagggtgtggtttttcttgtaaccataggaatttagggagttgccacgccagccaagccctaaaccctgggcttataggtaactttttccctaaccttaagatctgtcttagttggtaaaggggtgtctattttggtctctcagatcacactagaaacctctcaagtcctgtattcttattataaagctgattataaagctttacaatttactttgtgattactgtagcttatcgtaaagcaactgtaatcagtaggattggtgtcaagatgggtacacagatgggtagaaaagaattgagaatccagaaatggactcatatttacatggtcaatttatttttgacaaaggcaccaaagaaatttagcatagaaagtataatcttcatcaaatgatgctggaaaaattgagtaactatatgcaaaaaagaaagaaaagaaagaaaaaagtgaaaacctccacctccgtcattacttcataccatataaaaaattaactcagaatagatcatagacataaatgtaataactaaaactataaaactcctaaaagaaaacaggagaaaatagagaaaaccttggtgatcttggttttggcagtgatctgttaaattcaatagataaaacacaaattagaaataaggtattgactgaacctcataaaaataaaacataaacttttgttcttcaaaagacatttaggaaaatgaaaaggaaagccccagactgaggtaaaatatttgcaaaacatatatataataaaggttttgtatccagaatgtataaagaagttaagaagaaaagcaacatactttttttttagttgacaaaagatctgaaaaagacatctcaccaagtcgtttgtaggactggcaaataagtaaacaagaagaggcccaacacctttagtcattagagaaatgaaaactacaaccacagtgagataataacacacactagaatggatgaaattgaaaagtctgaccatatcaagtgtttgcaaggatgtggaaccaacaggaactccattcacagctagtgggaatggaaaatggtttgaccatgctgaagagcattttgttgtttttttaaaagttaaaaatatatctaccatatgactcagtcattccacacttggttatttacaccccacaaaaaatgaaagcatatattcacacaaaggcttttaaacaagtgttcataatagctttatttgtaattgccaaaaaccgaaaatcacccagttgtaccccagcaggtgaatggataaaccaattgtgacgtagtcatataatggaatgctaaccaataatttaaaaaaggaacaattgatacctataacagcattattgaatccaatagaatgatgctgaataaaagaacatggacaaagaaagagcacatactatatgattttagttacataaaattctaggaagtgtactaatctatagtaacagcaagcagatcagtatttgcctattgggggaaggagttggacagcagcaggggaagggttaaagtcacattttagttttaaaatattcagcatgtattttgggctacaaaatagcacaaggaaactcttgggtgtgatggacatgttcattatttaattgttatgatagtttcagagacataaacataaaaaacttctcaaatacacacttccattatgtacaatttattatgtggccattatacttcaataaaactgtcacagaagaacgacccttatcttctggagatacatgctgaatgtcttacaaataaaattatctaagaactgaaattggcttcaaggtaaagcaggaatggggtgagaagtgtgtgtgacgtggacacaagggtgatatagaagattggcatcaagtgacagaagtagacggtagattcatttttatatatgtttgaaatactacattacaaaatgccagtagaaaatctgagtctaaccctaagaatgcagtacatcctactgccatgtttctttctttagagctgaggagaggcctctttactttggtcggaaacctcattaggtttgatttagttcaataaaaatgtgtataggtgaaatagtccatacgaattcattacaattgatgtgaaacaaaattaattaataattaatccatgcaagtcttttggtagcctgcattttatcaaagaagggacccatggcaaaggctgggaagggacctttaacaggggagcatgagttccacggcagagttgccctcaagtaatgctttgtagattggtacagcacatgtgcatcaaagtagtgaaaggattatgaaatgtgaataaggagttagaaggtggaccttgaagtcctcctgggtacccatttccccaagagtgagcatcattattcttcattcccatacttctacaggatcaatgttgcagccacagtaggtggaaaattccaactctgctaacagttgggagcgtgtccctctaatgagaggacctgttcatgcaattttcttgatgtctggtgaacgctcccacgttatatcttcaaaagactttactacctgagagggtttcatgctaactgctgagtaaaaccatccagtgctgagcacgcagaggagggagtagggatacaggtccaccacagcccaggctttggagtctgccaaagcagtcagacaatggtggtcagaaaaggtgtgtgagtcactcgactgactacttaaatccaaaggaatttgtttatatggaccaatcgttttagtaagatggtttgttatgtgcctttataatttaacatattaattttatttagacaatattggaaaagataatgcaatccggtgatctcagcaaaattctctcctctataaaaataatgagaaaagtgacaaaaataatcagaatcaactttttagaactctggaaatttaccaaagtgttgcagccatccaaggattgtttgctcaagcaaaacaactgaatttcacctagaatagtgggtttgtgacattttaacttgccccattcgcatcaccctttctccagcttcatggtagccttgaaaaccagcagcccccagtcacagagaaaacccgtctagtggttctctgaaagaccccacttgcaaggctgtctttatttaatctgacttggagtttgcccagtgtgaaaagccatttcttcaggggcatttgttaaaaacatttagaggcaattgtttaacttcacagatgcttgagatagtggataatagttgcaacaaacaataggctaattaaaaagcttaaagtgaaaactggagaatggatgttcataggggctttgaaaagctctgacatattctgggaaatctggaaggccatgagcaggagtaagataggctttgcacatgcacagagctgtgtgcaggcttggaaaagatcttagaaggtcctaaaccctcatcaatggctcccttaaagttctggacaagaagatattgtcaaaatctaagtttaaggtggaattgtcaactgcttggatgagtgtggaggacattccccaacatgcatgtagagcacctcagcaaaaacttggagatgtaaaccaaaaagaaaaatctaaggtcgtcctaccccaaccatctgaatggatccctcctctctgtcaagggcattccaaagtttacctgaaaaagaagttcaggccatgatgggaaggcagagctggacaaacctggtaataccctcctcctttttggagttactaacagaacagactctaaatctgataagaaacatttacaatctagtctgtctgaagcctgctacctggaggcttcatttgcatgacaaaatcttggtttccacaacctgttatcataacccagatattcctttctattgatagtaactctttcaaccaattaccaatcagaaaacctttgaatccgcctatgatatggaaacccccacttccacttgtcccaccttcctggactgaaccaatatacatcttccatgtattgattgatgccttatgtctccctaaaatatgtcacaccaagttgttacccaaccactttgggcccatgttctcaggatctcctaaatgctgtgtcatgggccattggccactcatatttggctcagaataaatctcttcaaatattttacatagtataactctttttcattgacagagacttactagttcctgatccttaaagaaatttctctccaatcattagatgaccattaagctaacaaagcagagacgtcagtggctacacaagacaaagaatacagacttataacacaattacatcagaaaagttactaaaaaacaaaaacaccaacaaactgtaaaaacaacataacctgaggagtagagaaagaatctgattttttaaagttgccacattgcatttttaatgtccagttttaacagaaaattacaagacatgtaaggaaacaagaaaatatgtctcatacacaggacaaaatcaattaatagaaactgttccagaggaagcccagacataaaacttattagaaaaagtctttaaatttagttcaaagggttaaagaaaaccatgtctaaataactaaaggaaaggatgaaaatggtgtttatctaacacagaatatcagtaaagagatagaaatgataaaaaaaaaaaaagaatcaaataggaatgctagagttaaaaagataactaaaaggaaaattttaagaggagctcaacagcagatttgatcaggtggaagatataatcagcaatcttgaacattgttcatttgagattttccagactgagaaacagaaagaaaaaaaattatgaagaaaaatgaacagaacctcagaaacctgtagatctctatgaaacatactaacatatacataatggggagtctcagaaggagcagaaaaagagaaaggtgataaaaatatgtgaagaattaatgtctgtaaacttaacaaattgtatgtaaaacattaaactgcacttccaaaaaaaaataaaaaaaagccaatagactccaagtaagatacattcaaaaatatccacacctggacacatcattattaaaataccagaagtaaaagacaaagagaatcttgaaagcagtaggagagaagtgactcatcccacagaagcaatcctcaataagaacaacagctgacttctcaccagaaaccaagttagcaggatggcatgctggtgttggttacaatgtggcatttgctaatattgtgcttgtctcctgaaactcttatagaattgagatcttgagcttgttttgtttgtgtgttcatttgtttgttggtatggtagagattctcatacaaaaagccacttacaaggaggttccttaggtccatctctcttctctgcagccttgctgctgttgttcctgttggtgcttctacatgaagggtcttcaactgtctcattctctggttatgaagttagtaggacataaacctaagcagttttctcagtgggctttccaggcatttcacagtgatggtccttctgagccctgacaccattggtgccagtagcatgcaggcatggcaggtcactcttcccagtagaacagaccaggctccacaggaggaaatccaggagctcctcacttggatagggttcgtgtaaagtgacagagtcaaagatgctgtggggttttaagtctggagaagcagaatcaactggggaggttctggatgttatcagaaccaacttcacagctttcagcactttgtagagaggattaaatgaaataatgcagtcatgcaccaaacatgcttagaacaggtgctgtccaagaaatcttggccttagcaatgagagggtggagcagaacagctgtttataaaagagaagacccatcgaggaaactattttacagaaaccacagaagtcatctggcctgggattaagaacttgatgattttctagggcaactattgagaatgcagcaaggagtccactgggaagaaaccaacagcgtggcagctgcaataagggcccagttgaggccagagaatcgcaatgaactctgcctattgacaagtggttctccaaactctggtgttctcgccctttaaatggaaataattatactacctatctcataagatcattgtaataccatttgtaaatgctgagtactttgcctgacacaagatgttaactcaataattgatggtggtggtggtaatggtgatggtggtggtggtgatggtgatggtggaggtggtgatggtggcagtggtggtggtgatggtggtggtggcggtgatggtgatggtggtgatgaggtgacgatgatcgcagtggtggtggtgatgataatagtgaaggtgatgtctcaagggagattgtatgagactcctatagggtagaacctactctgaaagaactcacctcaattaagcttgattggagtaaaagccaaggctagacacctaagcttcagagggacagagaagctactctaagtaagagaggatagggagttgattttcctgggtgaggatggagagtctagtgggaagagggtcagaaatgaggcctcaaaagacaaataactttgggaaaaaagaaaaattattcattggggaattaattttttgtctttggaatgtgcaatgttaacccctttcatggtctctttacattatcttctgtaaagtctgtgcttctcactaatggttttggaaaagtgtacctttttggttatcttcaagagggattgagttctgtgttgagtttggcatgtgataaaaacagactgaccccatgcatgcaggatgcagaagaaaaggtgcagctgatacccaggatgtattattattactgtgacacagtgaatctaaaagaggggtcagtggatgagggacaggagatgcagctaagagctaagagtgtggttagtgagacagtgaaagagctgagtgactcaaccctaaagggaattgtatcagggagaagaaagatggtttaaacctccaaggaagccagaggattacagacgagttaagccagtgttgagtgatggtgctgagggtcttgagcaaaacagcaggagacagtgcactgcaccccatggtggaggttggtgtttgtgcctgagaaccttgctcttgagtcaggagtgtatgaccttggacttgggttaggacttggacttgtgttaggacatgggttagtgtgcagtttgtacttcttttgtgtgtgtgagtctgggagagagaccaaatttcttaggctctagcagcaggaatattccttgtactctaatgacataaagtaacttgattctcatgtctgaggtatcaattagagaaaaatagattaggaaagggagttcagaggagcaaaagctggcaaggctcgttcagtcaagcttgcagttcagtacaaaaaggatttatttgaatgcctactgtgtgcttagcactatacctttgtctccaaattagaaacataaggctgctttcatctaattagcaaacatgttataagtacctattgcatgttaggttccacacaccaaaaattgtcctggatgcctggaatgtgacttttcttcttccctttacctccttgcaactgccctcaatattaaagcctatttataattcattcaacattaattttattgaaaaagcatttggtttagccaaaacaaacatcaaactccatatacttttttcagtctgagagtggaaaatcaaaactgaccttgtgttatgatttactgtatctccccatcctggccccacaggcccataaagaagagaatctggtggctgttttttctcaacagtaccatgacttcataatctgaactatatccaataatactgataggatggttttaaattatattgcctttcattttgttttatcaaggaggctatgaagtccctgctagtgttgtctttccactttgggaagtgaagcctgtgttctttgtaataggctttcaattgttgctagtgccatggatgcaattttcaccttttaagctcatttaaatgtcaacaattctctacctgcctcttcctgaacagagtatttttgcacttttcaagagttaaattgaggggtgcagtggcttacacctgtaatcccagcactttgggaggccaatgtgggtggattacttgagcccaggagttcaagatcagcctggccaacatggcaaaaccagtctctactaaaatatatatgtacacaaaaattagccaagcgcagtggtgcacgcctatggtcctggctgcttgggaggctgaggccggagggtcagttgagcccaggaggcagaggttgcagtgagccgggatcacaccactgcactccagcctgggtaacagagctagaccctgtctcaaaacaaaacaataataacaacaaaaaaaacttaaaaaaatagttaaattaggactaaaatttcagatgcttttagtgctgcacagtcatctatgaacagggcctcttttagattaccattgtatccgcatgtattaatgtgctgtattaggcaggcccacttaaatctgtcttgtcccccagttggtgttttctgcttccactgatacaaaatggctctcccaggaaagggacaccctcaaagctcagcttctcacagggtcctctgcctttctcaggggagcttggagaatgggggaattggccctcatggggcagagtggaaaaagggtctatcttgtgctgaaaacagacacttatatgactatacggagaatgggtgctatacaacatgcctaactcttggattgatttttctagaaccaaggagtagaggtggggcaccaacactattccagctggggctccaaattcctgtctgtaggatggcctctgcctgaggtcagaaagcaggagcaccgtgaggttcaggaccgtcttctgcacactggctaccaggaccaggaggctattctatgctctgtccatcctcactgtttaaccagaaagggcatgcccaagcctacagcaggggctgacagcatctacagggttagaaagagatggggtccatgagggttccaagtccagggactgaaaacaatcccatggccccagagacaaaattacagctcaagtcaccatgttcacaactctaacgtcaacacaaggctccctcaattgccttgctgtaaaataggtgaataggtgtagtgggagattcagtggccaagcctgggtcccaggtaaggtgactaaccatcccagttttcctgaacagagaaatttcccaggaaactttgggttttaaagccaggaaagtcccaggtaagcaagggtgagttgatcaccctggcagggaactgattcattcaattctggataattgaataaagtccacatcctcaccgggaacattctactgaatgataagaagaagttccttctagttttgcctgtttcttttccaggatctgggtccatgggacccctaccttatcaactgtccccatacccaggccctggctctcatccctacattgacctccaccccttcctccacaggcaggccagaaagcagacccagggaggatagcacatgtcttcggctacactggtgaaggcatcgtgcctgctccacagcacatttttattcaaggtattgtatttgcaaacaaaaatgaagtcccacaaatgcgggactccacctgactctcaaaaagaaaataaatcacaagtgtattttaaaagctacatttgagattagcaaactggaatcaaatgacagatactttatccagaaagcaacagacattcttttttcagttgtgcttctttgttaaagcatcttgcctcccagaggtataatgcgttccccaggagcaaacactgaagcgcactacagtaatatctttcaagagcggtgggtgtggttccagcaggattctaattatggcagagaaacagcaactatgaccaccaaaccaacaaaaatgatgtgaaatgcaatttcttaatttcagtctcaaactgtgcctgggccaatgtatgtgaaagcccgatgtccatgtggattcaaatcctgattcactcaggcatggtacttaacattctaagcctcagtttcctcatctgtaaaatggctttcctatctcacacaggcagttagccaaggcctgatatgcagaaagtgctcagctgctgtgactcttcacccttcctgtgagatgccttctttaaccccacagatgtgtaccatgtgatggccaagggagcttcatcaatcatggcatctcaagggagctggagcagatgaggaggagatggaggtcccaggaagggctgtgatctgcctggggtcccacaatgggaaacaggcatgagctctccacactccctgtccaatgctctttccactacaactggctgtcggtctcccataggacaagaaaaaacagtcaaaaaggaaatcgaagggatttttgtttttatccctgttcttttgttggttctatctgttctgttttgggtattttgtttgtttttatttgtgtactttttttttttttaaatggagcttccatcatgtaggagtagggtgtagaaatctgagttggtggctccctggtataagaccatagccttcattttggtgagtaacaacataatttctgctttgagtcccattttcttgcagtggaagcttaatctcagagtatcaaaatcactgcatctgagcgtgggcctccccacatcatgggaggagaaggatgagtagatgatgtctcatggagaggacctgccaggatccctcatcgctggccttcagctttctcatctgccctcaaccacagaaccctgggaggaggctccctcagtggctcgtgcactcttgcaggccctgtgaacatatatacttcctggtgggaagagcaagggagcctctggtggaaagcagccccagggtccaagaaccacacagccctgcattagggcccccagggagggagaagaccaaggtcatgcttttgaacctggatgccagaagagaacagctgtggggaaaagcatgcctggaaccaagaaaaacatgtttaccaggggccattcctcacaccagctgcaggcagggtcaggaaagccacaggctgcactgtagttgcaaccttgcatgcggacgcaaggctcagaatgttcctcaaagatcctaaaatgttcccagagtcaggctgagtccattcaaatgttcactcaccctggccacactcactacacctgacttccctgtatcatgagttagagaaatagtatagagtctggttgatgctggcaggtgggagggaatgggataggaaggagagagagagagagcaagaaagaaggctgtttgggtttttgtctataacatatgtatatacactcatcaagtccattatttaaaacctctttcatggtttcaatttcctgtggaccacttttcatgcccattttaagttccttgaaggcgaggagatacatgtgtatctgccagcttcactgtgccttatatcttaggcaatcaataaatattagtaaatcaaaggatgcctgatactctaaaaatgtcttattatttttaggtgatttgggcaaagcacacgcattgtatttgcatctgggaaccacatttttaatttaaaaaagttatttgtaggccggacacggtggctcacgcctgtgattccagcactttgggaagccgaggtgggcggaccacttcaggccaggagtttgagaccagcctggccaacatggcaaaaccctgtctctactaaaaatacaaaaattagccaggcgtggtgatgcatccctgtactcccagctactcgggaggctgaggcatgagaatatcttgaactgctcctttttattgctgagtgatattccattctatgaagctcagtttgcttatccgttctcctgttgatgaacatctgatgtttgcagttctcctctccgtgagtcttcttgtaaacataattttcatttctcttgggaaaaaccctaggagtggtactgctgggtcaagggggtaggtgtttgtatagctttataagaagttaccacatccttactaatatttggtgatagctattctttaagttaaaagtgtagaggcatctcgttgtggttttaatttttatctcccaaatgagtaatgataagtgtctcttcatataccgaatggctatttgtgtatcttttttgtgaactgtctcttcaactgtttcatccatttctgattgattatctttttattattgagttgaaagagttcttcataaacccaggatttcaatcttttttcagatgttttgcaaatattttctcctaatctatggcttgcctattttcttaatggtatcacttatcagcagaagcttttaattttgacagggacacatttattcattttctgttacgtttattgctttctgtggcctgtttgtctataaacatttgcctgtctccaggttatgaagatgctctcctatattttctctaaaagttttatgattttatatttagccctacaataatttagaattaatttttgtttgtgacgtgagaaataagttaaagttttctttgtgtgtttacttctgaacatctagttaatacagcaccatttttgaaaagacttttctttccccatggattgattgctttggtacctttggcaaacaaatgaccatgtaatcatgggcctgtttccagctctcttctcagatccactgatctatttgtcagtccctatgccagtaacatactgtcttaattataaaaccaacaatgtcggtattataatgttttaaagtcatgtagtttgagcactccagatttattttcctaattcaagattgttatagatacgctagattctttgcatgtctatataaattttagaatcaatttgtaaatttctacaacagattcctgctagcattattactgggattgcaataactctacagatcaatttgtggagaactgacatctcaacaacattgagtcttccaatctgcaaacatgatactgtgtgtgtgtgtgtgtgtgtgtgtgtgtgtgtgtgtgtgtgtcttctttaatttctttcaataattgtttagttttcaacatagagatcttgtccatcttttgttgtttattcatgagtattttatgctttttgaagatactgtaaataaaattgtttttctaatttcatttcccaaattcttgctgctgatatataaaagtataattgatattttaatattaaccttgtatcctgtgaccttgttcaattgatgtattagttgtaatagttgtttcttgcatttcttaagattttccacataaacaatcacatcgtgtgtggagtgagttgcaattcttctttttaaaatctttatgccttttttttttacttacattattgcaatagttaagactacctaaaataaattggtaagtgttcttgcctcctctgtttttgaaagagtttgtgaaataatgatactattatatttcttccttaaatgttttacaggattaatgagacaatcttgaccaaacttttctttgtggaagatttttaaaaataatacattttggctggacacagtggctcatgcctgtattcccagcactttgggaggctgaggtgggcagatctcttgagctcaggagttcgagatcagcctggcgcaacataataaaaaccccgtctctacaaaaaatgcagaaattagccgggcatggtggcatgcacctcccagctacttgggaggctgaggtgggagaatcacttgagcccaggaggttgaggctgcagtgactggaataacaccttagcacttacacttggacaacagagcaagatcctgtctcaaaaactaaataaataaattcaattcaattcaatttcctctcctacatgagttatggtacattgtgtttttcaaggaatttgtctatttcatctaagttgtctattttgttagcataatgcttttatactttttttaaatgcttgtagcattttcagtgataacccctctttcattctgatattgaccattcgtattctctctccttttcttgattagtatagctagagttgatcttttcagagaacagacttttggctttgttaattttctctattctttgttgttatctcatttatttctgttattatatatagaatttctttcctttctacttactttgggttttctttttttttctttccttttcttgtatttttcccctcccttccattctccctcctttcctcctttctcctttccttcctttcttactttttttcttctttctttcttctctcattttagactcttaaggtgcaaacttaggttatggattttagacctttgctctttccaatgtaagtatgtaaaactctagatttccttctaaacattgctttaattagagctcataaattttcatatgtaacattttcattttcatctgttcaaaagcttttctaattgtctttgtgatttcttctttaattcatgggtttttttaaaataagtgagttgtttgactctaaacacgtggagtcttcctagatatcttattgttaccgatttctaacttaactccattgtggtcagagaaaatgctctgtagatttcaattatttccaactcatcaagacttattttatggattaacgtatgctttaccttgacaaaagctccatgtgcacctgaaaagaagatatattttgcaatggttgggtgtagtgttctataaatatcaatcaagtcaaggtgatggtggtattacatagatcatctatatctgaactgattttgggcctagtttttctatcaacagtcattgagagatgttaaaatttccaactatgattgtgggattgtctacttcttttaattctgtcatttttgcttcatttattttgaagctctgttactaggcctatatacgtttatgattataatgtcttctgatgaattaattcttaattcttatcattataacatatcccactctatgtctggcagtagtcttattttgaatttaatgtcatctgataataatatagccacttcaacagtcctatattcttcttatactcttttcatggtatttctttttctatttatttcttcttaatatatctgtttctttctgtttaaaatgcatctcttatagaaagcttttttatccattttgacaatctttgtttttaattggagtttttagtccatgagcatttaaagtaattattgacacatttggatatgtatctttcattttaccatttgttttctgactacatcccctctgatttctgttcctttattctttttctgctttcttttaaacttattgtaacatattttagaattctttcttgatttacctattggctttctagctatacttatttaacttttttttttttgagacagagtctccctctgtcacccaggctggaatgcaatggcatgatctcagctcactgcaacctccacctcctgggttcaagcaattctcctgtctcagcctcccaagtagctgggattacaggtgcccaccaccatgcccggctaattttttgtactttagtagaggcagagtttcaccgtgttgcccaggctggtctcaaactcctgagctcaggcagtctacctgcctcggcctcccaaagtgctaggattacaggcgtgggccaccatgcccagccacttctttgctttttttattgattgtgtagagattacaatgcatttcccttacttttcacaatctattaaagattgtgccacttggctgggggcggtggctcacgcctgtaatcccagtactttgggaggctgaggtgggcagatcgcaaggtcaggagataaagaccagcctaaacacagggaaaccctgtttctactaaaaaaaaatacaaaaaattagccgggcatggtggtgggcgcctgtagtcccagctactggggaggctgaggcaggagaatggcgtgaacccggaaggcagagcttgcagtgagctgagattgcgccactgcaccccagcctgggcgacaaagcgagaccccgtctcaggaaaaaaaaaaaaaaaaaaaagaaaaaagattgtgccacttatgtaagtagaaaccttgcagttatataaaactacccatccctaatcactctttatactgcaattttcatatgcatcacatctaagtgacaaaccccataagacataaattttgctttaaagaatcatatgtattttaaataaataaagagaaaaagcaccagtcttttctatttatctagaaattcactatttccaacaggatcgtttcccttcaggaaatactaaaggaatttcctttagtatttcttataatacagatctactggcgatgaattctcttagccttctgaaatgtctttattttgccttcattcttgaaggataattttgctacatatggaattctgggttgacaattttttgtggcacattaaagatgttgtttcactctcttttggcctccattgtttatcagaaatcagcaaatattgcttttttgtttcgtgtgatgtgccatttttatttagctgatttcaatcgtttttcccttatttatgaattcagcgtataactatgatatctctaggtattactctgcttggagtatcatgagcttcttgaatcaaaagttttatacctttcatcatatttgggaatttatttctgctccatttactctcttccctcctagaagtaagagtaccaattactagagtaactagaactccaattactcctatgttagacattttaatatttttgaaccagtccttgagactgttcaattttttctctgccatttttctctcttttctttagattggatcattttcatctgatcccttttcaagttcatggactcttccctatgttgtctctattctgctagaggatgaatttttatttcagatatgttatgttttagtctagaatttttatttggttgctttttatagtttgtatttttctgatgaaattttacaactttttattcattaggagcatcttttcctttacatgactgaacatagttaaaatccttacctgctaattccaacatttgggtcatctgccattctctttttgtaagtgttgactcttctccagaatctgcctgctttatttgcctccaaatagttgtcctgtgtgcaagtgtgtgtgtgtgtgtgtgtgtgtgtgtgtgtgtgtgtgtgttttcaaactcttaaatgtctcagtagtcaaagggtggctaatctgatggtgagatcctgaaaaaagagaataaatgttttcatcctgctttctttaacccatgaaggtgcaggaagagattgacttcattctccatagaaggcctagctggctctgtggcacaatggaaagtgcattgtctataggaggccttgtgtacatacacatgtgcactcacacatgggggagagcctataatctttgctgacaacagcatgcagtgtataaatctctgtagctcagacccagaacctgaaaaatttagacctaacattactttggcccagtaagaatgttagctggaaattagtttatagcccaggagctattttttaaagatctgtaggcttactagccatgacaatgatgacaataatgatgatgaaaatgacatcatcattaccaatagctactgccatctattgatcccataacatgtgatcatatctctgtcctcagaacaatccatttcacagatgaagaaacagactcagtgagcacgtgatcacttctcacaactaatggagccaagattctgtccttatggctccagagacctcttttttttcccactgtaccacaacactcaccaggactggagtgccacctatgacctcattgcataatggatggcttgtcctcaaatgggcccgggtatgtgtacatgtatacttatgtctataggggagaggggaaattgacccactttcctccactctaactccagatctcagctgccgagtggaaaccccattctcacaccatagctatgggactgggggaaaggggaggaaataactaaagagtaaggaattgggggaggctttgaggtttggatgtgacaggtagtttgcatgtagttggaatgcagtaacattggtccacaaggtttgtcagaaaccctggttattttggaaggttccaaagttttgtcctcttcagatatcatgaaaacaggaaattctgtaaacatggccactgaagggctagctcatttcttggaaaaggagtttctggagagttctcagagcatataaatagcagggccataaagacaaaggtaaccattcaaggaatagagaagtatattctcaaaaattacacgccaagccagagctgtggttcagaaagggggttttatgttgtttctgttgttgtttcagttttggcctcagaaaggatgcgcggccctgctgtaaacagcctctcagcactgggaaggggtgtgcttacgaggctggtgtagacatccagagcctagcctagataggaaggcccaggcacccacagggaggcctgctttgacagagaagcatttctgtttagaagagggcacctgggagatatttccagagagcttcttatgacttgtcatgtagctcttcccccatgttttctgcagctggaggtaccatgcacctttgagggaccaaggacccaagacttgaggtagacactattcccagctggatactctcaatgttgaggatatagatgcacaaaccaatgcagggaggcctccaggagccactggagaagaaatcttcagatcctaccaggcccatagctgttgcctttgtgggctcctgggttaatttccacacatcagtggcccaccttatgatatcctccctgcatgccacactcccggccatgctctgtggacagccattatttccagtaattgctaatgggagccagtctccaaagagtaatgaatcagaggtgttccttggaatgtgttacactaggacttcgccgatctcacaggctcctttccagatgagctgactgtaatctctgggaagctggatctggaggaacaatgggatgggatttgcggtgacccttcctgcccttcttgagcagcttgtgaaccagaagatgtgcctggagagaaagcctcatttggggaagtgcagtagtcgaagttctttattttgaaaatggagaacaacccttctcacaatcctgtctccccttccccctttccaactagaatatcagctcccctgaacatgagtcagtcacatttcagggaaaactggctgatgttgaagaaatcacttgagggcaaactttgtccttcaagctgtgggtctctgaagtgtagagccagcagatcccccagtgtagggactgggccttccttgcccattgaatgctttctatacatgaagacttggagctctttacagatgacagtagccagtgaggaagataaaagaagagaaaagacccaaaatgcgggtttgccactcttttttgccagcaccgtggggacagtcactctgccttctttccaccacctccaacttcacactcacacgcacactctggtcccacagagcctgtttggtacttgcctgacagcccaccttgaaaccagatggtcatgaacctgtcaccaagtcatctgaagatcttccactgcaacctgtatggcatctgccacagggaccatgggacatgattgaagaaccactccagtgcagttgatgaaggggtgggtctgcactggagttaggtgcaccagggcctgggccaagggtgggctgggtccatcttgtgtgtggtggtcttcttcagagtagcagctgattcagagggattccatagaactgcacaggctaggtctagtcagatatcttggacattttctatttctagattagagaatatagcatacgctgattttaatataactgtgtatgtgactttttcagtgagaaaaattttaagtgatgttctaaacaatttttggcatgtagacagaatagtcaaatatctgtttaactagcaacatagttactcgtgcatatttaaaatactacatgagtatggcctggcacagtggctcatgcctgtaatcctagcactctgggaggccgaggtgagcatattgcctgagttcagtttgagaccactttggacaacatggtgaaaccctgactctataaaaatacaaaaatgtagccaggtgtggtggtgcgtgcctgtagtcccggctacttgggaagctgaggtgcaagaattgcctgaacctgagaggcagaggttgcagtgacctgagattgtgtcactgcactccagcctaggtgacagagcaagactacatctcaaaaaataaaacaaaataaaataggccctgtgccgtggctcacgcctgtaattccagcattttgggcagctgaggcgggcagaccacctgaggtcaggagttcaagaccagcctgaccgacatggtgaaaccccatctatactaaatacaaaaaattagccaggtatggtgatgcatgcctgtagtccaagctacttgggaggctgaggcaggagagaatggcttcaacctgggaggcagaggttgcagtgagccgagattgcgccactgcactccagcctgggtgatagagcaagacttcgtctcaaacaataaaataataaaataaaataaaataaaataaaataaaataaagtaaaatgctacatgagtttggaaacattgctttttcccacattactcacctcctttacagcaccagcatcttggtcgacacaagatctctctttaattatgtcacagtttgttgatgaatacattgcctttgcttcagttaaatcaagtaggatgcagtgactccaagtctgaggggtgcttcccaggaagagccaccccccacagccatttgcagagcattggagtaagttttaccttcatcccttagatgtgaatttgttatcctcactgtgacaatcccttatcacatggcttttagaaggattctcaaaaagctagactctcacattcaactttgcaattgcctggctgggtgttacgtttctttgcctcctattagagaccctatcagcatctaaaactagcgttgtttgaggatgttggagccaacggttctttgccagatagaactttgtgtgtccaaataaatggttcaaaatcatcaagcaaataaataccctggaataagagaagcctcatgaggatttgactccaaattgacttcctctgttctgcagtaagaagttaggaattaaaccaaaccttgcctgaggttcaggtatactcaaaagcaatgaggtgtggctcaggtgtgcgctggcaaggtcactgtgaagttcagccagaggctttgcaagcctgggcctgagaagccagacctcttagatccagaagggccaatggagctgggctggcctgctgccactcacaggcagagactctgccagcagaagggactctgctgtcagagctggagggcagcggaccacatggctgaggcccaaccacaggtctcctgactcaaaacctcttcccagggcttgtcctcctccctaaatatatgtgccccaaattgtcaccagatctcgggaaagcactggctttgtctgggataaacaccaactccacagcacacccagtcattaccagattggcagttgttgtctaggtcttgtggcttcttggggttttctcgggtgtctctctcccaaatctttcccctttcctttgattatattcacataaacattgagctttgtagccctcaagctctctcaagcataactcactttgtccctctctgtttccctatgcagtcgcctctccctctgctgtcagaggcccatccaactgctccagccctgtggctccagcgtctcctcctctctctttcccctgctctgtttctgggaagatctatctgagggtcctgaaggaggagactcgaggttgttctcttggacaaagaggtctgggtggatgacataattcactttacgtcttagaaaaataaccttgtggctcttggctctcctgggctgtcattttggttgcctaagggctctaggcagaaggccagggagcccagccccagcctagaacttgcagggctcagagagctgcagtgacggggtgtccgctgtgcctgccgccccccttgccatggactctacttgcagaacttcacagctgagaggctggccctgagattcccctttatgcctcccaaagcttgcgattgcttaattatacgctgctgtgtaccaatttccactttctctcccggtgtgttttgactgataactttgacttaacctcctgatgccagaaactatgttggctactgctctggcggcaggaaaaggccggttccagggaaggctgaatgcctattgttctggatcattttgagaaaaaaaaagagataccttgaagaaagatgaagacaaaatatggaagggtgctgaatttacaaaaagcctaaggggaaaaaactcaaatgtccctcaggagtggaatgagtaaacaaatcatggcgtgttcacacaatggaatgctacctaccaataaaaaggaatgaactgcggatgcacacagaaacatgggtgaatccactaggcatcatgttgtgtaaaagaaagccaacttggccaggcgtggtggctcacgcctgtaatctcagcacgctggggaggctgaggcaggtggatcacttgaggtcaggagttcaagactagcctggccaagatgatgaaaccccatctctactaaaaatacacaaattagctgggcgtggtggcgcgtgcctgtaatcccagctgcttgggaggctgaggaagagaattgcttgaacccaggaggtggaggttgcagtgagccaagattgcaccactgcactccagcctgggtgacagagtgagactctgtctcaaaaaaaaaaaaaaaaaaaaaaaaaaaaagcagacgcaaaagacatactacatggttccatttatatgaagttttagaacaggcagaaataatccatgtggataggatagtggttattgaagagcaagagcaagggagaatgtggattgcctgggagggaaagagaggcacttctgggagtggcctgtatctcattcacagtggtagtcacacctatgtatgtgtgcaaaaattcacccagctcttaatatttatgcactttactgtatgcatgtgatgtagtttggatgttgccccctccaaatctcattctgaaatgtgacccccagtgttggaggtggggcctagtgggaggtgtttgggtcatggaggcggacccctcaggaatggcttggtgccctctcctcagtaatgagtgagtcctcactctattagttcatgctagagctggttgtttaagagagtggcactcctcccaccgctcttcttcctcctcctcctctctcacctcgtgacatgcctgctctccctttaccttctgccataagtggaagcttcctgaggctttaccagatgcagatgctggtgccatgctttttgtacagcctgcagaaccatgagccaaatatacatatttcctttataaattgcccactctcaggtattcctgtgtagaaaacaaaacagactaatatggcatgttacacctcaataaaaaccttataaaaatagataaaggcaatgaggagtcagtggaggaggatccaaggctcagaaagagaaggaggtatatgagaagctgagggaagcaggggagagcatttcagtaacagagagacacggtggaccaatgtggagagactcttggattgggtgactgagaaattctgtcctgacagaaaaatttcaacaagatagctccaacttgaagaaagagcaaggttaaggaagattctggaggctgatgttcttgttcttgttgtttaagtcttggacgagcctgaggatgtctacaagtggaagaaaagaagccactggagcagaaggtggggaggataaaatttggagcaagattctcaaggaagcaacaagatcctaaggcgagtaaccctgagtttagttgggaaaaggaggatcattaggagaccaggagggaaagaaaaggtggcaaggtgtctagccactccgtgtggagcgtttctgagggtgctaccagcacagggtgagcacattgctccatgagagggatgtgagaccttgaatagaggagtcactgttgggaatgtgaaattttttcaacaagagatcaatactggaagtgatagaggcccagaactataactggctacacacccaggaaatcccattttgaccagttactagccatgtttgggaacccaacaattaatgcagagaaggtgagtgtgtacaggtgttcctccgggttggggattaacaatgcagatttgacaaaaagttgacaattcttggaaagtaaacatgtcgctcagaaggacccataatgacagaaaatgatggcttaatatttgtaacattaaagtcccaagaggagagtataatgagtgaggagctgaaaaatatttgaaaaaattatggctaaaaatatttctgaatttggcaaaacacataaacttgtagatttgagaagctcagagaatcccaaacagaataagctcaaagagattctcacttagagacatcataaggaaactactgaaaactaggaacaaaggaattatcttcaaagcagcaatgaaaaatgacattatttataaaattacaattatttaaagggttgtagatttctcatcagaaaccatagaggccaggccgggcgctgtggctcacgctgtaatcccagcactttgggaggccgaggtgggcagatcacttgaggtcaggagttcaggaccagcctgggcgaaacctgggcaaaaccctgtctcaactaaaaaataagaaacttagccagacgcagtggtgtgtgtctgtagtccccgctactcaggaggctgaggcaggagaatcgcttgaacctgggaggcagaggttgcagtgagccgagatcacaccactgcactccagcccgggcgacagagcatagaagccagaatgcaattgaacaacatttcaaaaaaccttgttttgaaaaaattaaagattcatgtctcgtgttcactttctctgattttccctggtgattagcatcttacctaactatagtataatgtcaaaaccaggaaatccatatcggtacaatgtgtgtgtgtgtgtatgtgtatgacattctgtgccatttttatcacagatgtagactgatgcacgttcagccacaatcaagatgcagaactgtgccatcacaacaaagttctccctcatgctgtccctttaaagtcacatccactgctcccccatgaccccacccataactaacccctggcaaccattactctggtctccagttctacaattttgtaatagtgagcattttacataaatggaattatacaatatgtgacctattgagaatggctttttttccccttcagtgtagtgcccttgagatccatccaagttgtatgtatcaataatttgtttctctttattattgagtagtattccatggtatggatataccacagtttgtttcaccattcttctattgtaggacattttggttgtttctaggtttgagttattacatataaagctgccgtgaagaatcatatacaagtttttatgtgcacatatttccatttctctgaaataaatgtccaagaatatcattgctagatcgtatgaaaagcgtatcctagtgctagagtgtggattttgtgtcgcccccaaaaatttatatgttgaaacgtaatcgccaatgtgatggtgttaggagattgggcccttgagagttaattaggtcttaggggcagggcctttacaaatgggattagtgccctgaagaaagaggcgctagagagctgcctttcttctttcaccatgtgaggatacagtgagaaggtgccatctgtgaaccaggaagccagccctcatcagatactaaccctgccagtgccctaatcttagactccctatcccccagaactgtgagaaataattgtttctggtttaagccacccagtttatggtattttgtcatagcagctcaaatggagtaagatactcttaagaaactgcccaactacttcccaaagtggttgtgccattttacattctcaccagtaatgtagacctaatttcttagcatctgggtcaacatttgacatagattctattttaaattttatttttgctgctctgataggtgtgtggtgatataaaatgagagtcttaatttacattttgttagtgggcagtggtgttgagcatcttttcatatgcttattttccatctttggtaaaatggctcttcatgccttttgcccaatatctaattagactgtttatttgttattgataagatttaacagttctttaaataaattctagatatgagtcctttattgacgatcagatatcagaattatttagaaatactttctcctaatctgcaccttgtctttgcattctcttatgatattttactggcaaatgtctttaatttttatgaagtccaatttatcaattttcagtttatacaacatgttttggtgccaagtctagccaactaggagctcctggaaattttgtcctgttttttcctgaaagctttatagttttacattttacatttaaggctgtgatctattttgagttttgttttgctcttttttttttttataatgtgttaggtacaaagtacctttttctgtaagcccacacttccctagttactcaagcactatttgttgaaaagcccattctttatccattttggatcttcatcaaaaatcatttggccatatttttctgggtctctttttggattctttgtctgttccactgatctgtgtgtctaatcctctgccaatatcacactgtcttgatcactgttgctaagtagaaagccttagccttgagtagactggttcttgtccatttattcttcttttttagaattgcttaggctagtttagtttttgtgacctttcttataaattttcgaataatcttatctacagaaaacattgctggtattttaatgcaaattttgttaaaactgtatatgaatataggagaattgttgtctttcaatccatgaatgtgatgggtgtctctatttatttcaattgcctttgatttctttcatcgacattgcatagtttaggcatataaacccttcaagtacatgttttgctagatttgcacctaagtatttgttttctttttttctgtgtgattgcaaatggtattgcatttttaatttgggtttccacatgtttatcgctagcatatagaaatacaactaattttatgttgatcttatgactttgctgagcttattaattctaggagatttttgatagattccttgggattttccacacacctttatgtaatctgcagatagcaatagttttatttcttttctgtcctgtgggtcttttatttccctttcttgtcttattgcactggttagaacttacagtattatgttaaacagccttgccttatgatcttagggagaaagcattacatttttcatcactaagtatgatgttgtagatgtttttatcaagttgaggaagtttccttcagctccagattttttagagttttcatcatgaatgagtattgaattttgtatttgtcctttttgcagcaattgaaataatcatgtgatttttcttctttaggcctgttaatatggtggattattacactgattgattttagaatattaaaccagccttgtattcctgggataaaccccacttggtcatgttatataatgatcttttatattaaagaattctatttgttagtatttttcttatagatttttatgtctatattcatgagggacactggactataattttcattttttatactgtcctttcctagttttagcatcagggtaatactgacctcataaaatgaattaggaaatgacctttccttcctctactattttctggatgacactgtataaaattggtgttaattgttctataaacttttggtataattctccagcaaaacccccaagcctataaatttcttcctatggcttttaaaaattataaattaattttccttaatagttataaggctattcaaatgatctatttcattttagataaattgtggaagtttgtgcttttcaagcaattggtccatttcatctaagttgtcaaatttatgtatctggaattattcatagtattttcttattaaccttttgatgcctgcagggtctttagtgatatcccctgattcctgatgttggcaatttatgtgttcttttcttctttgtcagtcttgctacaggttagtcaacttcattgaccttttcaaggactagcttttgtttcatggattttctctattgtttctttgttttcatttttactgttttctgggcaatctttttttttccttctgcttgcattgggtttattttgctcttctttttctagtatcttgaggcgagagcttagcttattgatttgaagaatttcctctttaaaccatgggttacttagaaatgtgttgtttaatttgtaagttatttgagattctcctgctatatttctgttactgatttcttgtttgattcgattgtggtccaagaacacactctgtataatttcgattattttacatttgccaaggcttgttttacagcccaagatgtcatgtatcctggtatatggtctttgggcacatgaaaagaatgtgtattctgcaggttttgggtacagcgttctagaaatgtcaattagaccctgttaattgaagatgttgttgaggtcttctgcatccttgctgattttctgcttggttttatatcagttggagagaaaggcagagaaacagtagcaaaatgcccaatgataattatgaatttgtctatttttcctctcagttctgttggcttttactgcacaccttttgggtgccttcttcttggcggggggcagcccaagcttcctgcgtgttctccattcacactgcatggaggagggtcagcagctcgttatctccaggcaggaagtcctgtccagactctgcacctggccttcctgacactacctggggagctggggttgggaggctgaggtccctagtcgggctgccttcttctctgtatctttcagtcttcttatgtttgttttatacaatgccttagttgtacttagtgagaagaataaggaaaaatatatctactccatctttccagaagcagaagtctcaaagcactgaactttaaaaatcactaattgatcccgtttagctgtgctactgtgaatggtgaccagggttggctggtgcccacctttcagaggtggcacactagagaggagtgcacaagacaccgactgcagtgtggcggggtgcatctcaagggcaggtcggacgccaggccctgcacacgagaggtgttcactgggctcatggggtagaggagccagatccgtgaggcctggaaggtcccacgaggtgcctggacttcagcctgagagcagaggaggccacatatgggtcacagcagaagtacgggtcagaaacagatgttagtaatgtcactgcattcaatgcactgcccactgggttggccccagttgcatccccagactgctcaaggcaggaggaagccacaggaattaaatgtgtggaatgtgtggaatgtgtggtgctggcttaatgcttctgtgttagcaatttttttttttttttttttttgagaaagggtctcactctgttgcccagactggagtacagtggcacgatcttggctcactgcaacctccgcctcctgggttcaagcgattcttatgcctcagcctccccagtaactgggactacaagcaagcaccatcacgctcagctactttttgtattttttggtagagacggggtttcatcatgttggccaggctggtctcaaactcctgacctcaagaacatttgccaaaagtcacaccaattgcctaaaagccactatgttaaaaatcaatttgcaaaacgaccagtttcacagattcccaaatcactaaaaacttctttgtagtaattatttacaaaatgtgtaatcatatgtgtttcacagaaagtttcgaaatctggtaatgattttttcccaacattttggcctttggttgtatttagttgagatgttgcatttttagtttctctaccactgttttctatcagatttataggcatgtggttcatatttcagaagctgactactcctcagtagttactataaaggttttggcaattcatgaggctttttatattctaacctttggttttcagaaaagatgatcttgcccttcaagtgcaattttacaccaattttcgtcatcttctttttttcaaagtggtttggcagtcagccaaataaaagttttttctgcatgttaattttcacatatccatgacaacttccccaatgacaaaatccaaaagtgggaactgtagtccaatttagacacaagtctaaaattggaattgacaataaatgtggttgagggaaaacccgtctattgacaccaaaaaaatattgtgtgtttgagaagtgtcccactcctgaaatatggaaacccacatgaaattgacatttaccagggagggactgagaaatccacagcaaaacggctgataaaaacatacctgacacttgcaaactaaactgctaaatataagtgaaatagaaaaccaaagctggggggaaatcctcagtgttttagaaaccagagcacacaaattgttataattttaaaagtaattaaccaaagcaacttttgggtgaattccagagatcacttctcatggaaattgatcgtttggaaaattaattttcagcaaattgtttttcaattaattgacttttgggaaatagtgattggtaatttggcaaaattaccaaatcacctgcacccagtcacctgcagggtttgatgctgcctccagggcagacggggagcatctgaaagctggaaaggaacttgagttgtggggtggaggatgctgtcctccatgtgtgggaggaaagatggaaggagcagcacaaagacagaagaaactgacccatttcttcaacctttccatttttcctgggtttttaacctctgtaaaccaacaatcaggaacctgcagccccaaacctgccagcctccctcctgatataaccaatgaaatggacagaccctcctcacagtcagggggaaatagacacttgtctacccctgcactgactcaagcagaattatgtttctcattcatattctaattcttatggctattttcttcttttttccacatattgatctaaacctttgtccctaataaagacctccaaactctactgacacaaaagtgattgggcatgagtgacgtttactgggctttgaggttacctggttaagcaggtaactgcaagtggaatcttagtcatccccagtctgccaagccatgcctggctgccctgagaagttcttcgcatgacctctcttcttccacacatactcagctcctctcctctctcttttgagctccacctcctttctgctcactcctcctccctcccactggttccccttcaatcctcctgttgttttcttgtacaacgcctcttactctgtcctaccctctatttccacatgttgatagagaaagctcactttccagagccatgcaagcttaagaaggtgcaaaagaaactgtgccactcccctgagacagaaaagtctgctgcatttctgtaaactgcaatttaaagcaatcctccatgctttacatgcgctaaagtcccccatcctgacaaaaacctctctcttgaccacattttcccctctcatcccaccttcctttcacaaccaatcttcctgaaccagctactgatactcgctgcctcttctttgtcccaaccagtggacacttccgacctttttcttacttaaccttcttttaatgtttgacacagtagacacttcttccagaaacccttttgttgtccacctgctctggccaggatttctcaatcttctttgtaccgtccttctctgctgttaccatcttagaggtcagggaacccagctttggccttgggactcacctcttctatagcaggacctacgtggtcccactcagcgatagactcagccgtggatttcaccacatgttgccttggagtcttgggtccttgtcctgggcttgagccactgaggacacacccgaatatctcccggatgtccagaatacgccatctgcaaaactgaactcgtcctctttcccccgaatgtatctcccagatgtccagaatacgccatctgcaaaactgaactcgtcctctttccccagaatgtatctcccggatgtccagaatacgccatctgcaaaactgaactcgtcctctttccccagaatgtatctcccggatgtccagaatacgccatctgcaaaactgaactcgtcctctttcccccgaatgtatcatctcccagatgtccagaatacgccatctgcaaaactgaactcgtcctctttcccccgaatgtatctcccagatgtccagaatacgccatctgcaaaactgaactcatcctctttccccagaatgtatctcccggatgtcgagaatacgccatctgcaaaactgaactcgtcctctttcccccgaatgtatctcccagatgtccagaatacgccatctgcaaaactgaactcgtcctctttcccccgaatgtatcatctcccagatgtccagaatacgccatctgcaaaactgaactcatcctctttccccagaatgtatctcgcggatgtccagaatacgccatctgcaaaactgaactcgtcctctttcccccgaatgtatctcccggatgtccagaatacgccatctgcaaaactgaactcgtcctctttccccagaatgtatctcccggatgtccagaatacgccatctgcaaaactgaactcgtcctctttcccccgaatgtatctcccggatgtccagaatacaccatctgcaaaactgaactcgtcctctttcccccgaatgtatctcccggatgtccagaatacgccatctgcaaaactgaactcgtcctctttcccccgaatgtatctcccggatgtccagaatacgccatctgcaaaactgaactcgtcctctttcccccgaatgtatctcccggatgtccagaatacgccatctgcaaaactgaactcgtcctgtttcccccgaatgtatctcccggatgtccagaatacgccatctgcaaaactgaactcgtcctctttccccagaatgtatctcccggatgtccagaatactccatctgcaaaactgaactcatcctctttcccccgaatgtatctcccggatgtccagaatacgccatctgcaaaactgaactcgtcctctttcccccgaatgtatctcccggatgtacagaatacgccatctgcaaaactgaactcgtcctctttcccccgaatgtatctcccggatgtccagaatacgccatctgcaaaactgaactcgtcctctttccccagaatgtatctcccggatgtccagaatacgccatctgcaaaactgaactcgtcctctttcccccgaatgtatctcccggatgtccagaatacgccatctgcaaaactgaactcgtcctctttcccccgaatgtatctcccggatgtccagaatacgccatctgcaaaactgaactcgtcctgtttcccccgaatgtatctcccggatgtccagaatacgccatctgcaaaactgaactcgtcctctttccccagaatgtatctcccggatgtccagaatactccatctgcaaaactgaactcgtcctctttcccccgaatgtatctcccggatgtccagaatactccatctgcaaaactgaactcgtcctctttccccagaatgtatctcccggatgtccagaatacgccatctgcaaaactgaactcgtcctctttctcccgaatgtatctcccggatgtccagaatacgccatctgcaaaactgaactcgtcctctttcccccgaatgtatctcccggatgtccagaatacgccatctgcaaaactgaactcgtcctctttcccccgaatgtatctcccggatgtccagaatacgccatcggcaaaactgaactcgtcctctttccccagaatgtatctcccggatgtccagaatatgccatctgcaaaactgaactcgtcctctttcccccgaatgtatctcccggatgtccagaatacgccatcggcaaaactgaactcgtcctgtttcccccgaatgtatctcccggatgtccagaatacgccatctgcaaaacagaacttgtcctctttcccccaaatgtgtgtccactgcttgaaccaggaaactggatatcatcttaaatcctccctttcccaccaccaccaaatccaagctggggagcccctcttctttactgcctctgaaaaccgcactgtccccccacaccccatggatcctgcttgaacccaggcactcatcacttcttcgctggggtatgaccattcccctggccttcctatcttcccatctatgcccaacatggctgccaaggggatctgtcctaaatgcaaagttagccatgcctgccctccctcccctggcttgcctgaaatctttcaggaagctcagagcttttaagacaacattttgagaacaaggaccttttgcaattttacgtcttctgttttctggagtccccaaattcagctcagccttcatggcttctaagaaacttgccttgacctcatctttcctatgcgttctgtgcctagctagcaaaattcttagctgacattactttgatcatgaactttgttgcctgtgagttcccagagggcaggccaagtctgacttggctttgttgcaaagtctagcacatgatggacattcaataaagttttgatagagagaaaagcaaaatctcagacttcttagctcatgatgtcccagtgaagagcttaaatgtgtgtgtggtgtggagagagataggcagccccacagtgagccccaaaagcccaaggaagccacggtgtggccaagaaacttttcaggcaaaggcaatcagtgtgagggtgcagccttcctcctgatagaggaagttgtaatttttattattctgtctccctgggactctgttcaaggaggctgctgccagggcaagggaaggtaggcctgtggggagggtctgttttgtcatgaacattttcaggagggtgattgaacagcataaaaatgctacatatatgttgattgagcatataaaatggatgtctctgcctcaagacagagggcacattttctatgccgagacctttccttctgcctcatcatgtttgacttagtgacactgtggtccccacctggctcaccttctcagcactgatgggccagatatggtggtgtggcagttgaaggggatgaatggtttagagccttcttgagtcaggctgccagtccttgtggggctttgccactgtgttgctcctcaaattccactgacctgtgaccagacacagtccaagcaggccagattctttcctagtgcaatacccactgggcattccaggtatagatgatgtcactgagagggcagccaagcaggaggtggcacctggtgcccaagtctagcccaacaggccaacttctgttgacaagggaagttggtgtctaattcactgtgacagaacggaactcttgccaagtcccttttcagaaagggggaagccacttcaaaataaaaataaagctggctctacaaaatatggcgtgcctggtatcaatggcagaggtggcaagctcgcaaaagctctatgaacaataactttccacagtatagacaccaaagggaaagacagcagagcacttagctggcttagacccgttctggtataactggcccatgaaaaactattcaacaaccatattagtaatcaaattgaaataaatatcaatgaagagctaccttttgccctgatacattaacgaaaattaacatttccattgcaatttccagtgctgacagggatatggtaaaactgctatcttctcagattgctcttgacagtatgcatttgtacagtctcccatggagatcaatttatcatgatgtgttaagaattgcaagagtgttcttaaccctctctacaaaaaaaaaaaaaaaaatccaaaatatggagcaaagtatcacttgagtgttaattgtcattttgataggtgtatgcagtgctaaaattacagttcattataaatgttttaatgttgttatgcatgtacatggtgactattgttcatgtagcaacatggaggcatgcttttgacaggagcagggcacaacattgtgtgcatataaccatgacaacattcacaagaaagaggagcccagtcaaacccaccaaaatgataactgtggctgtatttgggtgtgggggtgagagggtgttactttttctttttcaaatttagtgtaatatgatattacaataaaaacctctttttgaggcttgagggtgccaagcagagatgtaaagcgcaagtgagaatactccccaggtagcagggaggagccagctgggattggactttgctttattttggacagggcaagggtagaagctgggcatggaagcagagaggcttttactccccagcatggaagagacaagttaatttttttttgaaatagtttcgctcttgtcacccaagctggagtgcagtggtgcgatcacggctcactgcaatctctgcctcccaggttcaagtgattctcctgcctcagcctcctgagtagctgggattacaggcacccaccaccacacccagctaatttttgtgtttttagtagagacagggtttcaccatgttggtcaggctggtcttgaactcctgacctcaggtgatctgcccacctcggcctcccaaagtgctggaattacaggcatgagccaccatgccccgccagaagagacaagctaatcttaattgggaaaaatttggaaacctcatagagggctctttggctctctaaatgagtctgtcagggcccatgaggatgccagggggacctgagaagaagtaagatcaactctggaggctccaaggtgctgaggaggaaggagaccaaggaacaggatgggggctggggggagtggcttagaggcttccatggacaggtgagagtcacagtgcttgggcttgggggaactggaaaacggattctggtcttctagtgggagagaggtagagtgtgggtctgtggatgtgttcatgattttgtcctcagagagcaagcttgagttgaaagagtcactgggataggtatatggagtaaacacgtggcatagagcttcatatcaggatttcatgtagtaaaagctagctgaaaaatggatggatgaacaagtagatgcatgaggcgttatgctaagcattgaggtgcaataacgtggtctcaatggctctaacactgtccaatcataattctctgttcaccatgagtcactgcagctagctcttagaaatattgagatccgttttcttaaataatccctgctgagaatatttgtcaatcaaccagaaggcttatatggagatactgtgagcttcttacagttaagccttacaggataaaaaaaagaagcccaagacagagttctgttctacaaagggcacccatctattcccctatccccacacaagtttctcctccttgagttttgtctaatattctattagggccaatgctacaaaatcaggggcatcatacatgaaatgagagcaatgaataatttgtgaggacaaccgagaagagtccatttacgatgcgagaaacgaacctgactgtaaatcaggtgaaggcaaatatcttctagagttaaaagcagacaagaaaatatgcaaaattaaggggaaaccacttcatcttcatgacgtgtgcactacactctcatttgcactgggagtgacgttaactcaccagtttatttgcaaatggacaaagaggaacctgaaacactttcattaccttaaaagagaaatttgccagctaaaaagaatgctcccctgaaagctcataatcttagtcagcctcttctatgctccccaggccactgctttgctgagtcattctactatgcagcccctcagacacaaagcccggcggccacctgcccacagaggcacagagggccagccaactgcaagcacggaacttcaggatcttgcttttcgggttattttcactactgtaatttttttgtccttaggtaaaaaggataataattgtggaaaattatgtccttaggttaaaaagatcctggatcatgccagatattaaaatatggataaaattggcatgatcttggaatctgaacagaaaagaagctgcttttagctgttttcaactgtttttagcttttctgtctaaacagctgtttattctgtttcacaaactctcttagcagaatatttaggcaaaaaagaagaaaaagaaattgcagaataataggtctaatataatcccagttctaatcacacataaagaaatctgaatggtttacaaaaccattgagagcggtgatataagggctgtgactatagaggaatctcattttctaaattttgtttttctccaatgtatgagaactgggattacagtatacctattattctgcaaaatgaatcattagtttttatttattactcttgcgattaaaactagtaaacattaaatttgagagatgaccaggcactaggatgcactttgcatgggaagttttcctagtggtgaaatatcttcttaattaagctgtttatactctcctctataatcatttagtctcatttccttcttgttttggtttttcctacagatgaagaaagtggtcagcatcttccctagatcagaaaaactgcatctgttttccctttttattgtgaagtttcaaacacatacaaagttagcagaaattattaaatgattgcctcttggccttttggctaagatcaagtgtaaaaaattattaaatgagcaattaaaaacacttttgaaacaaaattaaaaataaaagaatctatgtaaaggaatataagatattgaataagtaatgagctagaaattataaacctaaaaaaatacaataactgaaatactcaacagatagcctcaaaagtagtttggagacaacaaagaatgaatccgcaaacttgaagacagataattagaaattactcagtgtaaacaatatagagaaaatagcctagaaaaaaaataaatggtttgagagatctatggatgataacaaaaaatctagcttttgtatcatcagggtcctagaagtaaggagaaaaactgttcaactgaaaaaaataatctaataaataatggctaaaatttccccaaatttgacaaaagacattaaacccactgattcaaaaagaataaagtagaacaaaccccaaataggataaatccaaagaaatccataccaagacaaatcatattcaaatttctggaaattaaagatggaaaaaggtcttaagagaggttaaggggaaacaatacattacttgtaaaacttaagccagaaagaagtggcacagcattttataaatagtgatttaaaaaaatcggcaattctgaatgctctacctagtaagactattctaggtatatcagtttaattctgatgcttgttctgtgtcttcaaactattttttttttgtcttttagcatgccttgtaattgttttttaatagtcagatatgagatactggataaaaggaactgcagaaagttggtctttactaatgtggtagtgaggtgttgatggcagcagcgctgccatcatgccagctgcagcagggaggcacagctggggctccacattcctaggagactggaagccaggacaagctggagacttgcccttctgagttggggcagcagctccccaggtgccaatgcacccacccaaaccacagctggcaacccaggcctcccactttatggagcaggcagggtccctgccctcctgggtgcagctgcagctgcagacccaggcctcctgctccatggagcagggaggagtcctgccttcctgagtaaggctgcagctgctcaagctgtggctgccgatcagagcctccctgtgctcttgcaggtgccaggagcagggaggatctctgccctccctggtgcaggtgcaaccaccagatccacaagtgcagacctgggcctctgctccaccaagccggcaggagccaaggacaagcaggaaccccaccccttctgagttggcagggtgggagctccctgggtgcagctgcagccaccttcccaggtacaagacctaggtgtctctgcaacctacacccttaggggccagggaaggccccccgaccccggtacccataagcccaggggtgtcttctccagttgcctggcttctcactgctccgggcacaggctcccatatcagagcagggttggagccaaggccgggtgctatcacagtttggcatggtctgcacacacttggatcagtgctggcaagccagtgccctgctgccccagccccctccagaatttgggtaccaatgagagtaggaggggaagcagaggggagctctgaggattgctcagtgctggcctgcaggtgcctcttggtgccagcagccagggggacagggacagcagaaggcaggcaggctcctgggtggaagtgggtgggttgccagtaagaccccaccttcaggccaaggagggcctgaaggctgggagccaggctgccagaccagcagaatggagtggggacttgtggtgccttttctggactgcccatggccctccatgaactgatcaacagggacttcttccctctaaggtccaaaaaagccccaggctcagccagagcagggcagaggacagatgacagaggacagatggcctgctgcagtgaggaactactctctcttctgagagcttcagagacctgcagagacatagggactaccagctgcagagagaagtaactttctcgagggcctcctttctggtgagagcagcagatgtcaggatgatgaccaatagcagagaggagctaccctctccagggcctcctctctgcttgagagctgagcactcaatgggaagatctgcttacagagaagatgatctgcctacagagaggagctatgcactaagggtttcctctgagctgttctaacacttagtaaagctttctttgtcttgttcacccttcacttgtttgcatacctcattcttctagaggcaagacaggaactaaggcaaagatgccaccagccacagaggtttctggccagaaaatcaataccccaaagatcctgtaacagtgcaagaaggcaggcaggctcctgggtggaagtgggtgggttgccagtaagaccccaccttcaggccaaggagggcctgaaggctgggagccaggctgccagaccagcagaatggagtggggacttgtggtgccttttctggactgcccatggccctccatgaactgatcaacagggacttcttccctctaaggtccaaaaaagccccaggctcagccagagcagggcagaggacagatgacggaggacagatggcctgctgcagtgaggaactactctctcttctgagagcttcagagacctgcagagacatagggactaccagctgcagagagaagtaactttctcgagggcctcctttctggtgagagcagcagatgtcaggatgatgaccaatagcagagaggagctaccctctccagggcctcctctctgcttgagagctgagcactcaatgggaagatctgcttacagagaagatgatctgcctacagagaggagctatgcactaagggtttcctctgagctgttctaacacttagtaaagctttctttgtcttgttcacccttcacttgtttgcatacctcattcttctagaggcaagacaggaactaaggcaaagatgccaccagccacagaggtttctggccagaaaatcaataccccaaagatcctgtaacagtgcaagaaggagaaaagtgttctatagttttatatctcagtcttttagtgagcctgtgtctctaaactgtgaacttcaaacagagcttctcgacccccccaacactccccttaggcaggacaagatggctagaatgaactgaagttgagtatttctcttcccctatgtagaaggctaaggcatgctggagcatgctatttcctttcttccaggttggttaggctctgataaaatcccaatagtttaggctctgataaaatagtttctcctgaggccaggcctttttgactagaagagaatgatctgacttacttcaaatagttcctcctccctctcctcaccagaagaacaagatcttttttttttttttctgatattcactgtgagaacctagttgaactcctgaaaccagaactcacaaaagtgggaggccctcctttgaatgggtccccctggactgtttaactctcatacttatttactgtgaatgcccagcaattcatcaattacagttcaggtttttctaccccatactggttcccacaaaggtttctgctcaagggtttctgctgcagtaatttgtgattctaagtattttcttgtcagtctttccaatttaaggggcagtaaacctcacttctctgatggatctaagagttgttaattaatcagtttgttcagccttttatttgttgttaggatgtagtgacaacttccaagctccttacgtactggattgcaaaccagaagtcaaactattccttagaaatgaaggggaagtaaagtcattttcagatgacaggatactaaaagaatatgtcaccagaagacttgcccttaaggaatgactaaagcaagtgctcagaacagaaaggaaataataacaaaagacttcaggacctcaggaagaaagaaagaaaagtggatatgaccataaaatgtaatcaattatttaaacaaaagtaataacaatgtagcgtgatgttaacatgtatgtaagtaaaatgaatgacaacaataatataaaggtcagaaggggagaaatggaagtatcctgttgtaagtttcttatgctatacgcgaactggtataatatcatttgaaggtaggctataataagttaaagatgtgttctgttaatcctaagaaatatgaaaataacacaataacaaagagttacagcaaataagacaacaaaagagataaagttggatcataaaaataatcaatttgaaaaaagtcagggaaaaacagaaaaaagagcaaaaacatatgggataaattgagaaaaacagtgagatgacaggaattaaacctaactatatgaataattacattaaatgtaaatggcctaaacaacaccagtaaaaggcaatttgtcaaattagattttttaaaatgctaatccaactatgtgctttttaccaacacaaaaaggcactttaaatgtaaagacataactatgttaaagaaaaaggatgggaaaaagatacaatgtaaagactaacaaagaatctagagtggctatattaatataaaagtggatttcaagcaaagaatattatcaagcataaagaagaacatttaaaaatgttaaagggatcaacttgtcaagagaccataataatcctaaatgtttatgcacctaataacagagctccaaagtacataaaacagaaatcaataaaactataaggagaaattaacaaatacagatataaattagatattttaatacctctctctcaataattgatagaatgagtaaagaaaaagatcaccaaggatatagatgacttgaacaacactactaataaaatatacctacttggcatttatagaacacgtcatgcagaaatagcagaatacacattgtttacaagggcacgtgaaacatttttcaagatatattctatattctgagccataaacaatgcataatacatttaaaaggattcaagtcaaacaaagtatgttttcggagcaatctgtaattaaaatagaattctttagcagaaatctatctggaaaattcccaaaggtttggaaacaaagtaatgtgtttgtcaataaccaggggtaaaataagaaatcaaaaggaaaattagaaaatatcttgaaaaataatcaaatgagaacacaatatatcaacaatagtggaatgccacttcagcaatatgtagaaggaaatatacagcactggatttctactttagaaaaaagaaaacatctcaagccaatgacctcatcttccactttaaaaattagaaaagaagagcaaattaagccaaagtaagcattaaaagggaaataataaagatcagaatgaaaaatcaataaaatagcagacagaaaaaaatagaaaaaatcaataaaaccaaaagctagttctttgaatagatcaataaaatttaaaaacctctaggtgtattgatttaaaaaattacttaagacacaaattcatcaatattaggatttataaaggtgggatcactcagattctacagatattaaaaggataataaggaagtattgtaaacttttatgcctataaattttaaaacttagataaaatggataaattcctggcaaggcacaatctaccagagcccactcaaaaagaaagaaagaacccagacaatcctctatttacggaataaattgaatgtttagtttaaaatgtatgcatgaagaaaattcccggttgacatggcttcactagtgaactctaccaaacattaagagaaggaaaaataacaatccttacaaacgttttctgaaaattgaagagatgagaataattccaaattattttatgagcctattattgctctgattttaaagtgaaacaaagaaaactatagatgaataactaactctcatgaacataaatgcaacatttctaaagaaatttagcaaatctaatccaacaatatgtaaaaaggataaaacatggtgaacaagaagggtttatcccgggaatacattgattgggttttgatgttcaaaacccaatcaatgtaaatcactattaactacaaaataaaagcaatatgatcatctaaatagatgtagaaaaaaaatctgaaaaaaacccaacacccattcctgattaaaaactattagaaaactaggaatagaaaagcattttctcaaccaattgaacaattgaagggtagctatgaaaaacctacagctaatatcatatttcatgataaaagatggagttttcttactctaaattcaagaatcagggaaaagtgtctgctctcaccactctatttaacagtgctggaaatattagccagcaaaacagataaagaaaaataaataaatggcatagactggaaagattcatagttggcacaattatgtatatataaaatcctcaggaatgtacactttacatactagaatttaaaagtaagtttagcaactgtgttagttcgttttcatgctgctgataaagacatacctgagactggacaatttacaaaagaaaggtttattggacctatagttccacatgtctggggaggcctcacaatcatggcggcaggcaaggaggggcaagtcacatcttatgtggatggcaacaggcaaagagagagcttgtgcagggaaactcctgtttttaaaaccaccagatctcatgacacccattcactgtcaggagaacagcatgggaaagacccacccccatgattcaattgtctcccacaaggcccctcccataccacatgggaattatgggagctacaagatgagatttgggtggggacacagagccaaaccacatcagcaacatgtcagaacacagaaaaaatgtaaaatatcactgtatttctatgtactagtagtgaactgtcagatgttaaaattcaattgcttagaatggcatcaaaaatatgaaatactggccaggcgttatggctcttgcctgtactcccattgctttggaaggctgaggcgggtggatacctttgaggccaggagttcaagaccatcctgagcaacagggcaaaaccttgtctctactaaaaatacaaaaaattagctgggcatggtggcctgtacctataatcccagctacttgggaggctgagacacaacaatcacttgaacctgggatgcagaggttgcagggagctgagattgaaccactgtactccagcctggggaacaaactgagactctgtctcaaaaaaaaagaaagaaatacttatgggtaaatctgacaaaataagtgtaagacctgtacactaaaaactacaaaacattgctgaaataaattaaagaagacctaaataatcggagagatatactttgtttaaaggtcagaagtctcagtattgctaaaatgagaactcttcccaatgcagtgctaatcaaatttctagcaggctttttgtagaaattgaaaagcagatttgaaattcatatggaagtgcgaacaaaaccaaaagagccaatataactttaaaaaagagaaaagatgaagttctaaaactatctgctttcaagatttattataaagctacaagtgatcaaaatattctagtactagcagcaagatagaggaaaagatcaatgaaccaaatagaaagtccagaaatagacacactcaaaaatatggacaactgattttggacaatattgcaaaagcaattcaatgaagaaaggatagccttttcaacaaacagtactggaagagttagattcctgtatgcagaaacagacaaaaacaatgaacttggatgcaaacgtgcattatataaaaagaagtgattcaaatggattgcagatctcaatgtaaaatctaaaactataaacctttagaagaaaacataaaagaaaatcttcatgaccttgggttaggcagagtttttaggtatgacaccaaacacacagtccataaaaaataaattgataaattagactttatcaaaatttaaaattttcattctttgaaagatactctgaagagattgaaaaaataagccacagattgggagaaaatgtttgccaagaatacacatctgataatgcacttatatccagaatatatgaagaattcttaaaactcaataataagaaaatagccccattaaaaataaaataggcaaaggatttcaacagacatttccccaaagaagatatatggatggtaataagcacatgagaagatgtcagcatcattagggaagttcaaattaaaaccaccatgtgataccactacatgtattttagaattgctaaaattaagaagactgaccatatggggtgaggatatggaggaaatgaaattctcatacaatgctattggtaatgtaaaatcaaactaccactttggaaaacagattaaagtttcgtgaaaagttaaacatgcacctaccacatgtcccagcctctcagttctaccagaaaagaaagcagatatccatacagagatttgtacaccaatgttcatggtacatttattggtaaatagccccaaactggagacaactcaaaagttcatcaacagatgaatggataaacaaattgtgatatatccatacaatggactattactcagtaaaaaagaaaaaaaagaaaataatagtaatggataatcacaacatgcataaatctcaaaaataattatattaagtaaaacaaaccagtcaaaaaagaccatatactctttattccattttaataaaactatagaaaatgaaaatctttggtgatataaaacaaactagtagtgaggaagagaggcttgggagggaaattataaattacatgaagcaacttttgggagtgatagaaatatttactatattgattgttatgatggtttcatggatatatacatatgcaaaaacatatctacacttcaaatatgtggaatttttgtaggttatttatacagcaataagcctgctcaaaaaagtaaatcgagcaatggagggtaccaagattttacttgcatatgactgttctctatctagcctgcaaacaggtgcacacaaaatctgcaactttaactggagcttgccaggcaacacctctgcaacattatgcaaatcactgtgagaaagagacaataattatgtcaaaaaccaccaaaatatgtttgtttccacacactttttttaaaattcccagatctgggctgtctacagtatgtgcctgccagttaacctaacttggggcttttcactttggtttaaagaatctgaaattgagctctgctcaagttaagtgcatgtggtgattcatgtgcatggaaagtaccttgggctgaccacaaactagagttccctacaactacatcaatgtcaaaactaaccactgtctcctagcttgtttgtttaaaaaaaaaaatcccatggtcttcaatttggtcatttaaaaataatctacaaggtatactgtttttctgttcttgttatttcctaacttttaaggtttctatttttccaccctgtagatcttgttctcactagagaataatttctacattatgcccaggttcttctgagctatgaaggggcccagatttaagggctatttttgacaccctaaatgtgctgagacaagtcattaaggtggtcctgccaggacacagccatctaaagcagcaatctgcttcttgccagaaaatctcgtgcctctgcagagccttttccagaatgaaccacaccatgctgaggtagggtagaaggggcagtacaccaataggcctgggtattctagaacaataggcctagaacttctcatcagctcctgtttcttttcatctctaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatctcctgctttgttttggactactttgaagtgaaatgcctgttaagcctaagtggggtaggtcatggcgtacatgactgtgggctcaggatggatacaggcattcaggagttgtgagcaaatagaacttaaagccatgagagaagaagggatcaccaagagagacagtgtggcatagagaagaaaaggggtggaagacgatccctgggcagaaaagtccttagagcagaggcaacaggcatgaccaagaagactaagaaagaacattcagtacagcaggaggagagcaaaaaatgtgtggtattctagaagcaaagagaataaagggcttcaggaaggagcagtcaagtgtgtcaaataagataaagacagacaagtcccctggattgggtaggaataaaataacaacagactgccatacaaatggttctatctacaccatctaaaagaatatagtttattctccatacatttaagaaacacctgccatatgccaggtatcctttcaagcactgaaatgcagattcataaaacatggtctctgctctcaaggagctcacagtggtaaggaggaaacaggcaatagcgagtgttctcattgcattcgtgaccccattgatcttgcaacagccccatgcatcagttattgccattataccattttaccgataaggaaactgtggcagggaggggtcaagcaccttgggtatttgacagcaaaaccaaggcttggtggtatcataaaacttccaagtagtaattcacaaaggtgactgggaaatggaagtgaccagaaatctttgcactatgaggacaagttcatgaccctgatacattcttgtccaggtagtatagctccagaccaaatgtctgcggccacccacccaaaaacttgttggataaaaatgactacacctatagtcaaatgatttttgacaaaggtgccaaacagttagataggaaaaagaaagttattttcaataaatgttgctggagcaaccagatatccatatggaaaaaaaatcttgaccacctacctcacaccaaacactaatattaacttgagatggatcataaacctaagtctgaaaactaatagtaaagttcttgagaagagaacatgggagaatgtcttcatgatgttcaggtaggcaaagatattttaagacacaaaaaagcaataagcataaaatttgtaaagaggtgactggggctttatcaaaattaaaatttatgtgtattaaaagacatcatgaataaagggaaaagggcagccacagactgggagaaactctttactatacatatacctaactgaggctcatatccagattatatgaagaactccttcatactgatacctagggtcttgattgcatgccccgaaatcagttgattcttcccttttgaaatgcattcccacaaggatccagcctttgggaagccatgcaagtagaggcagaagttgtttcagcttcggaaagggccactctgctgaggagtgtccttgaccggcagagagaagatgttcctgcagccatgctgattccagggggatatagaatttggggcctgggaatgtttaaaaatgaaagccagttaatagttttatttttcttttaacatgacagacaggagaacaaccagcaggactccaggcttaccctgacatttttgtcaagtatatgcgggttctccagagagccagaatcaaaagatgtgtgtatatacagccatgtgttgcataacaacaaagatacattctgtgaaatgtgtccttaggcaatttcatcgttgtgcaaacatcatagggtgtatttgcacacacctagatggcatagcctaccacacacctggactatgtggtatagcttgtcactcctaggctttgtacagcatgctactatactgaatactgtaggcaattataacacaatggtaggtatatatgtctatgtagacatatctaacatagaaaaggtacagtaacaatacagtataaaaagtgaaaattgcacacttatatagggcacttccaatcaatggagcttgtagaactggaagttgctctgggcgagtccgtgagcaactaagacattacactgtgcgcttaggctacactaaatttctaaaaatattttttaaaatatataagttagccttagcttactgtaacttttttacttcataaactttaaacttctttttaacattttgactcttttgtaataacacttagcttaaaacaaaatcacactgtaaagctctacgaaaatattgtctttctctatatccctattctataagcttttttctatttagaaattttttatttttaaattttaaacctttttgttgaaaactaagacataaacacacattagcataggcctacacagggtcaggatcatcagtatcagtatcttccgcctccacatctcgtcccactggagggtcttcagggatgataacatgcacggagctgtcatctcctatgatagcaacgcctttttctggaacaccgcctgaaggacctgactgaggatcttcttgaggaggtgtcactcttttcagaaatatgtccatagcatcttgcttagttgtttctttttttcatcacagatttgtttgtaaacagataatgcaccacgaacattcctctctattaataaaaacctttcagtgtcgggggtcactttcaaactttttaaagaaaaagttgaggtctgcaaaagcttctgccaaatgcttcactgtgaattttctcaggggttcttcttttcttctcctgcagtttcttttctcttgcctctcttcagctatggattctggttccagttcctacaactcattagtcagtttctcaggaaccgttgtttgctgtctcaaccacagccttgttgagtaatatgctgtcctgtgatattgtgatggctatgaaatcactaggtgataggaattttattatattataataatatattatatattataattataatatataatttatatatagaatatataatatattatgctattataatctcatgagaccaccatcagatatgtgatcctttattgaccaaaacattgttatgcagtgtgtgactgtatatataggtatatgaagaaatttatattaaggaatcggttcacatgattatggaggctgacaagtccaaaatctgcagggtgggctggcaacctggagacccaggaagagtcaatgttgcagttcaagtctgaaggccataggctgcagaatcccctcttgcttaatcttctgttttattcagtctttcaactgattggatgaggcccatcctcattatgagggtgatctgctttactcaaagcccatccatttcaatgtaaaaatctcatccaaaaacacctacagaaacatctggaataatgtttggccacatgtctagacactgtagcccagccaaagtgacgcttaaaatgaaccatcacaccaattgtgctattgacctgtacccactgaggtgagacatgatcagagactgggcaattttcacagtttggacacagctatgagcaacatagcagtgattcagcaagctcacaatagctttaccaggcagcaaattgaagcagattacagctactaggaaagacgcttctcattttgtgagatgtgctcccgtggctgaaagattgtgtgaattaggtagattgagggaagggccaattgatttagagtactgcaatcaagacaactggatagcctagtgatgccagctcagaaaaagaatagtaaagtatagtgaaaacaaaaattcaatttaacctggttctagcagaacaccagcaaataaggaaaacaaacaaacaaacaaacaaacaaacaaaaaacagctgcagagaaaactcaagaagccccatagagagggtactttgggatctgatgcatgcttgctgatggtgcccatccatcctgtctctgctggacgcctaacagtgttcctcacctgcactgtaggtgtccaatgcatgctaagtaaaagtgatattaagagctgcgtgccaaatttcatttcacattatatctcagaatttcttttagtttttctggaaatgtaactactataatggaccttacaaatgcacaaatggggccgggtgctgtggctcatgcctgtaatcccagcattttgggaggccgaggtgggtggatcacttgaagtcagaagtttgagaccagcctggccaacatgaagaaactgtgtctctactaaaactacaaaaattagccggacttggtggtaggcacctgtaatcccagctactcaggatgctgaagcaggagaatcacttgaacctgggaggcagaggctgaggtgagctgagatcacaccaatgcactccagcccaggcaacagagagactctgtctcaaaaaaaaaaaaaaaaaaagcacaaatggtattctgtatctgaaaattgtttggattaacttttgattcttgcctggttaaagaattacaattcttacctcagatcatgcttaaactatcttatttcttctcatcacaataaaataaattagtgtcatttttatacttgattgcctcaaggatattttaacacaattttgtttcttatcttttgtaccactcatttgaaaacttatggtcttaatgcaaataatctgaaagtaataaaagtataactcctagtaatttccatattgctgcctgtagaaaagttataaacatcccaatttattctggcaagaaaaaaatttttagtaagcaaaagccttgactgaccaagtgcttcacaaaagaggatatctaaatggccaataagcacatgaaaatgttctcaaaccattatttatcaaggaaatgcaaattaaaaccacaacaagataccataacacacccacttaagtgtctaaagagactgaccataccaaatgttggcaagtagacaaagcaattggagctctcactgctggtagaaatgcaaaatgatacagtaacattggacaaatgtttgggattttctagcaaaattaaacattcacctctcagatcacccaggaattctactcctaggtttttctcaaggagaagttaagtgcaaatatccatcaaaatgctcataaattttatttgtaatagctaaaaacaagacacaactcaaatacctattaaatgtttatctagacacaatccaaatgtaatacagtcatgctctgcacaatcatggtcccatgaaattataatggaaggaaaaattcctatcacccaagtgcacactgtttataaagtccacagcggtgtacaataacatcctaggctttcacattcactcaccactcactcactgactcaccagagcaacttccagtcctgcaagctccattcatggtaagtgccctgtacaggcgtgccatttttatcttttataccatatttttaccataccttttttaatttttaggtatgtttggatacatgaatatttaccattgtgttacaattgccaacagtattcagtacaataacatgcagcaaacgtttgtagcctaggagcaataggccttacagcctgggtatgcagtaggctgcaaagtgtagaattgtgtaagtacactctatgatgttcacacaacacaaaattacctaatgacgcatttctcagaatgtatccttgtgactgtcactgtctagacatacatacaatgaaaaactactcagcaatgaaaaagaataaactgctgacacacaaacttggatgaatctcaaaaacattctggatgaaagaaactactcaaaaagaatgtttactgtatgattccatttttatgtttaagaacaggtaaaattaacctgtgatgacagacatcagagtcatggttactcctgaggagaggggtttactagatgggacaggaggggactctctccttctctagggtggcagaaatgctctggatcctggagtgggtgatggttgcatggggtcatacataaataaaacttgctttttacatatagattttattctatgtaatttatatctcaatttttaaactgcagaacaaaataaagatggagagcagggagctgtgctttttccattttactcccaggtgccagaaaggagcacttctggaggggctgaggctacaggaggttagagaacttctgcaggtccagagacagcttagaaccaagctctggctggtcttccctccagcagctgggaggagggcctctctccacttgacagagcagcccagccccaacttggcagcctgcaagtgaaaacagcttctctgtagaaagtactagaacatccaccccctttcacagtgcggctggcttcctccatcagtctctacaggtgtcagaaggcattgatagcaccctaaccacagccccggggactctccatgcccagtcataattcaacggcaccagggtgacccctcagtggagaggcaggctttctttgagactgtgaacattgaaccaggaccacttgcccctgacggtctttccaggcagactgggagacagtggcattgggaccattctttcttgggctactctgggccagacatctaatcaaatgctctctttcccatccactgattccataagccccagagtgagtcaggtttctcaccccaagtggaggggccactcacgctagggggctatgttcctgcgttcagatccctcctttcttcctctgtcctctcccccatctcttcagctgtactttctcctgtgctcactttattctctagattaatttcttgcctcatccttacactcttgagttcagaataacttctgaacttctctctcccagggttcacaccagttgcccaaagaggactgtaattgggccactccaggaccaatcactgtggcaggggcacagactctctgattggccaaccaggtgatgggatcacccttggctgacagtcccactccctgcagccagggaagagcagagtcaaaaagaaagcaaagccacgcatgcagagaggttaccagtgtccatccagacgcccacttcacagacaggtagccaagcgccagagcccggctattgtagccctaagtggtaagacagctttgagaccagctgccggtcaggggtcaaggcgcaggaaccggaaacccccagaagcctgtctgcttcccactttcacataagaggatgagccccgtcctctacagcttgtggcactctcgctccaccgagccggaagccatggagcagacagagtcccagtcctgactcctcccacttcccacaacccatactgctatcactggcaatcacagtaggagggtttctctctgtgcaaacaatgatactgatctggctcttggtaaaatcaggggcaggtgttcccttctggagggggctgcacaggaaggatttccctgctgtgagggaaacacgggactgggagaggagccctgacacaccacacacaggcctctgcttgtcttcagtctccggaaaatagaagttagggggcagggaggggagtggggaagacgagaggtgttctccctgggtttgagaaattgggcctgggaggggaccccttcagacagcacccggctgccctgggacttatggcaataagcaggtagccgccttttcttttataccctgccctcggacatcagctgccagttcctgtctcgcagtgtgacagagtcttttcctcccatcctgagtcctgcagaagcgcccaagcttctaaggacatccccaacacggtccctattcctggtgagtgacacacaggggagggtccgtgctacagggaccgtggaaggaaacaatttgaaggaagcctaatgaaagcagtgactcctgagctgggatgtgaaagatgaataggagtcttccacgtagtggggccttgggggcagagcattccagacagtgggattagcaatgtcatcaggtgtggtcctggcaattgctggctctttgctatttattgggagataaaggtgagtcctccggtggagagaagaaaggagacgaggaaggtggcagacccggcagggcccccgggccctgctactccccacgtctgagtccatctccatgactctgccatttcccaccatccagatcactgttagcctaacactgttcttcagaccaatggagaagtaaatccatttaattccactaccaaaatgaaaaaccatgttacttgtcctaaatagaagatgaccacaaaacccaaaaagtcactattaaaataaacagcatcaatttttatgccacctaaagccacctgatgtgccacacaccgtattttgagaaactgccataggcaacaaggagccaagaaaggattttcagcaagggaatcatatgatcagatttgtcctttataaagaccagtccgaagagaagggatcaaggggctgaaagagggccaggccagaggagaaagcagttcatcagttgtctatttttacaaaccctgtacacagttgctcttttttatttagttgtccttgaaactgaattccacataaaactaaattgggcatccccttctagaagcagctcagtatcactagcaacctggaatggtggaaatgtccatttgctacaaaggaccatttggtgatgagtggccggcttgagtcccacctggccctcactttcctcactttgaggggtgaatttagaatctgggctttctgatatctccgggtgtagaagcaagcaaaaaccccttctctcttttcagggctgaactcatccagagggaagtggagatggtgctggctgtggttatctttcctccactcgagggattgaagctaggctgtcccacggcaccgggctcgtggctggccctgggtgtgtcgagttcatgtattgtctccagcagtagccgaggagtgacagccttgtgtgcaggcctgaaagccagggcaactcccaggtttcattgctgcggtggctaatttttatgtcagcttggttaggccgtgctacccagctgtttggtcaagcaccagtctccatgtttctgtgaaggcattttttagatgtcgttaacattgaaatcaacagactttgactaaagccaagcagattacctgtcataacatgagtgggcctcattccatcagttgaaggcctgaaaggaaaagactgaggtcccccaaggaagtcagaattctcctccagactacaacatagaaatcctgctcaagttttctagatttaggatcccagactgcaacattaactcctaccagatgttctagcttgtcaccctgctctgcagctttcaggttctctctctctctctctccatcctattagttctatttctctgaagaatcctgattcatacaattgctataacctggggcaagccacagctttattgtcgttgtttttaatctatggccatcatccccaaatgtagtggttaaaaacaacagttggccgggcgcagtggctcacccctgtaattccagcactttgggaggcctaggtgtgtggatcaggaggtcaggagatggagaccatactggctaacatggtgaaaccccatccctactaaaaatacaaaaacaaaaacaaattaggtgggcgtggtggtgggcgcctgtagtcccagctactcaggaagctgaggcaggagaatggcgtgaacccggaaggcggagcttgcagtgagccgagatcgtgccactgcactccagcctgggcgacagagcgagactccatctcaaaaaaaagaacaaaaacaaacaaaaaaaacccagtcattttattatttctgtgggttgactgcttggtaggtttccatttccgtgtgacactggtgacattagcaggggctacagtcatttggagttcaaccgggctggagcctccaagcagtctcccctgatgtggctggcattcggtgctacctgctggctgcgaccctgactcgtgctggggctgtcaccacggagcctaggttctcttccacatgcctctgtatgtggccccgtcttcttttagcatggagactggggcccaggggaaggaaggtagcagaagctgccagttaacacttaaggtcttggctcagaagtcccagagtataattctgtaggattttcttgggcagagcagtcccagggccagtccagactcaggcgagaggtgggggtgggcatggggtagattccacctctcagtgggtggtggcaagtgcgtagaggatagaatgaagggacggcgaccatctttggaaactctccaccacaccagatagatttccccttttgccttgagaaatccagtgatacataaacatcattatgttatttacgtcaatttgggaataaatgtgttaatttgcaatgtagtctctgtccacttcccaagaggatatgtagtagcttttaatgaaggtattacagaaatagtattgtttctatcaaaataaaaaatgattaaaggctatgcagagataggagaaagacacagtatatctttaagcttgatgaaagtagtttctgccattgtgtttccagctcaccaagctcctgtatctactggaaaatggaagtccagccttaccaacttgtgaaccttgtctgaagggagccagggcctgccaatggaaccacctccaggagctgcaactgctgttgtcattaataccattgtgtctattttttgagagagataaacttttcatggtgttacattttggaaaaaaaaaaaaaagactaggtgaacagtcaggtaggaaagcagcataacagtcccttaaattctgatcatgtaggacattcttctttgccctgggcctgggaaaatgcagcatgttccagagcaaaagtcctaatgaggggaactaaaccagtgggacccaaaccaatgtcctggctcactgaggacccgttagaaccaaatctctgggtgtggacaggctcccatacttttcaaaaattcccctgatgactaatgaacaaccagaggtaagaaccagtggcccagaggaataaccagcccagctgttgtacgagctcgctaagctggctcaggtcaatgttgaattctctgctaggcagctcctcataagaactggcagagatggttcttacacaacaacaggtgacaactccagactctgccggaagttccaggatctgggttcccggacaatgcatgacactcagtccagcattgcaggtggaagagcgacggtgaaaagaccaaagtcaattaaaatgtgttaaccaaaacaggaaacatgagtgaggtgattgagagtgtgtttaacttagatgtgtgattttatcaatactttcattgttcaaaaactcttattttttaaagatattttcaaaacaaatccaaactttacttttca

SEQ ID NO: 697 - DNA, 33942 bp, Homo sapiens
ccagatcccatcctccggaaagggttagtcaggcaagtgtgctgagaggcccctgggaacctcgtctcgattaacccatcagaaagcagcccatcctttgcacccagctctcagatggaaaagtgaagcccagaaggaagggacctgacacggaggcttccttggtagcatttcagtctcaagggaagaactgtgggcctcccctggagcactggtgaagtaaggggttggtttggatattgtctcctgactgggatatgggcaggactgacagggagctggagtcctaacgaagcctgggctaggtgcaggaagaaccaacccagtggtctcctgacatctcccacgcccccaccgcagctgggtcacctccagaatacggaggagagagctggaggtggaggaactaaggaccttctttgccaggtggggacttaaaggtaaggcgacgattacttttcggcgatgggggtgggatggaaacaaagccctttgaggtctggggcagcctctggtggcgcgcgcgggtttaagtggtggcgggccgcgcccgatccctgtcctggaccttcaccctctcctgagggcctgggcgggccgcccagcgccagcatggcctccttggaggggctcccgcagtgcccgcagcgcagctccggctcctccggagcctctgttccgctgcctccctgcgggcaccatctgtctgctcgccggggtgggcgttctgcctgccccctgcgtctcagtggaggaccgagccttccgagccaagctgccggtccaggaacttgcggaccgcgccgacccgctgcttctgcctgcgcatccacgcaggtgcccctgcctgagccctaggtcgcgcgctatcctcaccggcttcctgggcggtcccctccacctgttgcttcaggtcctgcaagcccttgcttgccatggcttcggggtatctgtggagtcgtcaagagcagctggagcgacgttggatcctgcccagagtggcgatgccaagcgccagctccggtttttaaggcgccccagggctggcctgccccgcgtaggggagagggcgcggggcggttcccgtcatacaggctccggggagtggccgggccctgctccagagtccgcagggcagggagcacatcctggcctaagacgggccgcggtgggaaaggggcagaccgaaccagggaccgaagaggtgccaggacaggggtccagagaggagctggaggcaggagaagggcgcacaccacctcccagctcatcagccccagccctccctttctgatcctgggcgtgagcgctgggtcagctccagggcaggagctcagggctggtgttgaccttaatgacagcagtggtcttttactgagcatttgtcttgtgccaggtgctgcctaacgctctgcagtctcttgtataatctttacaaccacctcctgaagtgggtatttttgttgatagcatcagtgtataggaggaaactgaggcagtgaggtcggtctcacccaaacgcatgtggcagggacttggatcctcgaatctgcctaggtgcctgtaaaccctagggctctggcatcatcggagcccccagccccaaacagctgcaggggcactgctgactggctctctgcctgtagccagagacccagtggatgcagccggagagggcctggtaaatctttcccctgagagggcgagatacaggtgtgtgcacttgcagaccatgcaaccccaagggggagagggcagtgtgcctgtgcagcccaggcaaggagattgccgtctgtcaccgaagccttaggaagttgggcaggaagcatggctcagggagggcaggaataagcttgggcctctcaggtcacctttcctgagatggggcaggcaaggcgctagagagtatgacttgtggctgttaggaggggacttagggacctgggcctgagtggagaagatcatccttgggtgcagcaaaacagcttgcaagatacattcccctggcacacaaggggtgtaggtcaggccccacccagctgggtatactcccactccagagtaggccttcaggacctggaggccagtgcacacccaccctgcctttctgggtctctctaccgcttcctgtccggggctgtttcttgcacctctgctggtgtctcccctattctggagcgctgggaagcccctgccacacaggcttggtctgctggcacataccctgcttctagtgctgcggggtcagcccctagagggagttgtttggaagtgcacctgtacacacacacacacacacacacacacacacacacacacacacacacacacggtatggattaatggagatgaggtcaaccctgggcaaagggaagaggcaggtgatgagattaggtggaggaagggggagggagcaggtctcaggcaaaacaaagcggcagcaacagtcctcccagccccccgcccctcctctcccagagcgaggccttgccctgggagcggccatatggatgccttggggactctggggagcccatctcagccatgccctgcctggctggccacagccctgccagccctcctgaaatcccaccggtagtgcccaatagccaggcaggccttcgagtgttccagtttatcacaggctggtggtgccactgggctccaggccccatgggcaatgagctgtgagctggacaggaagggagcagcctctgtgggaagagacagccagcccccagcagatggtggtagagagagctccacgtggccctagcggcaggcactacagtcaaacctcttgggttcagatattcttagagcaagcccctcacttctctgagcctcaacatccccatcacatcacagcgtctccccaaagtgtgtgtgtgaagattaaattggctgaagggtgcccaggactcagcagtggaccttgtgagagcgtgcagggcaccagggcttctcagacaaggagaggcagaaggagggagcgcattaccgcattaccgtttcccccacccccgccccagtttgctgtggtgtcacttttttttttccctttttttgtttttggagacagagttttgctcttgttgcccaggctggagtgcaatggcgggatcttggctcactgcaacctctgccttccaggttcaagcagttctgcctcagcttcctgagtagctgagattacaggcatgagccaccacccccagctaatttgtgatttcgctttctgcagtttcagttactcattgttggggctcagaaaccaataccccgaaatatagtggtgtgacattctgaactgaagaagccttaaggtctctccgaccagactcccacaggccccccaaccctttgtctcttccaaagcatacagtgaagttgttctctgaagttcctcatctgccttaagtctggacccaccaaagaagaaaacaatgaccactggtcccttcccggagttttctctgactgaactgctgtcacaggaagaaagactgaagcctgctcacatacctggacagattttgcaaaccgttgtctgctctgtgagcccaacagactttgtcccaggccactgtatgttcttcaagcccactgaattcccctgaaaatcatttactagccccctgaaattacccacacttccccattgctcatctgtaccccatttcgtggtggggcagtcactctgatttccccttgcatgctaatgaatgtgtattccatttctattctgctttcatgagctgacttttcagtgaaccttcagagggtaaaggggaagttttcccttggcccctgcaccgcaattggtaaggtccaaaatgttaaatggaaaattccagaaatagctggtcgtgatggctcctgcctgtaatcccagcactttgggaggccgaggtaggtggatagcttgaagtcaggagttcgagaccagcctggccaacatggtgaaaccctgtctgtactaaaagtaccaaaattagctgggcgtggtggcgcacgcctgtagtccctgctacttgggaggctgaggcaggagaatcacttgaacctgggaggcagaggttgcagtgagcagagatcgcaccaccactccagcctggatgacagagtaagactccgtctcaaaaaaaaaaaaaaaagaaaattctagaaataaacaattcatgttttaaataactttcattacagtatattgttataattgttccgttttcttactggttattgttagtctattactgtgcctaatgtataaacttcatcatagggaggcacatgtgtacgtgtaggaagatacatatgtaggctttggtactatctggggttgcaggcagctggaaacatcttgagtgtatcctggtggataaggggagtcaaccgtgctcctgcagggaggtcagaagcagcctcacagggtgcagagcacatgaggtttcaaaggcaaagagcactgccagtgcccatggctgggaaggggctttctggtgatgtttgtcatttgagtccaggaacaagccctgagtgtatgtgagagggggttgtaggggggctgtggtaggggcagcagggacccctctgggctcctccagcagaggcagagggccctgaaacctggggcaggttgtcgctgggagccgggcataggtgccctctccctcacccccatcacctgaccagccttgctcctccttgctttctctcacagcccaggggactctcgggcacacccaggccccaggtggcctcctcctgggttcatacaggcctgcttaatgtgtacatgtctgggctggggagcaggaacagccctgactggcctgagctgcttccagacccttcatgcctgcccatggcagtgcttggggatgtggagaccagcagccccctgctccgttctgcctcctcagtggatgcccatggccagacaacagatacagcctggctccgctgtgtctgactgggctcccagcctcctgggctgcccttgaatccactgcagaggctggatggggaggcggtgtggacagggcagtgtctgaagtcacatgtggacggactcaagctctggctccaacacccaggcctgaaggcctggggcaaggcactgagatgctttgagcccaaaccatctgagtatcaaaggggaagccaggatccccagggaaccctggtctgaacaagcccgcccggcatgcaaggctttaaaacaacccaggacacgctggccagtggcctacatgatgggtggtttgcgtcgtgcccggcaggcttgttcagagtgggctgggcaaacagcctttcatgtaggccactggccagcaagccctgggttgttttgaaactttgggttgggggcaatccactgtaagcaccttggggtccatgcagccatagcagggctggggagccacctgggcttctgcccagtcctgtgcgtctcagcaaaacctggatctacagctccaacctgagaggtttattctgaggattaaataaggtgaagtgctcagaacagtgcccagtcaacgcctgtgaggacctcagcagctgttgctttttactatttttctgtcaaggtgcggcttcgtgcgtctctgctgttgtgtttttggtggcaactggcaggcttctgggtgcaggaggggtgcaaggggtacccagctccaggtccagcggggagcatgagactggctggggccaggtgggaggcgccgcagggtccaccttctgtctctcctgtgggatgcccttcatcctcactaggtttagacttctccatctttgaaagtcaccatctgccccagggaggatgttaggtggccctgttcctcttgcgacactggagcccagaactcacatggagggaagacccaggagcctatcttcacctcctgctgacagtgggttcctcagggactcagagcaggcaggcgggggctaccttgaggctgagctaagctatccccgtggatgggactgtgagtcctgtcgaatgtcttggggagccgaaggcagtgctgcctcctccatgttaaaggcaatgggtgggttgggggtgttcctgaaggctcacgcaggtcccatgaatgccctgtgtgtgtccctataggatacctggtcctatcaacaggctgaacccgttcctgttcctgggaggacctggggacccctcctcaagctacacagcacccagaggaagcatggcaggagtgggctcaagttttatttggaatcatttaaaaaaaaaattcacagcagcataagtggggtcagaaggaccagagggtgggtggggccgagggagggcagtgaggttggtgcagcagcacaggtggacaggccaagggtggccagggagacgagggcaggagcgtgggcagccgcatgtcactcaaggcgggcactccttgtgctaggaggggatggtgtccaaggcagaggagcgctcttcaggtcatccacgctggcctgtagccctctagtctcccccactctgggcctgggagagagaatgacctgcacacccagctccaggccccagccttaatgggccaccctgagtgggctgagaaaagttgtcttctgtgccccatgcctgaggggtcatccgtggggggacctcccactcaggttcagggttagccctgtacacagtccctgtaggggctgtggaaggtcaggaggcccctctgggccctgggagcccaggagggaagcagtgcgtctgtgggggatggggtccctaccaaggaaccccccatggtgcaccccaggagcccagctcctacctcctctgccacttcctctttctctttggatgcctcaccctcctgttggggggcagatggcctcaagtcctcctgtaggggacaaaagggggcatgagaccatgtggagaatgcagagacccctagctgccctgcaaccagggccttgtctaccctggcctcaaggaggagcagaggcccctcgtggccttgttgtacttggaggggctggaggtattgggggcgtgcaattcagacaatacccggggctctgatgatgccgaggccttccaggggcaccaagtaccctggagcccagcttcacccctcaagctggtccccagtctctgggaagcccctagttgggcttcactgatgaggaacctgggtggggtagggtggagtgggggttagagtgggcagaggcccctgaagccccaggtctgaccccaccctcagtagccctacaaggaagactgattggggttcacatagggactctgaggccagggaggcttggcatgcagctcagggccttcgagctcaaagtggtggggtgtgttggcatcagatcaggcttgcttcaggcccacttcagtccacaggagcatggctccctctctttgcctcctggacaggctctgggctcaggctggtcagggccagcagaggttacacagtcctctctcacttcccatcttctatctcctgcactccatgccggccagacacttgcgtgagatatcatgacagctgggtgtgtaggaccacactggtgattgccctgcactctggcctcagcacctgcctctggcgggggacgggggggaggcggggatactgtcacctctgtgttgccccagggccatcctgccccttggcggagtggggcataaaagggcagtgctgtgctggcgggagtcggccaggctatccaggggcagggcaggtggccacctgctgagtcctgctgccctaaggctgatgatgaggccaggggtatgagtggtcagatagtccctgctgaggcctttcacagttcactgggagatgagtcgtgactggttttggggtgtcaccaggaaatgagtctccctcgaggtggctccaagggctcactagccctgctccgggattcacaaggaatgcccgggcaccctcaccccagggcctcttttgctgggggtgaggagggaggagccccctggggctctatgtgttctgcctgggacacatgatgatgatgatgatgatggtcaccttcctctgctgggtgctcacatagaccaggagaattgcttcatggaggtcatggccctgcctcatcacacagcccagggaggccgacactctcacccccatcttgcagatgagaacacggaggcccagagaggttcctttgcttctcaaggtcatacgacgagaaaggggaactaggagagggagcggctgccagctccaaggacatggagaccctgtgctggccctggaagcagacacctgggcatcgccccagagccaagaggagtagggcagcccccacccttccacccacccactcctaacgcagggattctcagtgctcagagcctcagactccaccacctaggaggcctggagcaggtaggagagctggacactgctcccccgccccacccccaggtaggaatcctagcccaggccaccacttacactgccacagggtctctcagagtacaggctgctcaggggaattccaagctcacatgaactagccatgggaccttgggcacattaatctctctgggccttagtttccacaccgtctcatggattttgtgtctattaaatgaactaataagcgtacaatgcgtaaagcagagcttgctgtgtcacaggtgctgggacagctcacccagccaacacccgtccctggggtgcgccccactgctcctgtgctgtctgctattgggccgcacacgcatgtgtacattcacacgcatgtacacccacacattctcacaaatgcacccacatgctcactcaacacacgtgcacacacacacaaaggcagctgcagagggtagggtcagaagcagcactgctttcttaccactaggggacgctacttccctgaggctcccagcaggaggcagctgccccgcccagcccagggagggaggctaggccctgggggcggggctggtgctactcagcccccggcctggtgaccactgcccgggaggctgcctgtcaccgtgtgggatcctgttttcacttataaaatggggtgtctcctaagtgctgagagccgtccggaagatgtggttttgagcctcactttccttgtctatgagatgggctcccaagtcccccgaaggggtggttgtggtgattccagacccgaatgcaggtcgaacagcaagcatggaccccaccccatgccggcgctcagtgggtactgaaactgaagccagccgcagccccccgtgttgtttcctggggtgtggagtggagtgatgccgcctccgcccagcagcctttctgggcccaggagaggactgggcaggtctgagggccggggctcaccttgcgcaccaccccggaggtgaccgcgatgttctccgcctcctccacggtcttggtggccacagtgttgacgctgctcaccacagcctcgctcacggcgttggcctgctccttggtcttctcggccactatgggaggacactggctggcctccaccccagccccagccccaaggcaggcctgctggagtcaggctcgcagccccttcccaggagctcagagccctggccctgctgggaccctcccctgctccctctgactccagggcacctctgatgctggtgggggtaaggagacgcccaccctagtttagcctcatggtctgcaggggtctgtagggcttgggaccccagttgggggtaaggcaggactctaggtttgagccccagcactaggatgcaggagccccaggggtcctatcccccatgtgtcccctggccctggggcttctcacctgaggtcacgctctgtacaacattctccttggtcttggctcctggggaggaaatggagctgtcagcccagacctccctcgaggtgttgggggcggtcaggacaaacacaacagaacagctggacaaactgtggggtcggtgggggggtaaggatggtgtctgggggccggcggccccttcagagggcctcttcctgctgtgtctggaagaagtggatggatgggaaggggacaggacagaatgtgggggacaagagagagcaggcctgaggtagggacactggctagacccagggtccagcccctgcccgggtgtggccgggcctcagaagcagcaacaggacaggatgggccagagctgagtcattggcttgacctccccttcctcctctggagagtgccaggagaggatgcgggggagggaacactgagcctaggtttcatcccccagcctgccccttctctctggggagggaggggatccgtgacctggctgtagccgctcccgtgtggagagggtgggggccacctgagcacaggctgctcatggcttcaggggctccaggctcaggggaggctggtatgcttgggaatgtgtgtgtgcgtgcacagacaggtagccagccctgtctgcggtctctgacacccagaggccccgaggaggccaaagacaaacacacataggtgtgcacagggcattgtgggtgctccagggtctggagaccccaccttgatagccagggcctcgccccctcccaaaatgcctccctggggctggggagtaaggtctggcgaaggtaactgggcactcaccctttggccaccacactgtcccaccctgccatgccccacttacccacatacatgaccccctccttggtcttctcagctgcttccgtcaccccctgcttggtcttttccaccgcacccaccacgccctccttggcgatggagaagcccttcttgaagacatccatggtgggtgtgcagggttgtgctgctgcaggcaggacggagctggatctccctgcgagctgcgggcttgagctggctcgagtgctgccgcagcggctgtccccgatgcctcctattgacgccgatgaaatattgatgcggaggccagctggagcccagccagccctgcgtgcagtgggggcggggagggagggagggagggaaggaggttcagcctcaccttcctccaggataggaaggcagagaccaggctccctgggctcctgctggctcagcccagctctcctgccccgtgccctccatgggctggagggggctggccacctcccaacctgtccctcattcatttactgccctgcccacccatgggggcagccctggctgggtgctcttggccccaggggtgctgtgtctatgctgcacctggacagacaggcacagagaggggaggcgccttggccattgtccccagcttcctaggtaggggtcagggccacataggcctgttaggtgagagcagccaacctcccgcggcctgggctgtgcagctacccaccagcatcctggatgccgctggaccctgggctgccatgaaaccggttggaggatctgaggtgggtgggggtggggaaatgaaggacttcctcatgccttggcctctggctgcatgctgtgtgaccccagaatagtcccttcccttctttgagccgcccagtgctgaaggtgctgaggaggcatgaattgccccccatttcctggccagcagtgtggatgggcagcaggtcccctgagatggacctgaccacttcctgtggccccacctcgaagtccacgctcttttcatggctcccagggagcaggttcccataaggatgcatttggtggggccaccccatgtctaccacattcccagagtccctgagccaagtcctcagggacaggaactggcttgtgtggttggcggcccctgtggggccagccagggtagttggggggcaggacaagacccaccgggtaggccggcccaggccacttcctctctttgttgtcctcgtattttcttttcctcctgagatttaacttgaagacaacgtcactagcagtttctggagctacttgccaaggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccggcaaggaccccgtaggacggtaagagggcctggaccttggcagaggtcatggagtaggatctgagtcccagctcagctagagcagagcctctctagacctcactggggtcccatctgtgaaatgggctaatagtatctatctctgggccatctgtgaggctgaaaaagtagtctggactgggtgtttcaggatccacctaagaattgcagggagttccctgtcggagccatggcagggaatggggcttggggggctggcagggaggcacagctcctaccatcaatcacccagcatggggcactgggggactgtggctgaagccattgccagctggcctggctatgcctcctgttcttccaaagaaatcaattctgaaagctgagacccagcaaggctgccctgagattttgatctgagttccctggggacctgactctgactgcccagcagtgagcagagacggccccctgctctccagagcacagtccagggcgctctgcctcagcgacccagcaagtgggcaggatggtcttgcaactggacccagaacatagctttccaacattctatgtgtacagagccagggcccatcctgctgatgaggtgttgggcctgtaagtcccccctcatctccaactgcccctcagtcagagcagcaggtgctgtttacggggcccccagtctcagggccaggcaccttgccacgtgtatctcagttcatccctccaacagccccacttacagaggaggagcctgaggctcagagaggctgaggggcttgcccaaggccacacagctaaggagcaggatctgagtttgacttcagagctcatagtgaactctctgcagcacttggagccagccccagcccccagatgctcctacctccaccctcctgcccccacacaccagacctgtttggctaagggcatctacatggatttagggagtgaggggggggccaacttacacttctgtgcggtgtatgagagccaccatcgcagagcggacctgcctgggataggtctcatttggcttctgagttgcaggtttgttgggtgctttcctgaaaacagatttgaccagggaggggcaagaggccccttagtgagggtctggtggcagtggcgtggggaacagtggctgagcagttggccatggagaaacctcattcccgcctgcccccaactctgctcagggctgggaggtgcaggtgattctcggtggtggggcggcaaggggagcagggggcgggggaggggcgggctggatccagccactccgctctgatttcaggaccaaggaagctccacgccttagtctcaggccaccttccgccttttgatgaaagggaggatgagaggacccggtggacgggagggaggagggagctgctcctcttcctccccacccccttggttgtgggagagacattgctcccttagccccaaggagtgagggtttgggaactgctgatgggcagccctgcaggggccccgcagtccttctctggggttctgagtgggagggtgcatgtacctggcccaggaatgcccaggtgtcccaagcctggaagccccctgcctgcagggctctccttcccacatccagaagctgcagtctccacagggcaagtccatgctctctcaccaaacccggatgggctggtgagaaaggaaggaaacgcgcggcttcctgggctgattacttcccttgctcctgtgaccagggaggtggaagcgtgctccagaccctgtccctgcagcatgggaaggggaggcagactgggttctgctagcaggggtggtgacaccaacaccatcacaaggaggctcggctgccagggccaggcattctgccctgcctttgccacttacatctgtttccagagccccagggctaggctgggcccaggatgcaggccccaataagaccctttgcaaggagaagcttgaatagaaccactacgtcctcagacttccctgaggtggagaagcgaaggggttaactgcttcttaggttgccagggaccccgaggggcccagcccagggagccagcagcctgagcattaggactccgggaggaagaggctgtttctgtgccctggcttggggatgtctagaatgtgggtgcctcagacccaggatttgctgtcccagtggaactcagtctgcggtagggaccgtgctgagccccaggcaaggtgtcccatctatcacattgctatgatagcttggaggggtggggacgcctcccagggccacagagctcctaagtgacagtgagagcccaggcccacccaggctgtcctgtccccccaagagggtggccgtgtaggggatgctgctgccagcaggctggttggccccagtcaccagcctcaggcttctcctgacccttacacaaagagcactgagattttcccagctgggagcttgtggcccagaggagtccagcatatgactggaggtcacacaggagcagggcagagcacaggccgccttctctgggccacgatgcaccttttgcacttgttcctcccccatcctcacccccacccccgacccctgccgggcacagagcccttggtatgaacagggaagaacccccactggccagagctgaagcttccagaaccacgctcaggggttcttagctctgggctgatccctgagagcctcaggcttctctgccaaggcccttttctgactcaaggacaaaatcctgtgagtttctcccctggaatggtcaagttaatggctggcttcagggcctcagaaaacaaggctgctgagaacacgccttccttcccaaggaagacttgagggcccctgggagggcgtttcctggctggggaagggaaggcactccacacaatctgcataatggatgcgccctccccctcccacaggctccctctcccttccccccacaccagctctgatctgtgtgccgcagaggcacagcttcttcgcatttcgatgatgggggaagggccttgcccaaggtcactgtgggttcagggaggaggaggagaggagaacgcaggccgcccagcttccatttaaagctccaaaggagtccacgtaccctcctatctgggtggagcagcaggttggggccacagcagaccaagggcagctccaaaccaggccagaggagccccacatccactctgggttggccactgggagatgagggcacccagcaggactccccaagggagggcacaaagatgaagccagcctgagacggaggggcagagggaaaaatgggcacttcagcaagttgggccgggggcatgggcatcaagggccagccagaagctgccaagagctggaggaagccaaagcaaaggtcaggaatgttcccagggttctgggccagcagcctgtactgtgccaagggagggcctgcccagggtggggagcatgggcagagagaatagcagtgctgaagcccagggtctgggcaggtcagcggagaaagttcctgggcaggaagggtgggcggcatagtttccacttccaggagcttgaggtggaaagtcccagtcactcctggcaggctggaccaggccaggcgtgcctggggcacacgccttccaggccctctgcagtaggtcagaggtttgcaaggaatggaagtttgtttagagagagtttctcagccctggcatactgacattttggactagataattccttgtggtggggtgtggagatgtcctatgcattgtagggtatttggcagcatctttgggccccacccatgagatacctagtcatgagtagcacccaccacccagtcgtgacaatgcacctggggaaagtaccctctcctcccattgagaaccactggtctaagagagatttttccctagggctgagctgttgcgggaagtcagggaccctgaacggagggacaggctggagccgcggcagaggaacataaattgtgaagatttcattttaatatgggcatatatcagttcccaaaattaatactcttataatttcttacacctgtctttactgcaatctctgaacataaattgtgaagatttcattttaatatggacatttatcacttccctaataatactcataatttcttatgcctgtcttgctttaatctcttaatcctgttatcttcataagctgaggatgtacatcacctcaggaccctgtgattttgcgttaactgtacaaattgattgtaaaacgtgtgttttaataatatgatatcagtgcaccttgaaaatgaacagaataacagcgattttagggaacaagggaagacaaccataaggtctaactgcctgcggggtcgggcaaaaggagccatatttttcttcttgcagagagcctataaacggatatgcaagtaggagagatatcgctaaattcttttcctagcaaggaatataatattaagaccctaggaaaagaattacattcctgcggggaggtctataaacggccgctctgggagtgtctgtcctatgcggttgtgataaggactgagatatgccctggtctcctgcagtaccctcaggcttaccaggattgagaaaccccagccctggtaaatttgagatcaaactggttctctgctctcaaaccctgttttctgttaagatgtttatcaagacaatacatggaaccactgaacgtagacccttatcggagtttttgattttgtccttgccccgtttcctcagaagcatatgatctttgctctgctttttgccccttaaagcatgtgacctactccctgttcatacaccccctccccttttgaagtccttaataaaaacctgctggttttgcggctcaggtgggcatcacagtcctaccgataggtgatgtcacacctggaggcccagctgtaaaattcctctctttgaactctttctctttatttctcagaccagtcgacacttagggaaaatagaaagaatgtatgttgaaatattgggagtgggttcccccaatactgagcccatgttccaggagtttccatggggccccaggtggatgtctgtgcaggcaagcatgacacctgtggctcctgagctctggggccagcgccttcccagctctctgtttcagtgttgagtgagcattccttccttccttccatccttatcgtgaggtgtcccctttttacgttgactgatcccttggagatgcactggccccttcctggtctctgttcccactggctggcatatcgaatcctgagccaacgccccatcattttcattccttggctttggagtcggtcttgatagttgtgagagaaactccctactcattgttttctttcaaaatgttctttctttttttcttttgagacagggcagacccaggctcgagtgcagtggttcaatgtcggctcactgcaacctccacctcctcagctcaagcaatccttccacctcagcctcccaagtagctgggactagaggtgtgcaccaccacacccagctaatttttgtattttttgtagagacagggttgtgccatgttgcccagtcttgtctgaaactcctgcattcaagtgatcctcctgcctgggcctcccaaagtgctgggattacaggcatgagtcactgtgtccaggttccaaactgttcttgattattcatctgcattttctcttcctgatgaaaatgattttttttttaagtttcatttttattagttatatatactcataggcaggggtcagaaaactatggccagtgggccaaatccagcccatcacctgtttttgctaacaaagttttattggagcacagacaggctggttcatttatatgttgtcattgacttcttttgtggtacaatggcagagttgagtagatgggacagagttcatgtggcctggaaagcctgaaaccatggccagcatcaggggcatgtgacctgtgcagtcacacacaaggccctgcactctggagggccccaccctgggtgtcaccatcttgaaattcttcatactttttgaaggagaggccccacatattcattttgcactgggccctgaagattatgtagctggccttgtgtcaaatatttactacctgtacccttagaaaaaaagtttgctgatctcctgattaggagtcaactggttctataaggcttgttgagacagtcagaagccccagctccctctggtcccaagggcaatgactttcaactttgcaggtgattcttttgcatttacctctgtatcactaaagaacatgcttgcattgctacttcttaggaggtagcattatctttttttttctttgagatggagtttcactcttgttgcccaggctggagtgcaatggcgtgatcttggctcactgcaacctccacctcccagattcaagcaattatcctgcctcagcctcccgagtagctgggatggaagtagcattatctatgagctagatctcattcctaccccaaagcaaatgcatgtgcacgcatccatagggccatgtgtactgctcagcattaagccttgaaataaactgtgaaacttttttgcccccttgcacacttttggttttccctgtagtaaaaatttagaactcacagagttctaaaatttcatgtcttgcttttttcttctgcttattctgtgtctttatcactaactcaactccacaccctcagccagttgtccacatctgctctctacactcattcatgccaggtgtcagatcagctgcatcttcttggagatgtggctcccagagcctccaggtgtgttccaatgtgaactgctgccctcataccacagcccattgtcattctggaggctctcttcacctggtttttgtgttggaacctgtttcctgatcttgtgctttctctttcttgattttctctgttgttttgttagagtgtttcctgtgacaccacggttctgcatcctgggtgtgccatgcaattacccagagagccttaaaatgctggtgctcaggccctaagctcaggggatctaggagactattatttttctttctttttattattattattatttttgagacggagtctctcactgtcacccaggctggagtgcaatggtgtgatcttggcccaccacaacctctgcctcccgggtcaagcgattcttctgcctcagcctcccaagtagctaggataattaggagattatgcccagataattttttgtatttttagtagagacagggtgtcactatgttggccaggctggtcacaaactcctgacgtcgtgatccgcctgcttcggcctcccaaagtgctgggattacaggcatgagccaccgtacccggcctctttttattattttttgtattttttgtagagatgaagtctcactatattgcccaggctggtctcaaattcctagtctcaagcagtcttcctgcctcggcctcccagtgttgggatgatcgtcatgagccactgcacctggcccaagactattattattattattattatcattattattattattattgagacggagtctcgctctgtcacccaggctggagtgcagtggtacagtctccactcactgcaacctctgccttccgggttcaagtgattctcctgcctcagtctcccgagtagctgggattacaggcgtgcaccaccatgcccggctaatatttgtatttttagtggagacaaggttttgccatgtttgccaggctggtctggaacccctgacctcaagtgatccacctgccttggcctcccaaagtgctggaattacaggcatgagccaccacacccagccccaagactattatttttaaagtgtcacacaatggttttgtttttgggtgtctttttttttttttgagatggggtctcactatgtctccaggctgatctcaaactccaggcctcaagcagttctcccacctcagtcacttgagtatctgggattacaggtgcaagccaccacacctggcttgcatgatggtgttgatgtgcaggcaatatttcaaaccactgctcatcaggtagtctcctactgggatacatgggaggtaaatgttctgaaacctgggttgtttgaaaatgtctttattctcactccccacactggttcatagttaggctggatatgagattctgggttgtaaattatttttcttcagtattttgaatgcaattttcactgtgttccagtttccaatattgctgttgagaggttcaaagccattccaattactgattttgtatgagtgtgtttgtcttggttttcctctctggaagcacgtagaaaccatctttgttcccagagttctaaaatttcatatgacatgttttgatgtaagtgtattttcatcatattgcaggtaactggtggtgcttttaatctggaaattgaagtccttaacttctggaatatgttttttgtttgttgttgagacaaggtctcgctcttttgctcaggctggagtccagtggcgcaatcatagctcactgaagcctcaacctcctgggctcacgggacccttccacctcagccatctgaggagctgggactacaggtgtacatcaccacacctggctaattttttaatttttttgtggagattgagatcttgccatgttgctcaggctggtctcgaactcctgagctcaagtgatcctcctgcctcaacctcccaaaatactgggattacaggcatgagccaccatgcccggcctgattttttttcattgatgattttctccatctgttctctctttctgaaatttgtactacttggatgttacatttgcaagactggtcgtctatttttcttttctctttccaattttcatctctctgtttgctcttttagggaaatttctttaactttaccctctaacgtttccattaaatttattttcatttttactgttacgtttttaatttccaagagttcctttttgttttctgaatgctcacgcttcctctcccatctccccctcatttgtttttttcatagcttcctggtcttgtttcttgggtgcagtaatttcttttatcaacctggaaatcttagtacaaatgtttgagtggttctcttctccttacacagtcttagtttttgtccaggttgacatttttttgtttgcccacttcaacctctttttttttttttttttttgagatagggttttgctgtgcacccaggctgaagtgtagtggcataatcatggctcactgcagcctcaaacttctgggctcaagcaatcctcctacctcagcctcctgaatagctgggactacaggcatgcgccaccacacctggctaattttttgtagggatgaggtctcactacgttgcacaggctggactcaaactcctgggctccaaggatcctcccacctcagcctcccaaagtgctggggttacaggcgtgcgccactgtacctggccctcttttggaatacagtgtttcttgggtaaatcttggatgtctgctcacttaagaggagaaagactgagaaactgactggaagctggggtgtatgaatactcctttcttacccattttgtcataggatcttctggttggctatttttatgggagaacccctgctgtcagcagctttgggtcttttcctctcgggctggcttattttcctgagaaacttttccagtctgctgctgagagggtaaagcaggctggggactcagcactcaaaatatggtcactcggctgggtacagtggctcacgcctgtaatcccagcactttgggaggctgaggcaggtggatcacgaggtcaggagtttaagaccagcctggccaacatagtgaaaccccgtctctactaaaaatacaaaaaaaattagccaggcttggtggtgggcacctgtaatcccagcccacttgggaggctgaggcaaggagaatcgcttgaacctgggaggtggaggttgcagcaagccgagattgcaccactgcactccagcccaagcgacagtgcgagactccgtctcaaaaaaaaaaaagtcactcgaatcccccgcccctgcctttcccaacactatcccctgtgtgacagtgcttgatggccccaggacaaagaccggctccagagaataaaatcccggcactgacagccacttcatcaccaaggcctctgaatgctgctttctaagagcccacaaatgtggccacttctcccatgtccaccatcactcagtccaagttgccatcatctctccccagaccgtggacacagctgccaacgtcttgccctcccatcatctctgcacccagggaccagggtggctctttcatgccacttccctgctgaaacccctccatgatttcccatgccctcaggacatgggccagctcctccgctgaggtctggcttctcccttcatcccagcctccttctgcagccccttcctcaccctcttgcacccctgtcacatctggtgcctcatccgactttctggccttaagacacagccccattagctccttctcctgaaagtctctgcagatcctagcacttctcacccattctaagagtgcccgctctccctggggatcctgaagggaaagtctgcacctccacatccacaccctgagcttgagtgcagcacccggcacccaagaggtgctgagctgtactgtgccacagagatcattgccactttcaactctgacgagctctgttctgggagctggctgcctggggaagggctctctgaccactgccactgaccccatggagtcagccactgggtctgtgaactggggctctgtcagcatgagtgtccccccgctcctgggaccaccacagtacatgctggtgaagggccaggatggaagggctacctatcaggtgtgcgggatgctgagtgtgacccccaaccaccttgcatgaccttgatgcggtggccatcccagagaggacactgctccacccagctgcttacctttccttaggacaactgtttgaaagtccctttctagaatggtcctaatgggcatggccagggagctggtccctcatgtaagtagcaactgggcaggctgccagggcagctggaatggggcagtggagctgtgttcacagaacgcttgtcaggagccaggcacctggtgcttctctgcccacttaaaggagggcattacgatcgccattgtatagatggggaaagagaagctccctaagtgcctcactcagggtcacacagccagaaagtgtgagggattcgaacccaggattctccagccccagctgcacgttggtagcaggagaaacagcgagagctttctggctctgtggctaacctcaccaaagggaatccatgcagacagctgcagtgcacacggtgttttccccacactctggctgttagttttgttggctaaaacaatcatcaccctggagctgcttttcacagttctagattgtggtgggtttctcagcctctctgctggctcggggaggcttcgggaaggtggtggagcaggtgccctctttgcaggtagggattgtgaaacatttgctctggagcccagggatgaataatgcggaaggctctcttctcaggataatggattccagaatcccagcactgctccggcaggaggcgaggaccggtggctctgcactggcaccccctgttgacctgggtgtggctcagcagccttctcctctggcttgttttccagtaactggtgcccctacccaatgtccaagctggtcaccttactagctctttgcaaaacagagaaattcctcatccactcgcagcagccgtgtccgcagggagctccagactgccagaaagtcaaagtcatgtgagtaggggagggtgggccatttgcccaggcctggagcgggccctccctggaatcactgagccagcccttctcctcttccaggtaccgcatggcccacaagccagtgtaccaggtcaagcagaaggtgctgacctctttggcctggaggtgctgccctggctacacgggccccaactgcgagcaccacggtagggctccctgcggcccccttccccccttgacctctgatccccaaggtcaagcagctcctctgaccactggggtcaataactaatgctttcttctgcagattccatggcaatccctgagcctgcagatcctggtgacagccaccaggaacctcaggatggaccagtcagcttcaaacctggtgtgttgctttccggaaggggaaggcaggcaggctggtggggcccatgtagccagctggccctttttcctgtgatacagcagtgccatttcagggaaaccttgcctccagaatcagcaaggcctgctctgtggcctgtaccacctcccaccttgaaggccaggctcacagggcccccagcggcctactggccaagcacacacacccttttccttcaccccatcttctgggaaggactggttcatctggcactttccttgccccgctgaaccacacaagcccttgtgcctggaaaaagcattctcaccctttcccacagccctaaccagagccaggaagtcatgctgtccttggtcttggagtcagcacaggaaacccaccaagagacaccatttgcagcagggccctttaaggctgggcccaagattgagaaagtaaatgagtttcattatgtggtgaagtatttattgacaagggctgccaagaatgaagttgtgaggccatgtgcatgtgctgaggaggggagtgtaccatgattgattagtcatgtctgctgtaggtgtaggaggcagggtgagggctcacttgctatgcatttgccctccaggggtttaaggcttctaagctcctgctcagaggacatcagcagctaacttccctgctctcagccttcaactctccttctctgaaccttgtgatcttcccaggcctggtgagttagcccttgacatttatgtctgctgtgtatttaggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacggtgagtggcaggctctaggggctgaggaagagcctggtcacattgaggggaggaggggaggaccccgctggtcccagcctgggaggagtgtctgctcctgcagggcttgtgtcacaccacatgtctgttgcagagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttcacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggtgagttcctgggctggggagactggacgagcctaggaggccagggccggctgccggcagctcttctgcctccaagagggccaggaagaaagagaacaggatggccatccgtcacccctactaggtccaccttccccttggcccacctgcttctcaggggtgtgggtctctcaagctacctggcttatggggagacagaagtcacaagaaccacctgctagtgccagagcccgtgagcggcatagcctggaggccacaggcacaatagtgccgcctactgctcctgctacagagagggcatcgcctcctgccctgccagggcagccttcaagtccccccatctcatctcttcacctcacccccttcattcccatgtgcgtttaagccactgtatctaggaagaatgtggatagggactgtggccacttgcagccccacttagttctgtttcattttccatgattttagttttttttttgttttttttttctttttcttttctttttttttttttttttaagatgggtctcactttgtcgtccaggcttgagtacagtggtgggatcatggctcactgcagcctagacctctccaggctcagctgatcctcccacttcagcctccagagtagctaggacttacaggcatgtgtcaccatgcctagctaatttttgtactttttgtagagacagggtcttgctatggtgcccaggctggtctcaaattcctgggatcaagtaatctgcccacctcagcctcctaaagtgttaggattacaggtgtgagccatgtgcccagccttgatttcagtttcttgcatcaaccacgatcagaaaataggtgagtacagtacaataagattttgagagagggagacaccacattcatataacttttattacagtatactgttataattgctttatattttattattattgtcaatctcttactgtgcctaatttacaagttaaactttggcataggtatgtacatagaggaaaataaatagtatatatagggtttggtactgtctgagatttcaggcacctgctaaggtcttggaacacacctcagtggactgtacagggaaagccgtgggccctgaaaggagctcattccctctgcaaatacagttaacctgtctcatcgctctgtgctagtccccttcctgggctttaccacaatggcccatcccaacaggtcaatgacacactcatcagcacttccatcttacctgaaactgaggcgcaaacacaagtttcctgcttgcacagctagtgagcagcagaggagcgctgtctttagggtgccggttcttcacctccagaaggccctccatggctggtccctgcagggccctgggcctgggagctggctttgaggctgaaggcatgtgcaaccaagcttcccatcccctccctgagtgtggtcccgggagggggacaactaggctctgtgtctcaagtgactctctctgccagaggctggccttggagctgtggcctctccccacccagacacagggctaagtacaaggccaccatcttggccatgtgcagcctggcgtgtggcaagtccaaggccttgttgaaggtcccgtcccaggcagcccctgccccagctgaccctccctatggcccaagaggcaatgtggagcagtgggaagcacccaggctctggcatcacttgtctgtttcttcctcagtaaaatggcagaatccctacccatgtcaaagttttgttatgaagactgctgcgtttaccaaatacctagcacgaggcttacctcatgtaggaacgcagtcaacgttttcccatttccccagcattttcagggttcaggttgtgtccaccgacactgacacttctctcttgtttcctctcgtgcgtggtgcaaggcttcaatatgctgatgactttcagaatttgccccacggtttggaaatgtgtttaccacgacgatatttatttcaaaaaaatgttgttcttaaaaacaaatttccaggccgggcgcagtggctcatgcctataatcccagcagtttgggaggccgaggcgggtggatcacttgaggtcaggagttcaagaccagcctggccaacatggtgaaaccccatctctactaaaaatacaaaattagccgggtgtggtggcgggcgcctaatcccagctactcgggaggctgagacaggagaatcacttgaacccgggaggcagaggctgcagtgagccgagattgcgccactgcactccagcctgggcaagaagagcgaaactgtcaaaaaaaaaaaaaaaattagcccggtgtggtggcaggcacctgtaatcccaactacctggaaggctgaggcaggagaatcgcttgaacctgggaggcagaggttgctgtgagccaagatagctccattgcactccagcctgggcggcagagtaggactctgtctcaaacacacacacacacacacacacacacaaacacacacacacacacacacacacacacacaccccaaatttccctttatttgtttgtaggaaggctgtagggcttgaatgtgtgccctgcagggaagcacactctgagtttgcacagcccttcccgcatcttagggcctgtcaggcgcaaggctgggttggggtgggggtctctctctgcggcggaactccctgcgcaggcgcccggacggaacggccggaacgagggcctagcaccggtagagggcgctgcgggccggccttccttcggctaggcaagagaaccacctgcagggtgttaggggaattgcagaggcagccgccggcctctgacttgggcacaatcttttttttttttttttttttttttttttttttgagacggagtctcgccctttcgctcagggtggagtgcaatggcacgatctcggctcactgcaacctccgccttccgggttcaaacgattctcctgcctcagcctcccgagtagctaggattacaggcgcctgccaccatgcccagctaatttttgtagttttagtagagacgggatttcaccatgttggccaggctggtctctatctcctgacctcgtgatccgcccacctcggccttccaaagtgctgggattacaggcgtgagccattgcgcccggcatttttttttttttttttttttgacggagtttcactctcgttgcccaggctggagtgcaacggcgtgatctcggctcacggcaacctccgcctcccgggtgcaagcgattctcatgcctcagcctcccaagtagctgggattacaggtatgccccaccacgcctggctaattttgtatttttagtagagatgggatttctccatgttggtcacgctggtctcgaattcccgacttcaggtgatccgcccgccttggcctcccaaagtgctgggattacaggcgtgagccactgcgcccggctgatttgacacaatctgaacacaaatgagaaagctattctcagctgtctaattctcagaaaatcttccagaactagagaaaagcaacatttttttattcacaaaggcttgctggattgggagtcaaagagctgaggcttgagttccgggacccaagtcagtaattgctcagcaaactgctcctctgaaggctttggttttatcacctaagaaatggggaccttgttttaaacccctacagagggagcaagttgaggaaccccatggtggacatgacctcgttggtgccaaggccagtgtcacagccaggacccaagtaggacttacctttcctgtgccatctcatgaccctgtccccagctgcccaaccatgctgtccaggcagcaggactggcttcttcctggctgtttgtacaccctccacacatggcagcttcctctgcttctgtgcccgtgcatgggcctggcaccagtgttctgtcagtgttcctgtcctaaggctggccaaagtggtccctgcagagaaccagaagtctagagattcaaggtctgttcccaggaggcttggtaatttactagttgtgtggtctggagcaataagctttttctttctgggcctcaatttacccatatgtaagatgaccagcttggccagtaacagtggctcacacctgtaatcccagcactttgcggggttgaggtgggaggaccgcttgagctcaggagtttgagaccagcctgggcaacagagcaagactctgtctctacaaaaaataaaaaattagccaggcatgatggcgtatgcctgtagacccagctactcaggtggctgaggtgggaggattgcttgagcccaggaagttgaggctgcagtgagccatgatcgccaatgcactccagtctgggcaacaagagaccctttatcaactaaaaaaaagaagaccagcttgaaggggcttctcttccctggctccacctgctctttccttctttctccaaggttctgtcttcaacatccaggaggatccagccttcatggctctgcagataccttcccagtgttagcattattattaccttgaggatggatattttctccctctcccctgagtatctcaagattcctagcaagtggtggtcgtctgggagtcagagacccgtgttcctgtcccagcctgccatttacaaaccatgtagccttgggcagccggtgaaggattcaacctgttttgtcaatcagggatactgtctctcaaggaagttggaaggaaaagggatcaaacgagaaagtgctttgtggctgggcatggtggctcacctgcaagcccaacattttgggaagctgaggctggaggatcacttgagcccaggagctccagatcagcctgggcaacatagtaagactccatctctacgttaaaaaaaaaaaagggctgcagtgagtcatgaccactgctgcactccagcctgggagacagagtgagtccctgtctaaaaaaaaaatgaaagtattttgttaaaatgtacaccagctcagacaacagacttgcattttccttcctctctattagtgaaaaacagaattggccatctagcttttctcctgcaataacactgctgttgggaatatctaggttatctagaaatagtgacctatttccattgctaataaggtgaggacggtaggtctcagggtttaatttcccacccaatggtgtaagggatgaatcactaagcactgtcctgttatgtttcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaa

SEQ ID NO: 698 - DNA, 840080 bp, Homo sapiens
gcggcgtagagaagctcgcagccctccggagcctcagcgatctcctggctcgcttttcccgcagccgccgagcagcgcaggcccggcgactccgggtgcagctggccctgtgcggtgacatcgccgtccggcgccaggctcgaagccgcctggccgcgcccgcggggtcgcaggccgctggtcccgcccggccgcgctcacaaactactcgcggctcgtgacccgggacaaacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagccccgcgcgcagccggcgcgggctcggtcatcggcgcgccgccgcccggggctgggcttggggctgcctgtggagaggcggcgggcggaacgcgcgcggccacggccacggccaccgccacggccacggccggcagctcgggtcccgggtcccgggcaggggaaggggagaggcggcgagctcagcaaccggaaccgagggaagattttggctccgcgggctcgccctccgctccctctgccagcggcgccagacgccgagtggggccagggacaggggaggaggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctgcctgtgagccgggcgctgggcgaggggccgtggggctggcaggcacccagtcctcgggcgggcggagcggacggaccccgagggcgagctccccagccgggactgccagctcggccgccgtccttccgcggcctgggctagtgctcaaggttgggcggcttgcactcttgagtccctggccggctgcaaaaggaacagcagaaaactttgcttgaagttcccagttgcagccgccgggccgcctggcgtaggcgctgcgcggtccccgccgaccccgagcagcggccgggcccaggccgctggtgttcggctgcgcccgcagcgatcgccgggaactggcggccgctccggcggcggcgatctcccggtgccctgccctccctgtcgccccctgcccggcgcggctggcgaccccgggaggtccccgcggtcgtgcagcgtctgcggagaggctggggggagttcctcgccggtcccagcggtagggcttggcggccgcggagggaagcgggcaggtccccaggccctggccacggccctgcgccccgctgggctccccctccccaccctcgtccccctagcggagcgccgcggccagctgcaacttgttcatccagcccggctgcccgggggtcccaggtgggaaggagaggcactggcggtgtgcgagcaagcgtgtgagtgtgtgcgcgtgtgtgcctgcacgcgcgcgcgggggcgttctaagcccagaggaacccctcacggagaggatctgtggatcggagtcgggggtccggcgtgggggcgaacccggcacgctgtcacaggggtttacaaccaggatgacctttattacctgggtgacacaggtggatagacggcaaatgctggcccatttgcacaccttctttctagtgtttattagattagtttcattaaggtccacatgcagtgggggcggtgggctttctttttctttaataaaaaagcctgctctttggtcttaaacttggtttttgcaaaataggtctctgcgtttgggaacaagtgagttgaatgagtaagttgggctttttaagaatttaatgaagaggactttcataaacagtaaagagcatattttaagcagtaaaaacctttggtcctccggtgcgtggaaacctttttattttcttggggtccaggaccattggctgctggagctctggactcacaggcacattagttgtgtcttgtgtgttgctgatctgcaggacccttgatcacagttggcctcagagaaggagtggaacgtgtaggttttgaaacccaaagcatcaacttcaatacagaaatatcctttctccaagttttgtgtttccctaactgcctggtaattgcacgtgctccagaggatttaacacaatgatgcactgtcgtctgattataaaactgatgcagaatttggtctgtgttcttattagtgaataatagagtagaatttgagagccttgtaactcattagtattagaagccaagtatgagagccctagtgatggttttctctttattaacatccatgactcccttcttgggatttgtttaaagttaagctgtgtcaaatatcatttggatggatttttaaattgtgtgcaagggagtggaaacaaatatttatattgcttatttaaaccatgggttcctcatcaccaaaaaggatttcagcctcagttgtactgacccatgtccttgttaaggctgatgtaaatgatcagtcaagccaaaatagacttctactaaaatttagcctgatttttcatttggaagaaatatatctatttgtttgagttaatcataccattaagtgaaatgtgttttcttttctatctagaaagccagagttatcctggcatgctagtgggtaaagggcagcatccaagccatgcctcagaaacgttgaactttaaaaaatgtaaaattggattagctgggtgtggtggcgtgtgactgtagtcccagctgctctagaggcagaggcaggaggatagcttgagcccaggagtttgaggttgcagtgagctatgattgcaccactgcaccccagcctgggtgacagagtgagaatccgtctcaaaaaaaaagtgaaaagtgaagatggcaaatttcatatgtgcaaggatcagatatgtttcacttcattatttatttttctctccatattgcgtttaggtagtacaggtgtgaatcagggttttgttttttgtttttgtatgttgaggaagttaattctgaatgctaggagtggcattgacacatttcttttttatgtttcttccagaaattgtagtaattggctgcttttcacttgacatgggaataaattttagagccagaagagctagattgtaagctccctgagggcaaagccaattttcgttttcttctgactttctcacaaaacatttctcatagatccttagatgtcacaggcattattactatttgttgaataaatcactaatgagaatcttgatcatttgcacatattcaaattgtgtgtgaatggaccaatatataataaaatggagggagagaagtgattgttaaaagttagacttggcttgccttttccacactgggttctctttaggccaatggactaatcatgagggtttataaatataatcagtcaagggtttttgtataactcagacattatctacacaaggcactctgccctttgctttctgcagtgctctcctgtcctcttttggaatgggtttggaattgttaagattgttaattaaccatttctggaggtggactacatgtgatttggataccagacatcagaaatagaatgctaaacttactggaaaagtattaggatttgggcctgtgatgacattgcttacttataatgatggatttcattacaaaattgtgggtttttttttttttttggagatagagtcttgctctgtcgccaggctggagtacagtggcacgatcttggctcactgcaacctccacctcccgggttcgagcgattctcctgcctcagcctcccgagtagctggaactacaggtgtgcaccaccaccaccgccagctaatttttgtatttttagtagagacgggttttcaccatgttggccaggatggtctcaatctcttgaccttgtgatctgcctgccttggcctcccaaagtgctgggattacagacatgagccaccgtgcccaggctgaaaaattgttttttatcattaccgtttctaatttgttaggcaaaataatggaggttcactttatatcttctaggtctttagtgttcactaaaaataactggtaagatggtatataagtaagacatgagaaagaaagttaaattattttacctttgttggaaattcccttttgcatggtgagaaaccaacgagttggcaagttgttcctctttgacccaatttcttaaaagccaagttgcaacatatattatataatacaatgaagtgtttagttctaccttataatggttttgatgtgttaagttctgctaagcaagctttggtttgcagaaatagaaatatagacttagctctttgtttcagctacagtggtatttgaaatatattaaatgttaacataaccttgtgaatttgggactcgtggagaaattaattttttaaaatattttaaggatgtttgtgggaaaacagctgaaatctgaataaagcctgtaatttagttagtagtgtggtaccaatgttaatttcttagctttggtaattctgctctgtgaatgtaagatgttaacattagggggaagctgggtgaagggtgtacttgcacagtttgtattgtttttgcaagtcttctataaatctgaaattttttcaaaatacagaattttaaagcaccctttgcaaagagtggtaatatgtttgtttagcagttaagtttattttttctttttcagataactatagtcatagcattttacattttcaaggtgctttcgctagattgaaaattgataatgaagaaaatacttcaaatttaaatcagtgagcatgaaagaaatatgctaagaaattactataacattcttagtgttctgtatatgtaaagaagaattgcttgagcataataaattgttccgatctagaaaattataggttttagtctctcatgttttcaaagggttatttttacagattttaagaaaagaatctattgacatgtagtgatatatggataagtgtgtatataattttggtaattcaaaatgaattttctttaatgaacaagtaatttgaattatgtcttcagattatataaattctttataaatgaagcatagcctagcctttagatttggtaaaagttggtttcagaatttaagcaattctgtgacaattctagaaaagtcaatacctttatttaaatttttcataattctctaaggattgtaatatattctaggaattgtgaggctgtatacagtagaggaactatgtattagattaaatattgttttctttcaatttttgttttagatttcattaagtttctagaatgagcatgtattatctaaatatcccaaggcttagttttcatttagggaatcaggcattttaatgagttttatgcttttcaacagtgaaacatttttcttaggggttatgtccaccatgcattttactttagttctgagattcttctctttgaaaaccaactttcctatagtttcactttttagtgtgcttactatctttatgaatataacatgcatgttaataggcttattttataagcgagggaaggtttaattattaatgtctttccaactcacaaacattctaaaaaggtacaaaataatgtaaatcttgcattataagaggatgttgcttttttgcttcctaaaataccgcggtggttttcagtttagtcatcagaaagcctgagttgacactgtagctctgaaaaacccagcagagaaaaataagttgggctgccttgggtggagaggaggaaagatttagtcaccaagcttcctagtctgtagtgcccccatcattggtgaggaggctggcaaggccagggcataattaagggtctgggagtatgtgagagaaaaagacaaaaacaggatgagaagagaagtgttgtgtactcaggtgtgggatgtgacaagctctagagatcttagcaagggagggtcactccccttgtgccctcttagctatgaaggagaaacacatggaaagttgaaggagggccatgaagagtggcagttgtgcaggtagatcacagtgacatcctgcctcagtgacgttaggtggctctggggagggcctgggaaactgcaccagtgttgatggtgagctaggttttaatctgtgcttctcaaaacctgctgtccacggggagcatctggaggcctcctttcaaaggctgcttcctggggcccagctgtggtgattctgatgtccacgacagaggtcccccagcatccctgggtggtcagggtttgtagccacagttgaagaaacgttgtcctgaaagaggaggtttttgttttgttttgttttgttttgttttgttttttttgagacaaagtctcgctcttgtcccccaggctagagtgcaactgagtgatattggctcactacaacctctgcctcccgggttcaagcgattctcctgcctcagcctcccgagtggctggaattacaggtgcctgccaccacgcctggctaatttttgtatttttagtagagacggggtttcaccatgttggccatggctggtcttgaactcctgacctcaggtgatcctcctgcttccacctcccaaagtgctgggattacaggcatgagccaccacgcctggccctgaaagaggagtttttaaagtgttgtccttgagccagcagcatcagcattacattgaaagttgttagacttgcaaccctctgaccctgaatccgcaaccctggggatgaggcccggcaatctgtgttagaacaagccccccatgggattctgatgtgacctgagattggagaacccttgttctaaaagaactgagatcttctgcctgccctatcagcctcccttgacaagagctgaaagagaactgggggtaaaaatatcacatccattcattcactgcttagcctcttgattaatacggccggtattaccaacatggtgatgtgatcgtgttgtctctggccagacactggggaagagactaaatccagccagttgtaaaactcaaatgaataaaaaagtttcctatgtttttacttaccacgatgtaacaattaaattttgttgtaatggttagccattggaaatttccctgggttgatattttgtataggagatatttgttggcttgttataataagcatgcagcccagtgtgcttattagaatatttaatagtgcttattaataattcttattgaaatatttaattcaaataaatatttattgagcacttacatttgtacggcccctttgtggatggtaatgggcaaggataaagcaggtatagttaccacactttgagaagttattcatttattaaaatttcaaaatctactaaaatggaaagaaacagggactttctcaggagagaactggaagttagtagatgtaagatttggaattgtaatgtggaattgtgaaactttgcctttggcaataaactcaaattccaaatagaaagaaaataaaggtttttcggccaggcgcggtggctcacgcctgtaatcccaatactttgggaggccgaggcaggtggatcacgaggtcaggagacggagaccatcctggctaacgtggtgaaaccccgtttctactaaaaatacaaaaaaattagccgggcgtgttggtgggcgcctgtagtcccagctactccggaagctgaggcaggagaatggcgtgaacccgggaggcggagcttgcagtgagccgagatcgcgccactgcactccagtctgggcgacagagcgagactccgtctcaaaaaacagaaaaaaataatgaagatttttcttggacatttatttaaagtactgacaatgtgtatcctaaaattgagcctaatttttctctgaaccctcaaagacaaccattgcatctctgtcatttaacactccaggtaaataaaaataatcatgatgtcttttaacagattgatcctgagcgctttgtagccggcctttctgagaaacagctgaagagtgcttccctgctgccggttgctcctgctgccatccgcagctgatcactaggtgtagctgcgtcccttaacccccctgcctgagccaagcaaggtccagccccatccatagatggcttcctggacagctaaagaaaggcacgagagcggactttcatccgcttacgtgtgcatctctaagtctttattgtaaaattgagttctttagtgggagttgtagttccactgctacttgtagtgtagtttgttgaaattcagcactgatccagagacaactttagattcacctgctacagtcttactcaattttttcttttttctgctgtgtcatatgttgctgctaatctacatgtagtggtaaaactggaagaagtagtatatatttgccaactaagtaaagggttcatgttaacctttggggccttcttgtagtagaccagaaaaagcagtggtgtggatggctctgtgtaggtgtgtaacatctttaggacatggcttgtctgtacttttcttacgtctgcaaggagtgacttctacagcactgagggtttaggtatgtaattcaagaagtcatgaaaatctgcctggaaatctgattcagccatttttcctgcttaaaactcagaagactaatgagtcatcaaaaactttatatgaaatgcaagtgttgggctttgggttagaagtcagggcagggtggagaatctgattgaagatggctgtgtggcttcctttcgaaactggggctagcaggggttggaaatgaccttgcaagctaaaagagcaaggattgcaggacatacaggagagatgaatgagaggagaggagtcagagacttgtcaaaactgataaggttttagcatctccctctgaagaaaaggccactgtttaacagaatgatttatttcaacatgcaccagccaaagcagaagcaaagcatttactttttatgggctgcaaagcataaaagcttatagagcatcagtttttcagatgggtgaatattcattttaatctctctttctattcaatatgcagaaagcagatttattgcatacaatgagaagagtgcatattagtgtgggttactctgggagtctgaggccccattacttttccctggcttctagctatggaatcaaaatgggctcacaggtaacaggtaggctttgacagagggtgagaaggaattggaccacaccctttgtatagtctgtgtttttttgatttttttttctcaaggcgtcttgctctgtcatccaggctggagtgcagtggcaggatcactgatcatggctcaatgtagcttcgacttcctgggctcaagcagtcctcccacctcagcctcctgagcagctgggtccataggcacaagccaccatgcacggctaattaaagaaaaaaattgatagagatggggttttggtacattgcccaggctagtcttaaacttctgggctcaagtagtcttcagcctcccaaagtgctgggtttacagatgtcagccactctgcctggcccagcctgtttttgatggatactatttgttctctcttctctgtttgagtagcttgaggtactttacatcatgtaataagcacatgcttaaaatgaacttaaaatggactcagtgtgatgttccatctagatatacaattataaggtggtttaaagcattccttttaacatactcataatgtgtaaaaccagattacttaacaattttagcatgtagtagtcactcaataaatatttgttgaatgaatgaagaaacaatttaaagaagctcccttggagaagaaaaaaatcaaataacttatgcttaaggctgttttttttttcctacttcctatcaagtttgacttaggtatctccaataaccttaacaatagaaccaggctgtgtgtttagtgcctggtgccattagcaatttataggtgtatagagacacagttgctaaatttaaaggaaaaagtattaccttttgttaattaaatatataaaagtaagactgtagttttattgtgtataataaaaatgtataaatcagttattgctataaagtagcattttgatataatactgatcactaaaaaatgaaatttactatgcagtagatttatcatgactgtactctagggggatttgatttagtcactggtatattaaaggaaccatggtatcaccagaaagaagattccatgacagggaataatatatattatctctgctgccttttatttctgatatagaatgaaatgaattatacctacacagagctcagacagcatcatgataacatcaggctcatcttcattacagcaggcatgttctcgttcctttttcattcagtgtatcatactctcaagtgataaaacttaataaaaagaggctactttgacaacaacctcataaactgtgttttctacttcctcaacttctgaagtcttgaacaccaaatgtggtgtaaaatttccaccatgagttcaggtcattggctctcattggcattgtgttctgtgtgtgtgtgtgtgagggaggttctccctcgtctctctgtctgtcatcattttcatcccaaatgtgtgactttttaaagagcctctgcttttctttctaatcttgctcagtaggcaggggcccctgtgagacagctggttgagaatgcttggtatgtttggagtgcagcatgctttgtcagagagggacaggacacagtgggggtctgaggctgtgacatcagccatggggatccctgagctgttgaaagaagggcagtagtagcctctggttggatcaggtcttcctggcattgagttctccttctacctctaagtagccatgagaccttgggtgtgttatttcattttaaaataccctgcaggatgatgatgatgattatgatgatgatgatgataatgatgatttttagacagggtctcactcttgtcacccaggctgtagtgcaagtggcatgatcatagctcactgcagccttgaactcctgggctcgagcgatcctcccacctcagcctcctgagtagttgggagcataggtgcatcaccatgcctggctaattaatttttttttttttttttttttgagacggagtcttgctctgtcgcccaggctggagtacaatggcgtgatcttggctcactgcaagctccacctcccaggttcatgccattctcctgcctcagcctcccgagtagctggggctataggcgcccgccaccatgcccggctaattttttgtatttttagtagagatggggtttcactgtgttagccaggatggtctcgatctcctgacctcgtgatccgcccaccttggcctcccaaagtgctgggattacaggcgtgagccacagcgcctggccaattttttttttttttttaagagacagaggtcttgctttgttgccttggctggtctcaaaacacctgggttcaagtgatcctcccacctcagcctcccaaagtgctgggattacaggcgtgagctgctaatgcccagcctccttgcagagttattgcaaagactaaatcagagaaccaatgctgtgatgtcaggggcccctggggtgatagggcttcatgtgtaattagtggtcagaataagacgggtccatcagtctgttcccccatcctcatgcagattacagatttaagcataggaaccctgtgctttcataagtgaaaaagtgttgaatattggcaatttcacatgattcagactaacacatcccctttctgggtccaaggctttgatagttgtggtgctgggaggttgtataagtgacatagaagtatgtgtatgtggttatgtatgtctagattttataaacagggccaacattatgtttgaaaagaaaaaagccccctgaaattagcaaaataatcatgttaaaattggcatcatgaaaagccagcactgctcggtgccatggaaggccctgcatcctggatacctgcattacagtcacctgaagcacttgttaaaaatgcagattcctggccccaccagacctacagagtcagaaactggaaagaaatacctcatatgattttgatcttctttaaagttgaagagctactggaaggaaagtaacagtgactcagagaccctgcctttgtattgaatttatcacatctactatgaggagtgttaagaaagcatctgaggattactattaatacatgaatttttacatagcaaactataattggccagagagcatttcttttataaagcagaggcttttcagcattagaagagaaaatgagttatgaaacaattacattatagaaacttatctgcttcgtatatatcttgcaacttggtgacctctagtaaatgtggcatcactctggaatgtttagaatatagtgaaagaataaagacattttggagtaatcagaacacagatgattttagatctctaaatttgccaatttgagctgcattttgagatgactcattcagggaagatcatgagacaagatgatctgcaaagtattttgggaagattattttccagcacttagtcctttacttcatgttcattgaaacatgtgaacgttgtggaatgatttgtcttaggtgccccataaggatggaccaaaagcttggtgctttgattgcagtagttttaaaaagtctcacaaacctcaaaatgggcatattggtctgttaaagcacttgaaatttccactagctcatcattttggccaaggaagaaaggtctttgtcaaaatgtcgtctctaggagaggtggctcattaagttatcttaaatatgacatctctaactagctgtcacctcgataagttgacatctttagattctcccttgtaaaatgacatttgattcaaggatctctccaatatcttaaagagtatgaggattgtcatcagcttatgtcttagttcagattagtttgtcagatggcacagcaaaagagaatgagacttggatcattgggtcatttttgataggtgagcatgggagacatgtctagagcactgggtcccatctgagagagtgcctgatacagcatgaggttgcttgctaacaagaagtgggtgttgaagggctgtctgcaagattttagatgctttgaacatttgccataggcttcatctgctaagctatgcacttagcataagcgaagttcactctttctctctgtacttgagaatgtagctaccattcacaggtgacgccaaaggctcttcagcaactagactgttaaggcctgtggctttcttcttaaatattgataatatacgtaagccttatttcaggggcttagcattgatagtcataagtgataaccatatattgagcactaagtatgtgctaaatagtgtgctgagagggtatgatattctcaaacttattgccccccatttacaaataaaagcttggctgagagaatcaacggagactttgggaggtaaagtcgtctccactcccaacccaaccatgtcatccgaacgtggggtacatgtaccatattatgtctccctccccatacatacacagagtagtgttttcctgatttatgctttactttgatgccatcctcctgtattgaagtgtgctctaagaaaaagcatttcaaatgtagtgttgtggctgctaggaagatattaagtgatgttgtattatgtcatataaaatccgtatgatgaccttctggagagatttctttccggttcagggaaaggtgtgattctcctgtgcagtcagattcttctcgtggacacagtgagcaatataacccatcaactttcttttttctgtcggctgttagaaagccagattcaaatgcatgttttgtagtagctggaacttttatattgaactgaaaacctcagtcaaagctggcctgcatcaaacagggaattttttggctcttgtaacaggtaacagagaaggccaaaggtgggcacgggattccaagtcttccttgctaagcatcttttctctctatgtgatgtttctaaggagttacaggctaaatccctctggctccaagcctagtggaaagagaaattctcttccctcatggtacaactcactcctgtgattgggctccaagaaaaaaataaaaataaataggttctgttaccagttgaagagtagatagtacctggacgaaaagcagcaaactgccagagcattcatctatgcagtcgatgcttgtttctgggtctttttgctggcctgattcttagtcacttctcacatcattttaatttattttgctgtattttatgtatcattataaatgcattaaacctttttgggtggtggcagaaagtaaattagtttcaaatctcatcatttgcatcagtgctccaaatgtaccttttgtgtgtgcatgtttcatttactttttttttttttttttgagacaaggtcttgctctgtcaccccagctggagtgcagtggtacgattatagttcattgcagccttgacatctcaggctcaagtgatccacctcagcctccagagtagctgggactcccaagcagcatgcggcactattcctggctacttcacaaaaattttttttgaagagatgacttctcgttatgttgcccagactagtctcaagctcctcgcctcaagccatcctcctgcctcagcctcccaaagtgttggggttacaggcatgggacaccccacctggcataaaatttatttttttaaagcatcaaaatcttttggctaagcaaattttacataggtagaaatgtgtacaaatcttttggttaaataaagttttatgtgaacatatttttaaaaaggctatccaaattggcaaacaaggtatattggttagctattgctgtgtaacaaagcacctcaaaacttagtgacctaaaacaaccaccatttactaaaacttagtgacctaaaacaaccaccatttactattcttcatgttctatgggtgcctctgctgacctaagttgggctcggtatactttgtgtatatgtgtctctcctcggtgatcttggctgagctttcttgaaattttgctgctgtccttctgtaggctggtctaggatgtcctcagctgggacagttggactctcgtacatgtgatctctcattccaaagagagagcagaagtgaaccaagacttctgggctaatgcttgggaagagtacgttgtcacttccacctcttctcctggccaaagccagttacaaggccagcctagaatcaagggtggggaaatagtcctcactccttggtatgtgaggctgcagggtcacatggtaaagagtacggatacaaaaagaggtgggaaattgggacttacagaggggtctgctaggaccagcacatatgacctaaatgcctcagcttctcagaacagttgggaaatcatgggcagcatgggaaaaagaaaagtttagggttggaagaactgcgttcaagggccagcactgctgcttactgtcatctgaagggtgaagttgttaacttcggtgaactcacttccttatctgcaaatagggtcaatcggtggcattctcattcatgggtttacttcagagatcaaataatatgaatttttttcaatccctgtgtccctgggtgagttctgaaggttataatagcctcattaaacttgagttctcaaggtggctgtgctatttcctcactgtgagaatcacatagcttctctagtccttcatctgtgaaaagggtatgaattctacttccttggtcatcctgtgtaaaacacagtgcccagtccagaatagctgctgttattgttggagccctatgactacagaatagccttgagcaataaccttgccttgtatttttcctttatgtctacaaaccccaaagggtatggttttcctcagccccagtttttcttccatttgtgatcttgattcataaatttgctaccatttctcctggtttcctagaaataaggaaaaaggaaatgtgacaattgcatgccacctaggtgctaggtcctttacatatcatttatatacttctccaatgtgatcctattaggtgaagatgacagcactggtattttagggtttatggaactgaggcctcaacacatttcaggatgtcccatggacagtggctacagctgattttagatccaaaagtgctcatttccctgggcccaaagcctgttttcttgtccctgtctgttgggtccaaagcgcatgttataattttcaagtatggcttaagaatttggtacagtttctcattttgatgttaaaacaattgtaagattggcacagcccagaagtgcagtgtacttactgctattttacagccctctgaaatagtaaattaaaaggaaaaatacttagcttcttagtgacttgactgaaattaattggttagagaattacttatatttttcatgagcagaggagggcagaatgttgtcttttctctggttacaaatcccgtagatagaactgtgtttttgtaatttcttgtgttttccatccgaatatctgtttaacgtgaaaggtgcaaaatcctttgtaaatctctagtctgtatgcctgagtggtcttagggagaaaatgccagtaaggtaagcaataatttaagacctttgacttcaagtggaggtgggaggccctaggagactgatgttaatcaccttctttagaacaaatttcattgccttttgaggcttgacaaagtaaagaaaacatgtagatctgtatttgaaggatttaaaataatctagtgagtaaattcttactttatccgcaatgggaaagaactgtttggtatatagtactctacagtggttatgtactttgcttatttaaataacattcttgcagtgtcattagggagaattacatcaaaataaactgcattaacaaaagtagaataagtgagtatcgagaatattagcatttttcagagtgactttaaaaaattatgcaattatgaattcagacattttatcaaaattatttatgaagtaatggtcattgtcaacagatgcaagtttgtaagtaagtactgattttggaaagattcctgggcagatagagataaaatgaggtgtttgtcgtcgattgttagggatgagaaagacctcaggactgggctttaggagatctgagctctgatgtctggttctgctgccatgtagcatgtgatttgggtcaaatctcttcatggtaactcaaggcccagaaaagtaaaattgatactctaataatactttttggctacctaaaataaagacgaagatcagtgagaaattgtgattgtgttggcatttttttttttctcttgggatgctttctgaatacatattgtttattagattctgggtacccccaccccaagattattctctcatgcctcagttctataaacggaaactaaacacagtggtgagaagtcctccatggctggaagaatattcaagagttgtttgcaaggcatattcttttccaaatacaatgcttacctagcactgagagtgaaatgaggtagaataatatccccctgctggacgaggtatctgtgccttctgtgggtgagtacccatttataagtcctgtgctgaggccctgggagccaggcctgtgctgagcattgaagatataaaggtttccaagatgagggtttgtcgttaaggagctcacaggaaaactgaagggatatccaagcaagtcgagccctctatttctcaactgacatagacagcgtggaaattagggagggagagaggaggttgctccttccccaggctggccttggcaagggagcttgaggccaagtgtgcaggaggaaagatccgtgggaaaactgcagggaaagctctcctgtggtcacctaggtaactaggaggtttgcagttagacaatagacacgggagctgcccatgaggcctttaggcactattcaggttgatgcagagggaagggagagaataaacttttacatagtcttttgaaatggtttttaatttttttttctcttaaaacgggatgtcttctaagcaagtgagttttcgaaggctgtggttatcttagagtagatgcagaaaggagaacatctgggaaattgcagagaggattggaaattgcagagaggaacgaagtttgaatagtttttgtttttgaacttggtggcttggcagtcttcccttctgtcccatgcagatcatatttggtgctgtatttaagggatggatttgtgcgggattggaatttggccagaggttggaaaagtgttgagtattggggaagattcatgactcaaaatattggctactgttctattcccatgcctgatatcaaggtccaaggctttctctctttttttttcctcttcttcttttccctcatctatctccctctcatgtgatagatgggttttgaaaggaagtggtaaaccaaacaggtatctgtatcccacttaaccatggccactcctcttgtagtggcattgtcagtggccaggccgcttgtcatcgtatttctcctctgcagatgtggacaggacagagtgttcattcacatagagtgaattggtaagtgaaagcataaccagtaccatgcctggtgaggcactgggtggtgccttatctactttatatctaatcagcactgaagttcttgtgtgtaaatgtgtaataacaccacaaaagaacagctgatactcatagaatacttaaaatttctaggcattgtcttaagcgctttttaattatgtattatctgatttaatactcataacaacctaaattaccctcagtttacaggcctggaaatcaactgaagcaaagtggccaagatcaggcaaattgtaagggtagagctgagatttgaacattatcagcttgatcctttcagccactaacctacagtttgtagttctttgtctacatcagacaggcttacaatcacgctgcatacatcgtgggcttaacctgcttctgtttcaatatccgggatctttttgtatgcttctctgttggttggttagtcaggagtccactacgggtggatgaatggttcaggtattgtaagtgcactggcaatgaggtggcaggactaaggacctgggggaaagaacatcagtccttaggcacttaatcaggttgatatctttagtttggggggtgacttttagaacaaagtcaacagataggtttgcttattttggagattatattataatataaaccagccaaactgttagggttgggagcaaaaccagggctagatactgcgtgatgaaaccttgccagtgaaatggctttctgagcagggagctgatactgctcagttccaaggtctgtggggcattggcatctgacttaaaagcctgtatattcaataaaagaatgtttaataaaacagcaactcaaagcactataaacatttaaaaacagaatttttaaatactaggcattccttgcacattgataagttcacatctgaaatttgcatgacataaacatacagttgagaaggagagaacgtatgccctatggtaaatattgacattttaaaatacaacttgtacaaacatcttttaaaggtatccattgtaaagacccaagtaccaaagggattcgataccctccattgtccatttaaaaatatatgaacaaacttttatttaattgagagaaactttacctctttaatttttctccttaaactggtactcccattttctttccctatagaatcatatcctattataacacatttgtgcttgaaagtctgtgattacttatcaggcttctctgtaacaaaaatatgtaaaaagttgaaattttaattctatatttaattttataggagtataaacctttaagtgttagatttttatgtagttgaattatcactagtatgtaatcgaatcattgttaaaatttattggaagaattgtttcagaaatcaactgggctttcgatgaaatagttcatttatctgtgggtagatattacttactggttgagttaaactgggttaaacatcaattctatttccatttttcatttttataaataggtactgagaatctttgttcatataaatagatggataggattagccacttctttgaatttctttttcaagtttcatgccaagattcacatcattatctagtatcagtaattatttttaatgacctgttagctgacagtttgattaagctcattctcaaaattgttgaaagcaaaaattgggaaaccaagtagtctcaaaaggatttgttgcccagttatgcaccctctcatttgctgggaagtagaccaagaggctttgcaaagatttcctcaatgactgttaatttcacctgttgttttttaacttaaaagcatcttgtttaacccagaaatatgaagaagtcattgggaaaacaaaaataatattagtttcaatatactttagccaatacatgttttaaatatatttatataaataaatacacacccaaacccacatatgtatagttaaaccttagaggtgaagatttaggctaatcaataagtgaacaatatatgattccatcgcaaagcagttctcatcaagctgtcggtaaaatcagacgtgctttctatcagataaagtctaacatagtttttaatttcaagtaagttttaatttgcattttgaggaaaaaatttttaaatggtaaaaagaaatgatatgacagattactaaaagcagtttagtcaattttgaagcactgtagatttaatagaattaatcatattttgtaataagttataaaaccataatgaatctactttgtttcttattagtctataggaatgccatataatggacacctaaaattatgagctattataaagtgaggattctgattaaaaacatgctatttttctggtaaatgtgtatgactgtttatactgaactccggcatttgacttctgagaataattaaacagtaattatatatatactttcagaaataactacattaatttccaaagacttcagggtccaactttgtatttaattcttacatatttaatcaaatggaggtatgtgctactaaaaataaattgttatagcagctagcatatttttgttaagaggtagaaaatactaacttatgaggattgactatcattggaaaaatcactacataaatatttgataaaatagattttaatgatcttactttataatgcacaccgaatctaactaaatctcatttttgtgagtttttattgtataattagaaaaatttggaaagcattgcaattatacttaaaagaatcagtgtcaggaatcttcacacttttggttgtttgaagattcttttcttgacagctaatgtgatgtttgagtgtgatcataaatgctcacaaaaacaaattgttaatgattatatttggaaacaccagaagtaattttttgtgtttaatatttaccagtgtcatctttgccttaatgtcaccagttcttctgctctgaaatgtatcctttaaccgtggtcacttgaaggaagatgtgtggttgttaaattgtatatctaattttataacacctcacagggaggaaaaccctcaatctctagtacattgctttacttttgctctgttgcctaggctggagtgcaatggtgggatcaggactcactgcaacctcaacctactgggctccagtgatcctcctgcctcagcctcttgagtaggtgggaccacaggtgcataccaccatgcttggctgatttttaaattttggagagatggtatttcactgtgttctccaggctggtcttgagctcctggactccagtgatcttccagactcagcctcccaaagtatggggattacaggtgtgagctgctccatccatcccattgttttactcttaaatgaaatatggatttgacagtgaaagacaagaagccctccagcgaatgtctgttgtttgaaagcttccttgaaagcagcaggtcatgtggttcctttggtggctgcatgggagtgtttacaggtgaggggtatggctttcttttggcagctatgaggtctgttgagaaacagcaaatgggaaaggagaatctacctgatcctagcacagaaacgggtgccctttggcctgtcggtgttctgtacccctgagtttccatagccacggagtgtggctctgctgggactctcatactcatggtaggaatgctggagctgggccctatggcccaactttaatctttctagatagagacctgaacacttgaaagtgtgacatcctcccctgcaactcccccccaccaccctggccaagaggcagaaatcaagctggtgaattctggtttacaatatagtaactcaattctggtcttagtctgtgactttggcaaatactgtatgtctctctgctcctgaaatcaaaacaagtaattctgacataatataatgtagatattaagactttattagtcattaataattaaatgaacactaaacaaaggcatatactcctcatttaacctgaaagaatcttgcaaaaccattagtttcccatgctgtaagtaaatgttttggacagtgggtagtttccagctgaattcgcaccttattccaggaagcagaactttgagagaacaagaagcagatagagctgtagagatgcttaacacgtgctgcatgtcatcaagccacttattatgtgacattcacctttacacttgggtggtctttccaacttgtctctaatgggaagcaggtgggtgttgttatcttattacatggatctggaaacaatggttaaattgttggttcaggccctagcagaagcgagagcatgggtttcccctgagtgagttctacagagtggtggcaaagcttttgtaacgcactaccgaagaaaatgacgaagcacagggaatggatgcttatcccttttgctaatattaagtcaagtttctccttaatttttcttcaggaaatataacactggcatcttaatctttgtatataaggatatttataataagctttgaacgggactgaagaagatagtaaggtgtgggggattatctgaggtcaattcattgatcagtggctgttcccagggtgatgggtcatccaaaacagaggtctccagagtgtgcacacctggagggtggaaagatggtcacttggatacctaaagaaaatagtggaactttttccaaatatgataaatgtctcctgaggaaataagagtggatatatacaaagaatccctgaaggcgtattcattaaggcattatttggagaagtaaaaaaattgggaacaacctaaatatccgacaatagagagtggattaaatcctggtatattcatgtaatagaatgccatatagccactaagaatgatgacaagaatatttaagggtgtgagataatcacaagatagtgatgtgggacaaaaactagtgacaaaatcatttgtgtaggattatgctggtactacttaattatttaacatgtttattgaaaaatctttggaaatgtatggaatacaagctaaaatattaaccacagttaattatagatagtggatttattggtattttactttcagtttttctggatctaccaggctttcttgaacatgtttatgtatccatcttatgatgagagaaagttacttaaaatagctattatgtgaattttgaatccatgagtgtttaactcagtaaagaaggaactgtgatgattttgtgagtatgtatgaactggctggcaaagagtgactctcatttcctgcttctagaaaccaaaaagtgaaagaggaagatttccagatgacaaaacttatctccatttttctttgctttctatgtgtaaaacacaaaacatacaaaatgtaggtgtgaaaatgcatccccgtgtgttttttaaaacagattgtatccttagctagttgtcttctaatcctcatttggctgtcttttcctctggaattgtttctttgctgaagtgttaatggattggttaatttgtgagcaacactcctaattgtattaaatctctacaaccttattaagcatttgtgcaggattagatcagagagcttggagaagcagcttgccagtggtcagagggagggagtggggagagccaggctaacaagtgagtctgggccactaattgatatccctaagtcccctactccccaaaataaaacaacagactggaaaccccaccactacaagttcagaagtattctaaagcacatacaacagcttctgtgctgtatgtttaaatgccattaaagagagagaatatgcaagccaacttattctttttacttttatttgagggaaaataaatgataattaacataaagaattaacgaaaatctccagagtgctaggtttttaattctagttgcttgtgtttatatttagacaccaggctacaggtattctgtgcttaaagagagggaaacaatttcaggaaatataattgaaccgtgtttattttgaaaacgaaagataataaatagtctgaaatatactgacttttatgaaccgtgattgacagctgccttctgcatgtaagggaggtgaattcagcacctgaagatgctggctgtgcaattgagaagtggggaaggggagaatgcatgatgagagattaataccaacctcagggggctctccctatgtgtcccgttgcttattcctgcctgctgataattctgttcccagaaaactttgaagtttatttcccagcattatcacaacagtaatggaactcccagtaaaaattttagtgacccgttgtttgatttaaattatttattgcattacatattttagcatttttgaagtaagagatactgtagttctgttaaggatgaaaaccaagtcaaacccataagcagtcagacttgttttaaattggatggtaccagaggtttttaagagccacctgaaaaaatagaaaaataaagacacgaaatggtttttgaggttttacataatccatgtttctacaggcgacatgggagctaggagagtaaaaatagggcaaatagaacaaaatgtaaagagaagagtaggcaattttgccttttcagtgctttgggagctgtaactcatcatatattccactcaacaggtcaggagagccatggggatgccccaagggtgtcatcaaatgctttcttgccctctgccactctctcaggacttgcctggtcctaagcagagctgtcaggcctctgcccacctgcagggggaaaatcactcctgtctcctgacgctacccccagttatgtggtacagagctgcctggtgctatctcagaaacataagaggaagaggctcctcagttaactcttcccttgcccaggggctattatgaggtccatgtaatctttatagtcagcagggtcctagaattgggagggtaaaaattggagtgtgtgctataaaaaaggggtgatgttgatagagaaagttgtcaagaaagagcaacattcccagggtttgattgataaatacaaaggcaggtgtgtgtgtgcacattcaagtgtgtgagctggggaagtgttgctgaaccgagacagaacatagccctttgccttggaggccttccacagcgggctgaagggagactcggaggttctgtccatatctgtgagaggtgaaaaggaaaatggcttctattacaacctggattagaaaaattcctagacatggtggcaggtttcttctgttcctttcagattttctgagtccttgtaacaattgaaacacatttcagtcagttaaatatataggatattttctacaataaaatcagtggcaaggaaagtgtgcaaactgcttagttaataattgctggtgtggagcatctcttactttgctttttcccccttaattggttgagtattaataaactcatggtttgtttcaagggcacagctagtttttaatggtcttaccgaaatttcaggaagaaagctaaagaattaacataataaataattattgcttccagggttttttgtcgttaagataataaaatgttaaaaagcaagccacttgagcggaaagtaattgccctgataagcaccacacaggcagcattcacaataaagcagcccttccctcaatgtcagccagatttgcatcccacataaatgcttcctcacattatggaaatgtactttttctatcaacagagtagaatgaaactccaggcttctaattaatcttggctgacatttgatttcatacccaagttaaaggcaagaagcggtggagcttcccccatgtacatgaccacaggcaaatctctccattaatgtcaaattgcatctgtgcatcttattgtcactgccacatgtcagtcattaatgcattagcaatcacttacgtccactttctacctgctggttccctgcttgaggaaatgggcattgcaggaattttactttgcaagcctttaaccttgaacctctggattaatgacataaagagcttactcagatataatgctttacagatttcagcttgcctttgcctaccctgcacattgtaaatctcaacagcttggtgaagaagaccagacacccacagtttacaaatgtggagaccaagacttagaaaacctacatggcttatctgaggtttcatggaaggtaaatggtagagctgggatttgaacccagaacttcttaggtccgatgtaatattattttctctaaatggattagagagctccttgaggggtagaattaagtagctttgtcactctatacgaccctctccgttctttcccagtcaagtttctgttgatgttaaggaagcagtacacattttttattggaaaaagtaacaaattcaaatttatagacaaaatagtaaagtcagttccatttaaattatttgaagtgggtcataaaaagaaaagaaaattgtccaggcgtggtggctcatgcctgtactcctagcactttgggtggatcacctgaagtcaggagttcaagaccagcctggccaacatggtgaaaccctgtctctacaaaaatataaaaattagctgggcatgatggcaggtgcctgtaatcctagctactggggaggctgaggtgggagaatcgcttgagccctggaggcagaggttgcattgagccgagattgtgccattgcactctagcccaggcgacagaacgagactctgtctcaaaaacgaaaaaaaaaaccaaacaaacaaaaaaaagaaggataagaaaattactcacatcagggtgaaaaagtaaggtgtgtatatcgctcattagatgttggttttaagctcgcctgctgtcctgcagaaggaaatgcagaaagcctttgtctcagagagaaaccattttccttgttgctactctgaggtttccacccagggttttatgtcagaaagttggacaacagaatgggtgatgctcttctcattaacaattttcttgtcaatatggcagaataatgtgtgctttttaaaaatctggtctccaaattaaaggaataacttgaaaacaattgagtgaaggtagttctatgggaggcaaagatgatgtataactgatttgatttagaaacaaatcagcctacctcacaaggtaaaaaatagcttcttttaaatgatcatcctcaaagcccacttctcgggactgagttttgacagtggggacaacagtagtactcttgaagtgtcttggagttctggggtctttctggctaagggtgttgtagaatcaccttggcagccaatgtgccactcgttgaatagctccttcagtgacttgctaggcctgatgttgacagaagacaagccattctcttaaggcccagaaaggtcttggttgtgatcctagagctgctgctgttgatgaaggcagggatggcttttgctggactattttaatttccatttaccttgaagccagcatgagaagcatgcctggagtattttggaacaggtattgtgtggggagccattatgactataggagaactttaggaaggtgcccatgaagtatcagaatctaagcaacattgatgctttcctgatgtgcctctgaggaggaattggctgcaaaatgcgcctctaggtaatgaggcagattgacctgaggatggaatggcttttttattagctatgtaagtgttggggaatgtctgtcaaacagtgattttgttctggcatagttaatgttgagccttttagggggacaataatgagatgaaggttgtttggtaacattgctctatgataatgtcatcctaggagacttagcattgtaagggaggcccagcatgtcaaatgcattttagtctacagtgaagtctcaggtggctacattaaaagcagaaagtcgtggcacagacttcaatagtaatgttactctatctgcattttaacatgtttactatcagcaatagatgatgatcttcatagtgatattattaagactatttcttgtgtaatttttgcatctttgctgttcatctgagaatatttgaatttgtgcacagctgaagccatttgaggcttgcctgtctgattatttacgtagaacaaatcaccctagatatattagtggatctctgccaaactgccttccagaaacattgtacccatttatatccacacctctgaaagatgcacctgaatcatttgaatcttttcccacttgtttgacaaaagatggttttcttggaaaaagatcgaaaaagtattggtaaggtgttttaggcatttgtgtatggtagtacccccttatctgcagttgtgctttctgaggtttcagttacccacaatcaaccccagtctgaagctactacatctccacccttgtgctttggggcccttatgaagtgaaatatgtgagtgacttgagcacaggcactgtcatacggtgacagttgaccagagaacggagtcagctactaagtgaccactgggcagggagtgtagacagtgtggatcctctggacatagggaggagtcatgtcctgggtgggactgagtgagatttcatcacgctactcagaacagtgagcactttacaacttatgaatcgtttacttctggaattttccatttatgtcacaatgccttgtctttcacctgacttcatcttatcccatgggcatttcatcatctcacatcatcacaagatgcagggtgagtacagtacagtaaggtatttggagagagaccacatccacatacttttattacagtatattgttgtaattgttccattttattattagttgttaatcttttactgcgcctaatttataaacttcatcataggtatgtgcatataggaaaaaacatggtatatatagggtttggtactgtctgcagtgtcagggatccaccaaataggtcttggaacctatttttggggtacaaggggggactgctgtatgtttattgccttttcctttgcttttttcctactggagtcattatctgatttgtttgttaaaactctttgtagaaatgccactcactcctttccttctcttcaaagtattttcccttactttcttcatttatcttttttttttcctttattttcttttttttcagacagtttctctgtcacccaggctggagtgcattggcacaatttcggctcactgcaacctccgcctcccaggctcaagcgattctcgtgcttcagcctccccggtagctagaattacaggcacatgctaccatacccggaaaatgtttgtattttttagtagagactaggttttgccacgttggctaggctggaattgaactcctgacctcaagtgatccaccctccttgtccttctaaagtgctgggattgttgagccactgtgccagccttcgtttatcttttaattcatagcgtttttgtaccatagagaaacttaactgtgtgcacatgtgtggtaaagggggaatgattgactacttttatgagcagcagtagaagccttggttcatggaagacctccagaggccttgaggtgtgaagtggggctggtgagagaatgctgttctctctgtgttctcttctggtccctttgctgggtctcagacttggatgctaatcgtttctttacctttcggatcaatattgtcatgggaggtaattttcccccaagtggacagattcttgacttactagagtcagttttgttactctctttggcatgggaatttaattatgtattttagtgggaaggtgtgagcaggatgaaattagacacagataggtagtcactgccacaacctgaggtcagctgcagttttcttaaaaagtcactttttgctaataaagtttccgtccctgcttctccattcatgtattgcactcatctacactaagctgggtaggcaggaatcatgaagtggattatggaatgtccagtgggtctggatacatagctcgcatatccattaatagcctgcattacagattttatgtaaagtgttagttttaattacgtaagcattagatttcctgtaaagatttcagaaaccacactatttgaaagagagtacaaatttgcaaagagaatacacatgtagtggataggtgaaaagcttactccctaaaactatccagatatggacaattcagggtcatctgtcaggccatttataaataactcatattagcattaatcaatagtgcagcgttccaggcctgaaacaatgcatttaaaaaatgggatattttgcctttaaaaaaaattgttaatatagacagtcctcttgaaattagtggggtttaggtataaatttagatcatatttgtgaatgaaaccaaggccaatttaaaaagctatgtatttaaaactacaacaaagtaaaattctttttatcttaatccaaatatatattggtcagtatttcttattccagagctcagaattacccaggaaatctttggtttcctaaaactcaaaatgtttattgccaatagctaagtaatatcttctcgtaaacagtgtggctcaaaattatgatcctatgtttatgaaactgaaatctgacttaagtgcttgtgattgtgtttctagttatacaaactttcataggaatgaaagcaaagcataattctgaggttaagacaaacatgtttggtattcattaaactctactgagcacgtctacgtgtgtttattgatcatctactgcaggcttagttctatgctcagttctttgggatgcagggacagaaattaggtactcagaaatttctagaaccaagtaacattatttttaaaatagtgcaagtctgggtatccttttataacagggtttctaaccatagttcagctttgctgtattaatagtattgttgatgtcagcactttcttggaagacatgttttttgcttattcaacttttgcctcatgttagatttttttttctgctaaacattgctgttatcttagtgtttgttttttgttgactggctgtttggcctgagaatttagttctgaattccttttttttttttttttttaaggcaacagaataaacaagcaactgtgtgtcccttggcgcggtagccaatttaaggtgattcatacccagttacttaatagtaaagtctcattcctaaaggatataaactctatttcttgcaaggatgcttaaagagctgagcaaatcttaaagcattattatcacattttagactaaataaagatattttcgttcattctaattttcgtcattcccaaacacactgtggccttctgtggcatgagtagtttaatcaagtgtttagaatttcttggcctcaaccagattagaggaatttaactcagctgttgttgagaagaagtaattcttcagtcactactgaggttttgtaagtgttattgttaaaaaaaagaaaaggaactttgaagtctttattagaaaataaggtgaactcattgtgttttatgtatgttctgagatagagttaaaatatttcaaaattactacggggcaattttcaagcttaaaataaaaaatggctcactacccctggacaggttgaatttgtaattcatagctgaaccgctaaagttagcatgcagattacactatgagagttcatgcaggtctaaatagtctcaaataattctttaatttgtctctacaagtgtaagtttactaaaagtactatatggaaattccactatcccagcttttgctgggtcccttgctataacccctgactcagttccttgctttcagtgagagctcccaacagctctcatcatttctttctgtggcttaagtctgtgcatgctcccagttgccacagcagagtttctgcaacctggggttcacaggatcatctgggggtgcttattcaaatgtagcaccctgctacatttttcattccagaggctaacacagggcccaggagaatctgccatttaaaaaagccacccatgtgatagaaagccctcttgagggaaagcaaaggcctgtttgtgatgagagctgttcttggcctcccttcttgtggcaccctcccgagctggggactgtgcactgtgcatttgctactcttgaagcacacttgaccttcacctttcaccctagttcttttgcttaggtgctgggtgggatccatccaccttgctcctgggatcttctacatgccttttaccgtctatctgcatgtcactgccattgcacccttctcctgtaatgcaccctgctttggtgtaaagtcagttgctctcttagctgttctcataatgcttgaccctgctttcttttcacacttactgcagaggttaggagcaggactctggggcccaccaatctggatttgaaacctagctcctcctggtctagctgtttgctgaagggtaagttattttatctttctgagcctgagatgcctcatgtgtagagcggggagaatagtgactacctcacagtctgttgcgaggaccaaatgaggtaataaacatccggggctgagaacagtgactgtcaagtagttagcatgcctcgaaggccagccattgccatcattgtgatttctaacatcggctttttcatgatcatcctacagagctctgcgcagccagaaatctggaggcagcaatcttgtctcccctttcaaatccagcacataacacaccacttgctccccacaccaacccacaagtgttgactgaattgcactgactttacttgcaaatgcatttcctgacttcagtgtcaccagacctcatcagtctgtggctatcaaatacattctgttgacttcagtaactcaaaagtccatgtccttgtgatcaccaccttgtgcgttgtctctacccgctcccctccctgaaggacttggttcccttgctcattcagcagtctctccactccaggccctgcccttcccctgcttcctcactagctgcaggagggagtaacctgctggtgctggctgtgccattgtgtgctcttgctgcctgcaccggtaagcttgcttgatgcacaccaggctgtggcccaagaggtgcctagaggaagacgctgcgcccctcagttcccctctgctgcacttgtgtctacctgggcctctaggtgctgtcagggtttcagaggaaactgctcctgcatctgcagggagctctgctggactgagaacaggctcacctcctgagaaacacagaacctgaattcatgcttggagaagacaacaattctccaaaggctgacctcccctgtgtgaccgagccccggagcccctctgttggttcaagatcctgcattggggctgcagaagcggctggcccagtggcgtggctttcctaggacagaaggattgctccaccctacaggggaacaaatgtccaccttttaggagacagaaaactggctgttgtatccaaattaccgtttttctagcccgcggtttctgaacagtttcgtggatcttaagtctgagtttcagttaggctttcctccccactggcatatctgcaggaaggacagtcctagctctggatatttctctgcccccttttatttcttgctgtatgagtcactactctcccccggtgcattagtttcctggggctgctgtaacaaatgaccacaaacttgccagcttacaaccacagaaatttcttctctcacagttctggaggccaggtctggagtcaaggtgtgagcagctacgctccttcctaaggctctggagacaccccgttccgggcctctctcctggctcctggtggctgttgcgagccttggctcatagctgcatcactccaatctctgcctccgtcttcacatcaccttctcctctgggtttattctcttctgtgtgtctcttttaaggatctttgtcattggatttggggtctacctgaataatccaggattatctccacattgtaggatcattgatcatattttaaaagaccgctttatcaagtaaggtagcattttacaagtttcaggagttaagacttgatgacttggggtgttcattattcaacctgctacacccgggtaacagtaatctacattctcatacatcagttgcattgtacccatttcataaattaatcttgtgccatttaatttggtaatctggttagtgctaggaatttttcatatttaggggagagagaataataataactacagaaacagtatatagttccttgagcccctaggcatgctaggcactgtcacacacaaatgcttacactggcctgggagaaaggtgccaccattatttgcattttactgatgaggggacttaaacctggagcacttaagtaacttgctacggtctgcttagcaagtcggtgacagaatcagcaatgaattggccgtctccttcaaagtctgtgctctttaaagtggtcaggactgcaggaggtgacctcaagtcagagctgggtggggaccttggtgtagttgtttctaccactaagttggtggtaagatcttgggcaagttatccacttctatgaacttgactccatctagcacagtaaaaggactgtgaaggaggaattaatagggaggcacaaattaaaagaagaccagtgagaagctttgggtttggttggattcagttgaatttaacattagatatttgggttatctgggaagtttgattgtggcaatttttttttttttttttgagacagggtcttgctctgtagcccatgctggagtgcagtggtgtcttcatagctcactgtaactttgaactcctgggctaaagggatcctcccacctcagcctccctagttgctgcaactataggcacatgccatcttgcctggctaatattttattttttgtaggcttggggtcttcccatgttttcaagactgtggcaatgcttttttttttaaagcatattatttactatagagctttatagaaatgttaaataggactattgtttagttagtcccatttctccttgcactgtgaacgtggaaccttaaaaataaaagtgttggcatttaaaaaaagcttgacaatgcttcagtgaatttaaatatatataatatatatatttcaatacttgacactaaaaatattaagagaaaatatgagttattatgaaaatatctaagaacgatgtatttggaattattattattattattattattattattattattatttgaggcggagtctcactctctcgcccaggctggagtgcagtgttgtgatctcggctcgctacaagctccacctcctgggttcacgccattctcctgcctcagtctcctgagtagctgggactacaggtgcccgccaccacgcctggctaatttttttgtatttttagtagagatggggtttcaccatgttagctgggatggtctcgatctcctggcctcgtgatctgcctgccttggcctcccaaagtgctgggattacaggtgtgagccaccgtgcccggcctggaattattttaataatctttggtcatgctgtcagttaactttatggtaaataagtaattggagttttaactgtagaatttgttttgttgagattcattgcaaaactgtgagactactttgcaactccgtcttgggagattggtgttgaatctttctggtaaatgtttgatttggatgttaagctaacgtttgcagggcccctgcctgttaacagctacctgggctttgcctgtttggccttgactcttcttcctaacctggggtgaggtctgcaggatccatgtgaggccagatgtgctccatggggagagtctggtgggcagatcctgagtgatggacttcccatttctctctccttctctgctttgctgtcaggagtatctgtttgtctgaagcctgctgattctttctgttcctccaacttcctttctgtaatgccagttggtagctttggctttaaaatgggcaaacctcctgctctcctggttcagaattagtgatttttatcctttcagggatcatgctgtggaacacacagcagcctgtggagtctgctaagcccgattcacaatggagcattgatccctgctgctgtgtggcaccctggcctctgcagcatacacatgcttgggccaggatcaattttcagtgggttttaggtctgacacactggctttagtttatagtaacatcgggggcttgtgtctgcctaaccccatcctttataaagtggggatcagtgccttacagattttgatgccaacataattatttataaaatcatcacattacataagatgtgctgtttttcttttttcacacaagaaatgattttcatttgatgtattgatcagtgtagttactgggaattgagcccaatacatttattcttttatttgagatctgctaaaattgtctcttccttcggaagactgaaaaatgatccaggttgtgaatgagttgttccaattcttttcatgccgagcagggctttacactaaatttgggacctgaggggccagatttaggatctggagggttaagagtgagacacagcggctgcctggccacatgccagatgcaggaggtaaggctggaggttcgtgaccagtttggacatagctgctgctctggtaaaacacaaacatcaacaacgaaaacttgattcctgtggaatatgtgctataatctaggaaacagagattctctggtatgggaaatccttgaagtcttggcattagtgacagcacctggaaatactcattccaattcaaatgagtctgaagtgggccctggaggggctgcatggggaaatttgcaagtggtgtctgtgccgggaatgttaagtattgatggtgatgctgaatttatgaatatggaaagaatgcgtgtactcagaaggaggatgcaaacagattttaaattttattttgacattaccttccagtgcagtgcatggttagcagtaactgtatacagaaagggccacagaggctttggtttctgaaagatgtctgggagctgccctgttcacctggtgccatacttcctcagaaatacagaaagagcacgcagcagccagcaaaggtgtacttcagctggtgtccctatttcttctaatttagtgttggatggaatgataaaatagttctaatatgctcatatttgtctgtggtagtacacagtaattttcagtttatttgatatagctgctataggtcctcaaaatagagttttgaattttctttcttggtgctgacaaattgataccatttggaatacagagaaaaagtttcagtgcaacacaggtgaattttttaataggatatactaagtaagtttaatctctggcagggatgtctgatcttttggcttccctgggccgtgttggaagaagagctgtcttgggccacacagaaaatacactaacactaatgataactgatgagcttaaaaaaatcaccaaaaaaacccatgttttaagaaagttaacaaatttgttttgggccacattcaaagccttcctgggctgcatgtgtcctgtgggccatgggttggacaagcttgctggagtattaataaatattgtgaagcagaaaggctgtgcttatataaaattttgatgataaattcttagaaattagctgtatttatcacactcattttcttttaagaaatcagcaaaaatgtcccccccccacttccgttctagtaccatactttgtagcaaagagtttttggaaagaaaagagattcttgttcatagcacatcatcattcttttctcctatagatgtataagggaggcaaggtgaaaatgagctcgtctttttaagctcttgtcgtgaatcgaaccaaatctctttggttattttaaggattatttccttggttattttgcagagttccagttgtgtgggatgagttaatgttaaccatacactacttatttgcaatgttacctgttgtggacagctctggttttgcttaagcgtgtgaggttcaggccctcattctgcagtctgaggctgtggtagtgatttgggagaggtctgccgtgttgtcagcccagccctcccagtccagctctaccaggcaagtcctcctctcctacttaagcacagaccaagagctgacatgggattaggtgatatgtggggcctggttcctgccattgcagagcatgacagacagggagagggtgtggcttgaaacctgggaaccttgtttctggggatgagcaggatgtaggaagtcaggaaggcagggagcttttctggagtccctctcaaagcagccactccctttactggtctgcaggaccaggcagagtgggaagtgggaggtggctgctcagcactttgctacctgttgtctttctgaactgaagactcagaccatctttgaaagtcctgcggatctagtggcctgcactgggtgtttggaggaagactcctctcgtgaatagtttaaagctagagaagcaagtggttgccattccttgttccctgggactggtaatttaggggacccttaggatctgcacaggtccagaaagaagaggcatcttactgtggttgcttctgtggaagaagaggcatcttaccgtagtggcttccatggctgtgatcttggatgggcggggccagatggggaggagacagcagggatttggcttctttttctccccttcccagacctgtgcggttggagagcttcttatcccagttagcagagaaggtaaaatctgaagttagcagagaaggtagaaatcatttttgatttttttttcatgtctgactttgaattgttgaattcatccaagggtaaatattcctctgtataccacactagccataagcacacagtcacatatactgcacattagatagagcgtgatggtgacttacaggtcctgcttaatggaggtgagcgaggtggttttatgttatttggctaatttgtatttgtttaaaggataactaggctgtttcccttgcccttcattatctttctagttcataacctttttctccaggcacagaccttggctttggttgagtggggagggaggatgtcttgttttctttagtctgccttacagatgctggaggaagctccgttgttactttcaggtccctgaattccccaaaaagcagattttaaaaatcttggccatggattttctaccttgttttggtggaaactgctctattggaagttgcctgactccacccagctcatctgggggctcccagaattttacttgtaacccatcagatttgctcttctcctgcttgtagacactcaggtgcctaacctgggaggttttcatgggaacttcacaaaagacttcagaaaggtggagaaggaattgccgtttatttagtactcagtgtatgccaggccctgggtgcaaagttgccagtgttactgcatcaaacattctcaccagctccttaagggagcttaaattaacacaattttaatgatgcagaaactgagatctggagctgcgaggaatagagatagcttaagcatgtttattacagaaattctcactgcaaccagttgctggttcttttcttcactcactggcatgtggaaaaagcctgttgataaattgtgataagaacgactgatgtgctggggtgtgccgagttgtctcttctgcacatctctcctctcctacttaaggagaggaggcagctagcctagcctagcctaggattaggctggagcttgcactcgggagccgtatttctgggttcagatcttgacaccacaggccttcttgtgtgacctcagataaattacttaacctctttgtgcttcacaattagtgatgtttgttaaataaattaagcagttgagtacagttctagtgatctcttaccactgaaggggcaaagatttctcctgcatgtgccagcttgatctggcagaggacagggttgtgaggccctctctgtgatacgtgctaggctgctgagtgctaagatgtcactttcctaaaataagtgtcctggatgccgtaggcaagccactcattcctcgctctgccttcctcggagcactgctcatcctctcttcgtatatcaaagcccccacactgaacacgatttccttttgccccgctgtctgatatttaatcccgaatggtgtagggggtgaagagagtggagtgaggcagtagccagcttattacagctccagccttaccagctgcctgtgtggtggccttttagggccattgggccctcctgctctacaggatctctctcccacctgttgcagtaatgagtgaaaccctaaagcctttcactccccggtcagacaagatgctgggaaggcagcgttcctgggagaggcatcaggctgactgatattcacatcaaaggaacgaacaactcctttctttctgagtaggctgttttagagacgacaggatagacataccttgagagtattgagatgacttgggaaaaagaggcatggatagtctggagatacaaagaatacttttttctgattcaggttttatttggggccagcatgcttctgcacactcctgacttcacacagattcaaatacagcttgtccagaacaaagacggtttctactaattttttacattccatttttatgaaacattctcagagttccaaggaaaagagaatcctgttgttctgtgagattacattaagaaccactatattggttatctgattttctttttctttcctttgaagctctacattgatctctggaattaatgtcagtgagcttttgaggtctctaaaatgagaatgggaggcacctggctccttttcaaccccgagaagttgaatgaaattggtgtggggatatctgtggagtcagatttcctttggatttttcatttaaccccttgagccttgagctaaaggcactgattttgttcatgaagggcctgctcccattcttgcgtcccattcttgagccatgctgactggagatgaccggtgacaaccacatccaactgcccacagctgtcttcgggaagctggagaattagaatagtattgtctgctctgaaacagcctggagaattttagagctctctgggagcagggtggggtatgggataagggaagatgtgatgaaagagcagcctttcccagttagaacagatgtaggaagcaagcaaccccagaaacatctggaaaactcttaaagtgcaggctagtccctgtgcaccccataaggtcgactgattagaggcagtggaggcagatgtcagggtcagctctctaggatgcccttcataattcctgttttcttccccagggtatgtttgtgctattattaaatgattacacatgcttgttcattccttcctagtgtatactttctagctaatgtcatttcaagctaaaaataagtctggtccttagttagagttcctgagatttttctgcccagccgtctgtctttctcctgagatttgggtcttctcacatcatagtgaagtttatcctcctggtctgtctttgcatagctgtaaatgatgggagattctggatgatgagacaaagttcccagctcactacccagctatgacctgcatagggggacagcagcataggtagtcctgtggcgaagcgttggcctggaggacaggcctaggtgctcactaggtgctcactgcctggtgctttggggcgccatttcccctttcggagaaccagagtcctcttgcatagaatgagatcatggaatagcagtgcattctagaaactgcctgtctccttttttttttttttttttaaaggcaagccctgtcttcaaacaattttgtatggaatctcagtttaagaagatatttactgtccgtggaactgacaaccattgcaccccctcttctcttcatttgctggtgtggttcccaggcatgcctgcagttgagggcaagacagtttctgatctactgccattggaggatctcccaaaccctgtgagctcttgagtgtctgattactgcccagggatgaccattagccttgagttagggagagtatttccacagaggtgagaaggtagttcccatggattcctaaaggtttaggaggaactggcctcaccagatggtgagaattttgctaatgatggctgctaatgagggacacttcccatgttcctggtaataagagttgtggcaattttgtttccttgggaacgtcctaaacaaatgacttacactattctgttagtagtgggaattggaaggcattttcatgacagtgataattatattacaaacatcaacagggagacccatcagataaagtgggataggaaagaacaagacaacacctattgggcattttgaaaagctgataaggtaaatggtcattttaagaaaggtctcaaagactccttcaactagaaaacttcttatgctgaccttgaaattagggcaaactgacaagaacaacttatttgataggaattgctgggttttgcacagtggttctaagtgaggttctcagacttgggttcctgtgattattctcagccaacatgaatttcacgtaatttttaaactttaaaatctgggtgtcttaaagtgttttctatcatttatgaaagtccgttttagaatttttttttttctagtattaagtcagtgtttctccaaccagtgtcctccagaaccctttaagaagacattgtttgggtccttgaaaattatttttcttcaaaaattttctgaactttattcaagtttgagaaatacagactaggagacaggctggggtataatcatgtgtcacatagcattgttttggtcaacagtggaccacatgtatgaggacacatataatcccatacaattataatggagctgaaaacttcctattgcccaatgacatcatagtcttcagaagattgtagcacaacgcattatttgtgtttgtggtgatgctggtgtaaacaaacctactgtgttgtcagtcatataaaagtattacacaattctgttcagcacatgattcttgataataaatgactatgttatagggttatgtatacttttagattgttattttagagtgtactgcttcttctaattaaataaaaagtaacctgtaaaagcagcctcaggcaggtccttcaggaggtatctagaagaaggcgttgttattctgggagatgacagctccatgtgtgttattatggcccctgaagaccttccagtgggacaggatgtagatgtggaagacagtgatgtggatggtcctgaccctgtgtaggcctaggctaatgtatgtgcctgtgtattagtttttaacaaacaaaaaaagaaaaacatatataaaagagcttagaaaataaggatataaagaaagaaaatatttttgtaagctgtacaatgtgtttgtattttaagctaagtattattacaaaagtcaaaaagttaaaaaaaattaaaagtttataaagcaaaaatgccacagtaagctaaggttaacttattaaagaaataaaaatatgcttaaaaaagtaaatttagtgtagcctaagtgcacagtgtttataaagtctatagcagtgtgcagtaatgtcctaggccttcccattcactcaccactcactgacccatccagagcaacttgcagtcctgcgagctccattcatggtaactgccctatacaggtgtacaatttttatcttctgtaccatatttttctatgtttagatagacaaatatttgccattgtcttacagttacctacagtattcagtgtagtcacatgctgtacaggtgtatagtctaggagcaataggccataccagcctaggggtatagtaggcttgatatggttaggctgtgtccccacccaaatctcatcttgaattcccacatgttgtgggaggaacctggtgggaggtaattgaatcatgggggcgggtctttcccatgctgttctcatgatagtgaataagtctcatgagacctaatggtcttatgagggagagtttccttgcacaagctctctttgcctgctgccatccacgtaagatgagacttgctcctccttgccttctgccatgattgtgagacttccccaactgtgtggaactataagtccattaaaccctctttcttttgtaaattgcccagtcttgggtatgtctttatcagcagcatgaaagcagactgatacaaggctctaccatctaggtttgtgtaagtgtactttgtgatgttcacacaatgacaaaattgtctaactatacgtttctcagaacgtgtccctgtcattgacacatgactgtaactaagaccacaggttacatgaattcctttcatatgtgtttggaataacatgtttttttgctttgtctcatttttcagaagggagagaaagtaaagtgaactaatttgcattgtgtatgtgctctgtgtgtgtgtgtgtgtgtggtgtgtgcatgtatgacaggcaatctactgttatgctacagtttacttttgctctcttttctgaataaatgtgcaaaatgtgtatggaacctgttgtgaaggtgctggccacattttctgatgctttaaggacaagtgatccttattctgcttgagaaatcttcacggcctcatttttcactgcatcagataatttaagtctacgttctgggcattcctcatgccgatttcttcttacagatttatcgcactttctatgattcccaacatctcttgaccaggctggtcagacctgtctctcaattgttccacgattcactttgattttatcagccttggacccttgcttcatattagacctcttatttaaaatgtcttaccttccatttatctaaatcccaacttaatgtttggactaagtcatagctcttcagtgaatgggagtgaagctgtacgaaatcattgcattctagccaggtcctccaaaattggatatgtgagaaagagaagctgaaatgcccttctctgtaaggttctcactcatttctgttgtttctttcattttggcttcagggaaggtgtaatttcttttagcattgtgtaggtgaggccagtcactgcaagaaggctttgtaaaataacatgtaactaattgggcttacaaagtggaatgtacctagctcccatcgagtagaagggagggttcccttcatgtgtttctgccactcatgctcccagctcctattctgcttccatctctctccatgaacagtttataggcaggagggcaggacctggagggtaacagaaatcgccctcttacctggctcaggaaaccagcgtcccatctgtgattcagttgccactgtagtgtttatccacttgagggcagatatcaccccatgtgcctgggaagataggtttgcttatgacctcaaaggacaattggagggctctcaaacttgggtacctatggtaattcagatacaacaccaagcatccaacaatcctgtaaggatgttgcatggagattttgaagactgttcatttaaaaactcccccagtcattctcttctctcagctactccatacaatttaatccttaattatattttgtcatgttcccctttttcatacagtagatgctcaataatgatttcagtcatattgtttcttgaaataaattgaaaataccggccaggcgcggtggctcacgcctgtaatcccagcagtttgggaggcctaggcagatggatcatgaggtcaggagatcaagaccatcctggccaaaatgctgaaacctgatctctactaaaaatacaaaaattagccaggcatggtggcatgtacctgcagtctgagctactcaggagactgaggcaggagaatcagttgaatccaggaggtggaggttgcagtgagccaagattatgccactgcactacagcctgggtgacagagcgagactccgtctcaaaaaaaaaaaaaataccctgagagctgggaccatgttgcctatgcagttatccatcagtaaataaacacttggttgattccagtgcaaggaaaaggttgacccagtttgattaaccttctggggtcagcagattacttttgtcccttccaattggtttaattcataatgatttttatttgtatcaggtagataaattataatgttgcatagatggaaaatgctctgttgaatggaaatctgaattttccttataaggcttaacatttatagtcttactgggctgctagatagttattggaaaaaagagaatgacacgttcatgacttagtggggggattgctgatttgactcatttaacaatggggtctgccgatggtgcatacatcacagataggaaaaatactttttcttccaccctctccagaatactttagggtaaggagaaccagagaacatgtgttaaatgaatccaaatcaaacctactagttatacaaatgatttaagcgttattgtggaaatttacataaaactcagactcagcgtaaaacagtacaaacaccaaggccaaatgagttaccacagtaataaagtacacacagggcaacgtgcctgtgatatagggaaggctgtctttaaagtacttctggaatgtcagtttcagaaactgaaaaagatgctagaagtttgattttgtgtgatcaaacatcatttagaagctaaggaacagaaggaatattaaggtacccaaagaatattaaggaacctaggaatgtttgtgtttggggtgattagagcttcttgcaagcttagaagtaggaagctaatgataagggatcataaaaagaacaaaatagattgttttaactctgaaggattgtctttttctttagagaaaattggatcacttataggcagccaatctgtttaataatctgacttttatcatccccaaccaaaacatccagatgcattttgttgccttcccctgtctaatgtgaaatagtggttcagtatactgttcatttttcattaagaaattgtcagctgctgttgacaaacaggtaatgagtttgacacaggatcgatgtgctgtcagtcttgagcacaggcatgtgtttatcttgtaaggtggctttttgcatgggcttaaagagttgtttttgactccagggaacctatgaataaacttcattctaataacggttttacaagttttgtcaagtttttaagagagatgatcagttttttgaaccgttttactttttagagggagtttggagttgagaattaaactttgatacttcctgttgtccatcccctagccaacacacacattattataataacatttaccgagtggcttttttctgtatgttaacatttacattgatgttcccatagattataattgagaatttttaggaaggttcttcaaaatcgtttgttgcttaactctgataatttttcaatttgggcagctggtttgattttgcctaaaacaaaaacctcatcatttaaatacagttactttaaacaattaatgtaacaataaacaaaattcgggaactgtaacaggaaaaaaaatcacccatgatcttattatcagtaaagcactgtcatcatttctatatttttcattctctttttttcaaggatcatgcttagttttgcatacacacatggaagggcaggctgtagcaggaagagagacgggatcactcgcccctttctctttggtggttgaggctttctagctgagtgtagctggctctccgaaaggccctgtgtcatgctacagagactaggtccattccccagtacctctccagcctagtctctgaggagccatccctgtcatctgggaggcctctgccttccttctctggtacatggaagcagcagaaggaacaggtgcccttctgtcttctcttgagaagtcctcccctcccttcctgtaaggtggcaggcctcaacatttttggcaccagagactagtttcatggaagacaatttttccacagatggggtggggtggggatggtttgcaggatgattcaagtgcattacatttattgtgccctttattcctattattacattgtaatatataatgaaacaaatatataactcaccataatgcagaatcagtgggagccctgagctggttttcctgcaactagacggtcccatcttggggtgataggagacagtgacagatcatcagggattagattctcattaggagcgtgcaacctagatcccccgcatacacagttcacaatagggtgtgcactcctatgagaatctgacactgctgctgatctgacaggaggtggagctcaggcagtaatgctcgcgagccgccactcatttcctgctgtgccgctaggttcctgacaggccgtgactggtagcagtccatggcctgtgggttgtggacccctgatttaagggacatcaggaaagtccagctgggttcctgttaggatgctggttttttagacagggtctcactctgttgccaaggctggagtgtggtggtgccatcactgctcactgcggccttgacctcttggtcaaggctgtgatcttcctgcctcagcctcctgagtacatggactacaggcatagtgccaccacaccctgctaatttttaaaatttttgttgagttgggggtctcacagtgttgcccttggggtcttgaacttctgggcccaaggtatgctcctgcctcagcctcccagagtgcacccaaacgtggtgtttcagacatgccacaatgctccactgcagatctcactccacacctgaccaggggagcagcccaaggtcttgggatcactcacccctttctctttggtggttgtggctctctagctgagtgttgctggttctcagaaaggcccagtgttgtgcggcagagactgggtccattccccactaccagcccgggcacccctcactcgtgggcccgcctctttcctctttgtctcccatccctggcttggtttcctggaagaatgccttgagagaagctgcagccagtttgtgctggtgaggaaagcatagttttcagaagcttgtcctctggtccccatcctgcctgtcttcccacttggggtgggaggcctggggagatctgcctgttctcactcgcatggccaagctgatcctggtgtctgttgtttgtctggcctgctctcctggccagcgcccaggatgtgcttccttagtgcttccacatgtgagtggctgggctggggtgggttagtcgaggttgttctcactgtcagcacctctctgatcaaacagaagtacagagagggaggttctgcattcacaaaaaatcagaagggtattaaacgtaatatgtttgagtagatgccttagaaatagaattcacagcagaatgccctctttccagtagagaataattcaggaccccatactgtagcatggtggagcatgtttggaagtcacccatccccattatcagtggaagtgccgagatcattattctgagcacaggatctttttctaagaggattttatggttttaaagggagtttggaaaagggacatttgggaagcttgaagtgatgggacagaaatatcgatttgtaggttgaataattagactcctcctcgatgttcaggtcttgctgcagtgtcccctgcttgatgattttctagtggctgcaatatatgaccattatacattgcagaagttatagttatttgtttaaacacctttctcctctgttaatctgtaagctctttaaaggcataacctcccctttttcttttatttccctggagcaactattatacatacaataaagatttattgaaatgagtcagatagtgtcttcttatttttgggaaaaaacatagttttccagagtaaatttagaagttatttgcttaattgaaaaaatataatccttaatcaaaaaacttaattttaaagagggtttgcaccaagcttaaacactggtgtgtgtgtgtaaatatgcatttttaaatgtaatatatgtgtttctttctcctttccgctggtataagcatttcgtgagaagaggataatcatcaaccgcttgagttaatctgggggaatgtctgggaagtgggaagttgaggaatgccgcattgttgaatacattgagagcatttctggtttcaatttggtttacctactcttggtctgggagatctggaatgctgccctggactttcggttttgtgtgaattggctctgaggaaaaggattgctagaattagctgttggaatgaggagcggcagagactgggctcttgagaagcgagtggactggaatctgttctctgagatgttgccttgaatctgacttgttgatgacagacccatattggaaatattattccactgttaataagaacattttattttcacatgcaacttgttaaatatgtagccaaaaatcctgaaacaaaacaaaccccctctccactcaaaaaacttttctggaagtggttacttaatagtgcacatttcaatagaccgttgaatgaaacactaagataaagaaaatgttccctgagggaagagtcctgagttaatggcttagaaaggtgttgtaatcaactaagttttcatgcctctttcttcttctcattactgccatttcccttattctgatttactgattatttttttgaataatacattttaaaagagtatttgtttctctcactttaactcagatttatcacagtttgaaacttctatttagtatagtaataaaattagttttagtaggagtagtaaattgaggatgtgacaagtgaataaattactgaaggctcaaaacaaaaagcaatacaaaaaacctgaaaggaaaaaaacccaaaaataaatccccaaacctgtttgcccacatctactatctttcagaaccaagtaagaatctcagttctgcagcacctttcctcgttcttcttttcatagtttgtaccctttgatttgtgatgccttttacttcaccccaaacccccgtgacatttaagatgcgtgctatacaaaatacggttcctggctaaccagcaccataacgcttgttaagctttttctattctgcagaggcgatagctctgaaatatagaagtgattgcattaaatccttggctggcaattttgtgtgggattgggtattgaaatgcagcaaagcaaataatgaaggcatatgtttacctataattcttttttaccttgggagaaggattaaataggaacagtttggttgttgtcaaattcttaacagttgctttcaagcatgaaacagtccccgggctctcggaggatttacttagcagtttgaatagagaggtctttactgctaatggaactgagatggcaggcttaagcaatggggtgctttatagcctctttagccacttgagaagatgtaacatcaaatagctgaaaccatcctgatctccattggtgtttaggaagttgtgcaaagattggtgaataaataattcagggttgtatgaatgtctggatgccaggaatgttgagagtatctaaaagcttgattcacagaggatttagttctgggagaaactctggagcccctccttgagcttggcaccagggaacatttacagatgatgacattttctaagaaagaaagaactttcacttgggattgactgggctttgtaaagcaacatttcactggggactccagtcccggaaaagtcttatttgtaaaataaagaatattttcagtacagatggttggcagttgctgctgtgtgtgtgtgaatgtgtgtgtgtttaaaatacaggatggtgatgattatttagggtcttaaataaccatttaagttctgtactatttaatggttaagctttaagaaatcacttgttgaagacacaggggagaagtagtcacagtttgtctgttgaagcttctgcttcacgctctcgtcatctgtttcagaccttagtaaagacgtcccgaatgtgttgtccaatgaacaggtgggcagcaggtgttggggacccactggatatatgaatattcacaaatattcggactctcctcctgcgcatagagtagatagcagttccctgttcatttggacataggcgtgaccatatgacttgctttggccaattaaatgtcacttctgagcagaagcaggaaagctcgtgcttgtttcaccacatcctgtgccatggaaacttgcagttgattcttcagccccagggtgaggatgacttggaaaagagctcccagctgatggccagtgggcatggagggtgcacaagaagtgatatgttccttgatattttgtgattgttactgcagcatgacttagcctgccccgatgcatacaacctataaagtactagatttttctctaggagaaaaccactcaggcggtccatgggtgtttccctaccttaggctgaatagagaacttcccatggtgatgtggtggacaggagttagggcagagaaaccgctggctgctacacaggaaccactgtaccaggcattggcctttctcctttgtttcttgttgtctgtttcccataggtttctacaacattctttctcttcctgcttctacccgctaagtctgtttctatcctttgcatggtatcttggtgggaattctcaattttatgctaaccaaacatggaaagcagcttctgttcttccattacatgactcagaatgcctggacccccgacccctcttctctgccacagatgaggacaactctgtgtcctagagtgggtgaaagtgcttgtaattgccaagtgagggagattcacatgctttcatcaagccagagctgggcggctggggaatcggattctagacctattatccttaggtgcattgcagtgcttgagagaatctgcttttcacaaatgttttccactcttcacaaaactcttgggaattggaaatataatgcacactttatagctgggaagttgaggctcacagaaggtaagtactgtgctcagatcatcacatggacatgatatcactgaagcagctccaagaagtctctcattccaagatgtacactctttctactgctgtattatacacttctgagtgtgattaaataggcatagttgaaagaggcagtaatatttgaacctatcaaaagccagttcaaatagatcataacagtaatacagcaacaataaaataataataggctgggtgcagtggctcacacctataaccccagtgatttgggaggctcaggaggattgcttgaggccaggagtttgagaccagtcggcaacctagtgagaccccgtgtctactaagtaaataaataaataaataaacaaaactttataaaataatagcagctaaaacttacgcagtgcttattgtatgctgcaatattctaaggcctttaaatttattaatgcatttaatcctcataacactgtgagtaaatattcatatgaggcagtagaggcacagagaggttaagaaacttgcccaaggtcacatagctaataattggtaaactgggatttgaacccagactctagaatccttgatctaaagaacaaatgtttgaaactctgttaaattaagactaaaagagtattttttaaagaagagcagttttatgttcacagcagatttgagaaggtgctagagttcccatatagccctgcccccacacatgcatagccccccattatcaacagctcccacagagtggtgcattgttaaagctgatgaacccacattgacatgccgttatcacccagagccacagtttacattagtgggccacatttgatgttgaacattatgtgggtttggacaaatatgtaatggcatatatctgccattatagtatcctacagggtatttttactgccctaaaaatcctctgtgctccatctatacatccatcacctgattccaacccctgacaacgactgatctttttgctttctccatagttttgccctttccagaatgtcgtatagttggaatcccaaaatacgtagctttttcagattgtcttctttcacttaataatatgcatttaaattccctccatgtctttttgtggcttgatagctcatttctatttagtgcctaataatactctcatcatctgtatgtaccacagtttatccattcacctactgaaggatatcttggttgcttccaatttggcaaattctgtataaagctgccataaacatccatgtacaggtttttgtgtggacataagttttcaactccattggataactatcaagaactgtgattgctggatcatatggtaagaatgtggttaattttgtaaaaacctgcccaactgtcttctaagtggctagaccatttctcattccagtgatgaatgagggttcctgctgctccatatcctagccagaatttggtggtgtcagtgttcgagattttgaccattctaatagatgtgtgagaagaatattctaaaaattgaatttttataaataataacatggcctgcaatttctgaaatacgtagtgtatttgttctttttttttggtttaagaatcctaaaatatgtactgtgtatatgcattattcctttatcgatcaagcttctagctacttcctctaccctctcacaccctccttaccatagcagccatggttcatggtcaggcctctcatatgctgctatgagaggaattgatactgggctcccaggggtctatactgggttttctgtggtctgtgctggactcccttatttacctgttttgtcctttcaaaaaggctattaacagggctcttgtctgtatgatgtaaacaattagaaggaaggacaccctagataaataccttgggatggtgctgaaatttgttagtcatcaagagatgctgtcctgtggaaccctagggagtcagggtggttacagaatggcaagccccaagtcaggcctgctgccctcctgcagggctggagaggacagtgagatgggcataggagaaaatgacgtccctgctgaagtcagtttcagcatcaggcagcaggtacatggtgctgctaggggagtaggggaaggtagattcttgtatttttcttttaatctgagagttgagagtgaaatacttcactaggcccagctttgtgtatgtgtctgttgaggagagagaaagagaataaaaattgggcttgttgaaacaagccaaagttcagccaagttctcatctgaacctctaatccctccaagattttttttccaggcataagaagaaaaatcattttctaaaactttccatttctgatttttctgtgattctgggcagtcaaacttgtgtaaaatttttatgatacctttttattttataaattctcagcatgttaaacttgcttattttagtttgaatttttggaaattataatttttctattactcttcttggcataaggtaatttcttgttggggtgatattttacaatttagttacttaaaacgattttgcttttagtgtaaatcttacctttttttggaaaaatatgtattgggtgtcagaatcactttgtttttaaccctttttctgattatgagtctaatattgttattgtaggaaaaactaggaaataccagaaagtattaaaaggaagataaaacatactacctactcaaagtagcactactaacaatttgttgtatttttgcagatttccatgcacgtatatatgtattatacatgtgtacttactgttgtgtataatagtgaatacagctatataggcagtttttacagcctgcctgtttcagtggtcgagatcatcatgatttttccatgctttgaaatagtcttagaaaatatgatttttaatagctgcatgtgactttaatactattccataatttatatattattttttgggttgttggtatttaggctcctaacagtttttcattattaataatgttaccttgagtgtctttgcttgcattttttatgaggcttaacagttcaggtaagaggcctagaatattaaaaataactcttattcacaagctcctcccatgtgacaggtgtttgacactttacttacccccagaacaagcatgtgaggtaggtggcattgttcctcctaaaaaaacaaactggtggctgcaagctggtcagccatggaggtggacacaggactttctggaccaaccccagctctttcttgctgcactgttctgccttgggcacacttggagtgaactgtgagaccaaattatgagagaaggactatagaaaatcatgcagggggtgggggtaactattatgatgaaacatactggccagtactggtggatctgaaactggatcaggcggtgtatactggaaactattatacagatcctctttcccctgcctctgggattttacattttaaaaataaggtctcctgaagcaaagtgatttgcctgaggccatacaactaactatttatagcggtgagtgggaccttaactcccagcaactgcttttcccagcaactgctcttccatgttctttccactgtgcttgactctacaggcttcccaaaggatgaaggctagaggtctgaactctgtattcataataaggtcagagtacatccttaaagggacatctcccctagttatctagtttgaaatcagttagcctctactgaactatgaggatggcagtactgtagactgactgactggattttgatcctagttctacctttttcttgtcgtgtatcctgggcaagtttcttaacctctttgtgcctcagattctgcttttttttttgggacagggtatcactctgttgtccaggctggagtgcagtggcgtcatcatggcttactgcagccttgacttcctgggttcaagtgatccttctcccaagtagctgggactgtaggtgcgtgctgccacattcagctaatttttgtatttctgggtagagatggggttttgctacgttgctcaggctgatcttgaattcctgagctcaagcaatcagcccaccttggcctaccaaagtgctgggattacaggcgtgagctaccgcactcgccatcagattctgcttttattaaatagagacagcagtagtatctactgcatgagattgttgcgaaggctgcatgaatgcactgtgcagagctcctagaacagtgctgggcgtgtagcaagcctggtgtaggtgtagtgagcctggtgtgtgtgtggcgagcctaatgtgtgtatcagctgctgctgctgagtaaccaggcacattccctctgctgttcctccattagctactattttcaaggaactcaaaatgatcactttttgcctctaacagaatttacagaaactctacaagagcttgaaatgcacctatagtggtcagggagcgtatatatttagggagagtaataagataaaatctttcatgaaaaaagcttttagaagactaagaaaacataaaggtctttttaagcaggcatcagaatgtcatctcgaatctgtttcctttgtttcttgataggaaagtagttaaaacaacctaatagcttatcaataaatcagaagtttccagatttcctgatttgcttttgcttgctagtaattttcccgactcttatcaaattggatacaaatagatgtttttaaaagtcaagttgcccacactatttgattctgtttgctatttttggcttaaaaatgaagaagaaatatggcctaattcttgccctgtggtgaaattatattgcaaggtaagagaatagaaaataaagcttttcattatcacctctccatgacctcttgaatgaaaaggttgggagtttgagaggttctttttttttgagacagagtctcgctctgtcacccagactggagtgcagtggcgtgatctcggctcactgcaacctccgcctcacgggtccaagcgattctcctgcctcagcctcctgagtagctgggattacaggcacctgccatgatgcccggttaatttttgtatttttaataaagactgggttttgccatgttggccaggctggtcttgaactcctgatgtcaggtgatccgcccgcctcggcctcccacagtgctgggattacaggcgtgagcaacagcgcctggccaagggggtttgttcatcaagatagacttcctctgtctctatcaataactggcaaagttgcagtgagaccagttactagtggtcagtgtgtgacattggggcccatgagcctgggtttgaaacccaggtcctcggcatccagctgaaacagccgtttcagcctctcagcttcattttcctgtaatatagagaaaatacttcctactgtgaggctaaaatgccttaacattcataaaagcatctaatgctaggctcttgtaattttagcaccttttcctctgatgacattcactgggaaaaggaaaggctctgtagccccgtcttcagaactaaattctccaaagcaggacttcattctaggcttgcttttaaacaagattatttccatataccatccaatcaggtaatatgacataggaaatgcccttccctctgtgagacatgcactcgcgtttggcaaagactgtggtcaccaccttcatttaaaagggtttaatgatctttggactttagcagactccatagagtacagccctgatggacagagtttaggcagagagaatattttccatttcataatctcatacacagggacctaaattccactatcagggacttctttaatgactccaactgtcagcctggacatgagtgacctgaagaacctgtatggagagtggaaggggcatacagatgacttctgctggtatgaccctctcccctctcccagccacacagctggtggcttcacaaagagctaggttagcagtgaggttgtcctgtgtacaatttcagtgccccttgctcagggtctaagcctgacccatgttgctgcagattgtacactggggttatctgggttatttatttatttttagagacaggatctcactctgtcatccaggctggagtgcagtggtgcaatagctcactgtaaccttgaactccagggctcaagtaatccccccaatttggcctcctgactagctgggactgctcctgagtatctggaactcctgtgtaaacattttaaaaatttaaaatttttgtagacacaaggtctcgctctgttgctggggctggagtcgggagatttttgacacaattccgtggtttatccaatccatgcctgcacctgggagtgcatcacactcagctcactctcccctcggcactatccccctctgcaggtggcttagtgtccttcctccaagcagagggacttccctggtctccttcctcttctcgaggttctgggatgactcacactgaaatattggtggaatgagaatcccctgtggaagttgttgtttccatccctgccatttctactcacctcctgacctcactgacttgcacaaccagccaccctgtcattactctgggtgggacaatttcccttttcaatttttggttatcagatgttaccatccttttgggcctccggatatgggccttttcctttgcagggttatagctgtctccctcaaaggcttggtttagtccagcagccaggcggggaagcattttattcctctctgtcctgaggcatatgtcctgaaaccattctgttcttggcctcctcagcccttgtatgagatcctgtcttcccagagaactggcccttcccagtgaccacccatctttggggtaaaggtctttatcctcatgtttcaggacctgactctgggccttagggtacatggaaggagggagatttggggacacagaatgcccagtaacctgcggtgaggctcggttcattctaggaagtatttaggaagtattttgcaggccttgtgctaagggaatgtgaagatgagaaaattcggcgggcaccagaggcatgggagttgagtacttggctttgccaatgttaaatgcctccttcaacatttcagacagggaatttttgtagtggagagtagagctgaactttaactcggtgatttttcctgacagaaggtcctctctaaggacagcaaggaaatcaacagtagcagttagttaggaaatggggtgttgtgcggtgctacagtgactagagtcagaaggagttccattgattccaaataagaggccctgcacaaatggagattctgatgtatgcagctctctacctgtgtctatttgaaaacaaaaagccaccttattttgtctaaaataatttgaagaatttttagatggccacatgacaaagataccatttcaataagtaatataaaaaatatgtggtgtgaacctgggaggcggagcttgcagtgagccgagattgcaccactgaactccaacctgggtgacaagagtgagactccatcacacacacacacaaacacacatgcacgcacacacacacaggatatgtattctgtgaaccactattcatttctgtataccagactgaatttttaaaagcatttgaagcattcactatttttcacattaatatcaaagcagtaaaataatccagaaacaaaaaaagataagtagcttaatgattctacttaaaattaatgcaactaatgtatttctgttattccctagtgtattgttgttgcaaagtagttactgtctttcaaatgaaagtttaaaacgataactttctgaaaattgcagctatcatacaaaaacgtgattgtaaatcgtttgtcttttgccatttttcttaaaagaattagatatttaaaagatcatataatctgttaaaaccattagttggcattttaagagtcacttcaagaatgtgctttaatttaaaggaaaactaagcttgaattcattttcatcttttttttactatattgaaaattttaacatttcaattctagttttgtccatgactgttaataattcagtcattcagcagataattgagggcccaccctgtcaggcactgtcctaaatgctgctgctgcccaacaaaatagacccaaaatgctggcttcatggagctcacattccatttgtgtacatttctatggaacaggcactgtgtactttccgtgcatgcttgagcaattttaattcttctatcagcccaaagaaggcactattactatcccagtttaacaatgaggaagctgaggttggcaaggttcgcagtttccagctcatctccatctacgtgatgctggtttcatgaccactgtgcagtcacttgctttagagtggtttgaaccattgagttagcttcactgagaagtatcatggaaccacttacactgatattacgaagtatgcttcaaaatgatggtacactcatggaagcagcctcagaggaaagccattaagatggcgggggtgccaatcatgtcatatgagggcaattgtaagatattattgaactaagatcaatgggtacagggtttgggaggaaggattcaggtcaatgtagggaagaaccatctaacctgtccacagaagggatggattgcctaattaaatgccgagattagagaatttagcctcgtggatgtggtcaagaggattcaagcattaggttgatgatcatttagatcagcttcccacacctgctcatcagaatgatccagccacttgttgaaaggatgtgttctggttaccctgagatgttttcattcattagatttagggtggggcctgaacatctgaatttttaatcaacacaataggggacctgttgctgggtagagggtggtggggtataacagaggtcacaaatgtacaaaagccctttttggaggagcatgtatgaaatgttttaggaactgaaaggtcagctttgtggttgtactcaagagagtgaagggcaagttgtattagaaaaaagtagacatataggtgtgagccagaaattggaggttttccagaaccacattaaagattttaagcacaactgaaaccattttagcctagagtaacatagggtaaccagattttgtgtgtgtgtagtgtgtgtgtgtgaatgtgcagacccacacactcaaaatacacatcatatttttaaagatctctcagactgtgaagagaatggacttaaaaatgttcatggaggaggtagagtgggtggcagtggactggttaatagactattgaagtattccaggtgaatgacaaggggacatgaggaggtttttttgggagctaaaatcagctggcctggatggtagaccagatcatggggataagggtaagagggtattcagggtggagagggatgccatttactcacccagggaataggtttgtgggaatgttttgaacgaatggaaattgaggtgcctgagatggccactctgacatgtctaatgggtggttgggtatgtggggttagagctcagaaggagaggtcagatggttgaagccaaaggggtggatgaaattgtcgagggagcaggaagagtgttagaagagggctccagacatctaatgtctggtggtggagaggaggaaaaccaggattcggccgtcaccagggaagcccctgaagagggaggagggtgtttcccaaaggtgatatagacaagagagcaggagagatgagacctgagaagaacagccttggattccttggcctggatgtccctgtgacttcagcaagagccgtttaggtgccacactggaggctgcagggagttggggtgaggaccagagagagtgattatggagactgtctcctgagagatgtggttatgaggaggagcagagacctaggacagtcacttacgcgcaacgtggaagggaggtttttaaacatttttaaaagatggagtagccttttgggctattttgctggtttattttagaattaaaagtgggggaattaaagaaaaaagttttgagtaatgcttttaaagtttcatctttgttattttaaaatgttttctatcatgaactctgaagaaatctttgagaggatgatggatttacattgtcagtctcttatacaagtgagcccttgtgaagtaattttttcaaaactaaagctttgtttttctctccttgagataagataaacacagacaccattaatagcacattttgccttgttatctatgaagggggatggttgcaggcatatagtgtagtgtcacgtgagccagtggtaatttacatggggacccttaggttgggttggcttatgtgccatgtgaaagtgagagcctgtgcccaggatctgatttcctctttaattgagtatcaaattaaattcagagatcccggggactaccggccagaaacattttccctcatcctgatttgcttttctgttctacacttctgtgtcctgttttatttaaaacaaatgtaagactttaattaagaaggttttaaagtcatgagattacaaagtaatcttgaatccaatcctctgtaattttaaccaaatcactcagtatctttaagctcaaaatgtcctgtcagctttaaattgaaactgaatcccactgagaaaatattatgcagtctcatcaaaacctgtgctaatttcttttttgtttttacccatcctttcttaaagaatcaataagcttgcttttctataatagtgattctcagtgttgataactgtgataagatatatttctttccattaactttgctgtaataacacatttacgttcagaactacaaggctgttttttttttttttgtaatttcacgatatgccgggggattaattggtgggtgctgtgctcttgaggattaaagagtccaatttgggagatagataattgtctagagcaaggttgtccagcccgcggcccaggatggctttgaatgtggcccaacacaaatttgtaaaatttcttaaaacattatgattttttttgcaatttttaagaagttcatcagctattgttagtgttggtatgttttatgtgtggcccaagacaattattcttcttccagtgtggcccaggaaagccaaaagaccgggcacccctggtctagagatacagactatttcccagatagacgggtaggttccctgttactgccctctctcttgagtctggggtatttttgcaattattctagcactacagatctgtcaaggataataatgcatagttattaacactaagtatggatgttatgaaatttgattgtcaatatatcctgtgctgattgtactcattcaagttaaaatcacagggtgcagatatataaaaatctcaaatgctagtttatcactttacagatagaactgtgatatagtgttctatgctaggcacgttgtgctcagaactaaatagcctaagtaggaagccaagttagaaggttggtccagtatggaatcagcacaaggggagttgatcggatgatgtcagaggccaattgtcatgaagctgtttgcctagcatatccatttcactgtagtgacatacctatgatgagaaccagaccatggtgtttttctggatcaatggctgtgctgtgtttctagcagtgctctactctagacattttatatgtaaagaaatgatgttatatgctcattttagagaagaggaaagtgaggctcagagatgttgcgtaattggcctacaagttgcacagatagtaagggtaaaattagaattggaacttgcgtttaattccacagtctgtgtttctactctttttgcttcattgctaagatttgggcaatccataggtcttcagtgatgcaaatcacctccaagaaaccccagtgccttagcacttggtgtcgtttccatgaacagagcttttggtttcctttgctcagacactgtccaagttggggcggctgaaaaaggctccctgagctggccacatctgttttaattagggatgtgtaaaattccagccatcaactgtgccagaagtctggataggctgcatgttacagctgataaatgatctaaggcaaattatctggatttagggatggtatttgggatgaaataatggagagttagaatggtctctcagcaaagctacgtgctgtttactgtaggaattagcatgcctgattagtacagctctgagaagggatgaaaatgtctaaaaaaattcagcaattgcctcagtgccctaaatagtcttatgtcagcaattagcagtaacagtctttcattaatccatcagatttctgatgctgcacatcctaatgcaggagataatagagaatcctcaggattagccactgatgcatcacaccacagtatgtcattacagcagcagtgttgagacagcatattgaagcagaaaaacggtagagcaacaattctctgaaagcaggaaagtgctccttttcttcattcatttcagagtgccatgtgcaatgagccatgaccaggcagcagtctgtatcaccaactctttggaggtgtgtaagtcggctttttagttgtattaatgagatgttgcaaaaataagagagtccaaggaaagaaacatattgctggtaaattcaaaggggttcagattttgcaaccattccttgatgaaatggactctctttcatgtattctgtggtcgtgttacctaatcttaggaggagtcaccatgtttttgctcttccccaaattcatctttggatggctgtgtctcagaatcattcagcaaatatttcacatcctttctggtttcttcaagtctccaaatgccttcccttcccctcattcctggcagggagtcttgccttgtacttgacttccatcttcttagcatcatgtgaactctcccaccttcccttcactcctcttggaatccccatgttgtcacctgtgtgtgtagtgtgtggttgtcacactttgacagatctaatttcaaatctgacctgctctctctatctggcagagtgaccaggcactactcacttggaacctttgatcccctcctttctttccaaatgctcttcctgcatcctccgcatcgcaggaaaggacagcatcttttgtctggttctcaagctgagaaacttggagtcatcctgattcctgtttctctcatgcctacattcagccagtcagcagatcctgttgattctaccttcacagtatttccaaccaccatcccggccctcctgcaggtctttgctggcgtgattcttccctaggactttccccttttcagcattgccccataatggtctagtctgaccattccaaaatatgaatctgatcacagagcctccaaagtcttccatttttcacctgggaaaacacagaatcttttccaaggcccgctgggtatggtgtgatttgcttctagcacttctctttgttcatctcctacagcttcatcccatctcctgccatgggccctgatgctcctcaaacactcaagcatatgtcctccttgtagctcctttctgttttttcttgttgctgtttttgttttagttggctgtatcctccgtgagaatgttcattccataaagaacaggattttttttttcccattttgttcactgccatctccagcctctcgattcccattgtactgttgcctctcttcaatttgagaaatgcagacctatagaatgaagttcaggctctttatcatagtatttggtcttctccacaatgcccagttccctgtctttgggccattactgtttgtatactcacaggaaccctagctacacccagttataccatggctatgtctttgtccccatggctgtgaaggtaggacatgctgaaaagctctttcctcatttttacttgttaaaggtctattccttatctttaatgcccaaatggattgaacaatattttagatttctcccaataaacatttatcctcctttcctctgaaatttgctgccacttgtatagcatttatcacatttcgcctttgtaagttatttgtgaacatctttctcttttgttattcttgtaaaatccttgacgatggatttcttttcatttcagatctattgttgcatccctagttatcaccttttacacagtgtttagccaacttatttacaaatagaaacagccttaagttcatatttcaaatgatctcaattagtgtagaaagcttttattatttcctcttgtgtgaattatttacatgaacaagaaataacatgcatatgacaacaaattaggatatgttattttcatattaaatgtccctaagataataagcaatgaattattaatgtatcacacaggcatatcttttattttattttttgttttttcaaatgtaaaaacaaaactaaatttgtcctaccagaagctcatagggtatgtttaggctttcagggaaaataattatttttacttagagatcagtagctaaatataaaaaagaacttaaaatttgcattgtgccccccaaaattatgccatgtatttggaatgtgtatttcatatatgttggagtttaaaatatttttccagcagtatagaaaaacagaagaaaatggacttacatttattgttaaagcaacgtgtattttatatttttatatttaaaatgcttttgattataatagctaaggcaattttataatgcagggcccaagtctcatttcctttctgctcttccaccaggtaagtagtacttcttgatttaatgcactgatattttctataaagtgcttagcatagtactatgtgcttaataggtagttagcacccaataaatattagcttctattattcataaagaagtgaccttctcttttcagagtccttcttggcctgtcatttatcatattattgccttgtattatttttatgtcttttccagctaagtgtcctttaatattgtagataattttgtacattgtaaaggattaataaattatttatccactgaataaataatgaacttgtgaacattcttttaaaatttaagtagctctgaagtttgctcatattgagcccaaacatggcggaaacttctgagcatagacaagttaatgccataaataatcccagaaaagccactggacacagaacgagtctctggggatgaaccagaagtcacatttgcctgcctacattttccttgcggaggcagttctactaaattaacaggggatatattagcatgttcagagacctctaaggtacagtaaaatccatagaatgcccacttccactacatttgatagagttacccattgggttaagattagttactcagtttatttatgttgtaaatgacttatttggccatttgtttgggaaaggtaggaagagcagtggagagaatgagagactgcagggcagacaaacgcttctgttttctgactgtgcactcacatgagagaaagagagcctttcaaaaagtatttgcttgggtgcttcacatggaagatgtgagctgctgaactctgggagctggcagccagcctgaatatgtcctttaaagtgtacctacctgttaaccactgcagtgcttggaatctagtaggcattcaaggaaacttggatgtatagatgacaaactggaagtgacaatgttccaggtagaggagatagcttgctttttatggatggcttagttgcaggcctccattgggttctcccaaggctcagtgttttgcctggaagttaagccattttcagatctatgagtgcataggtaatgtaaccattacattattattgttctatttcatttacttccaagtaaaccccagtcttccttgtcatgattatattgattgtattcattcccacaatgattcaaaaatactgtgtgtctcagaattgcatggccctccattggacaagtggggctaaaatgtaagcaaggtgggcttcctagagaagcctacagcctaagggggagatgagacctgcttacatggctgtcagtacaggacagaggaggcgcgtgctacacagtaaaggacttcagaggagggaaatagtctgtacagtctgcaggatgccaaagcacttcagagaagaagttgcattttaagcaagactttgaaggagatgttggatttaaacaaagggactgggttggaggtttagagtgaggacattgaagagaaagcaacaggcatagtaattggtaactttacagtcatatcaattaatttatgttaattaaaagtgtaattcaggctgggtgtgatggctcactcctgtaatcccagaactttgggaggcctaggctggcagatgacatgaggccaggagtttgagaccagcttggccaacatggtgaaaccccatctctactaaaaatgcaaaaattaaccaggcaaggtggtgcatgtctgtaatcccagctacttgggaggctgaggcacaagaatcacttgaacccaggaggtggaggttgcagtgagctgagactgcaccactgcactttagcctgggtgacagagcgagaccctgactcaaaaaaaaaaaaaaaaaaacagtgtaattcatttgcacatgtgtatctggctaagtaaaatgttgtatattgtcaagtttaagataaattttatttccctttatatcctgtaggacatcacaataaaattttgtttggtcaggcttttcttatactgttttatttcttttaagcattgggattcttcatactcaagataaaaaaggaagtcataattgcatgttatgatattctttgaagttatgttggacagcgtccacagtagaaaaggttaagttcatttcttaatgtgtacacactgcctcttacccactagcattggggccacctcattcatttgtttgctcattcaacaaatatttattaggcatctactgtgtgccaggcagtgtctagtgtctttcaattgtgtttgcattcctcatggtatgttttatattctttttctttcttctattctatgaacgtttctttgggggatatagtaggttcttaataatcattgaattaatgcacattgaaaaatctcacaaaggaattcaggcatgaataagcaagatggacttgttgaaagttccactgcagttttggacttgagtacaaatattgaatactatgtttcatagggtttcattagaacagaatgcgtttacaacttttgaaaattttctggtgcttttccttaatttaacaaataatcccacacatgaatcacatcactgttcaaaaatgtaactttgtattttgactaaccttacctaatggggttttggtattaatttaagcatgaagaactattcttggcttttgccaggaaacaggtagttaaagttctctatacttttattaatcataacatttctttaggccatttcagctcttatatgacttgagggtgaatgaaaaaccattcagttaaccaaacagagaaaactgaagactgattagttgaagtctcacagagtatatgccccttctactctaccctaaacactgagatagtcacatttcctagaaagacccagcgaaaccagattagtagaaagaggtccagaataaagtatctgagaaagcattatatctgtaagaggagagtgttttacagaagatgaagactaataatttcaacttcatgtgataaatccagtttgtttcatttttaaatttatgcttcctaataaagtaatttattctagggctcaaggttttataaatggagaaagacagtgcatatgattaagatttcaaactctgtcatgaaaagaattatccatgtttctgcctgccccatgttgtataaatttctctgtgacttataatttcttagacatatttatctaatgatgtgtgtttgaaagcatccacattttgtgtctgccctagttttttaatgattttaagtgcatttttaatggttgaaactgttatgtagaccatcttctgaggcaaaaacatgaagtactacatcacaatattaagttcttcaaattagaattacagttttagtgcatttgttatttaagtattattaggttagttcttatgctaattttagatttattaacagataggctggagcctgccaattaatgctttttactcttgattcagcaataatttgggtagtcagaaatgcagatgcatttcttatggtcttttagaaaattattttcttttgatttaattacttggtgcaggacatatttcattacgacacttctaaatccaattaaatatttttctacaggcaacaattattctaaactcttttcctcacagtggaaaagttgatcatcttgaataatcttaaccatgtttatttctccaaaactgtagtgttttaccttgtaaattttcttgttttccaggtgaatttaaactagatatctcatttccatttttcagcattttctccaatttgattgacttgtactaattgctctgttgcccaggctggagtgcagtggggcgatctccactcactgcaagctccacctccagggttcacgccattctcctgcctcagcctcccgagtacctggggctacagatgcctgccaccacacctggctaactttatttttagtagagatggggtttcaccgtgttagccagaatcgtctcgatctcctgacctcgtgatccgcctgccttggcctcccaaagtgctgggattacaggcgtgagccaccgcacccagcctgacttgtattattctatatgcttttttttttttgagatgaagtctcgctcttgtccaccaggctggagtgcgatggcgtgatcttggctcactgtaacctctgcctcttgagtttaagtgattctcctgcctcagcctcctgagtagctgggattacaggcacctgccaccacgcctggctgatttttgtatttttagtagagatggggtttcaccgtgttggctgggctggtctggtctcgaactcctgacctcaggtgacccacccgccttggcctcccaaagtgctgggattacaggcttgagccaccgctctcggcctctatatgcttttatattcatattccacatgctgtttacatttatatggtgaacaagcagatatcatcctgatattgtagagcacatgatttcttgctgtattttcattgacttttttccagtgagcaaatagaatattttttacattagttttcacttctagttagaatatatctgtatttgaaaatttacccaaagagtattgccacatcttaacaagtagattactaaagaaggaaatagccttgttatcatgttttattttacttgtaacaaattccagtttctaaatattcaaaggaagtgcataactagtgttttccagataacttgtttggtaggggttttaggggtggagatggtctgtaatcaaaaataaatggcagaatggatggatgactggcagtgacagatactgagcattgagggggaaatcatacttaaaatgaatttcctatatcttagaatgttaataaaatattatataatttattatgctgatgattagcctgtggggtttctctcctgtttcagtacaggtaggcagaacttgctacagaaagaaacttccagtgtccagttgaatgaattaattatatatatgtcattccaaattatctgatagttatataatttgaagcaaataattatatgaaaggagctttagagatcatcttactgcaattttgtgataatgaggaaattgaggtccgaggaattttacttttctcaggtcattgtgtattaggatgcttttggttgcaagtgtcagagtccccagttgaaactagtttaagtaaactaaaatatatatatatgactgggaaatctaggagtagatttggagtcagaagtgcagcagccaattggtgtggttaggagttgggtattataactttaggtcatccttattcctaaggatgtggtagggagacaggtgattggcagctccactagaaccatggggaaagggaggagccagtctctgaaaaaggaaataaactcacctagtttagtggaagaattgctgctggaatctggcctttagattcccaagttaatgccatctacatcaaaaccttaatatgtagtaggatagttggattaattaagagggtgcttaactcttagttgagtagattgtctacttagttttcattttagagcaccctgaagttggggttctaaagccttgttttaaagccaatagagcctttggctacagtcttttggaagttagggtttttataaaacaaatgcattgttggtgacatgataaatgcagatgagaatagagcacaaatctgctaaaaatttagaatttttaaaaatgataatggaaataactcccaagaacatataaactatgatctgttcaacatgcaggtcttttcagcttttctttctctttgtcccggagctaaagcttgattcaggacctggctgtgtgtcctacttggagctgctgaaaggtccccacacattccagtcaacctatatcttccttctccagggaccttgtcatctcagcgagtagatttaatttgtctttaatattaaatatgttcagtaagtatgtgtgtatgtacgtgtgtctgtttaaactttacatttgatttttcctaattatccttagtgaattcttagaaatgtgatcagaaatacccataatattaagaaaaggagaaagagagacaggaaaggacttagttaattcaaaaactgcataatatatcaagatatgattgctatcacatactaacagaatgtttaagttctctcactcatgaaaaaaaacacacatcttccagataaaaaggtaacacaaatgtgtgtaccttaatcatacccatatgtaaaactagagcggtggcatgaatcccaagaagtgggcggttgcccacagctgtacttctgtctcagatggataactgcaatcactaaccttttttgaagaatttgatatgatactgagaaaatagtgattaatcaaagccccttttaaaatggaagactttcatctataggcattaactttttatgatcagagaaaaaagcagtaaagaataggtgaaacatttattgtatacttactttcggtccagcattatgctttacatacttaaatttctaattcatcttatctgtgaagtgagtactattgcaaatatgaattcactttacagatgaggaaactgaggcctggagaggttaagtaaatgatctaaggcgaatccaggtcagaatgtgtgctcttgagggctatgagggatgtggaggattagtataggagcactgtctggttgtaaatggcagggcagaaacctgacctttgaaccactctgtgttctacctgcttccgtggcagaccttgtcccaaatatttcaggattgatcaagcaagtaacaatactaggttattgactcacggttctgtgaaggaaagaaaattgaatatttctgagaaaaattgtaccaaaatagagagtgcccttaaactgtatcagcttgtgagacgtgttttaggcaagaagtttccagtttttttcctgggaaatgctgtacagcagtgggccctgggaggaacggcatatacattaaactccttccagagaactatttgttctcttttagggacaagatgtgttcttaaaagttgggcagacttcacatctaattcttctactgtcgttacaatttcctacactaatcctaaattccgtggagtttttattacattggttggtggcattagcctgtcaacagctggatgagatagaagttagaaaatggactttttgaggtcaggaagctaagcaaccagaagaaccaatttgtcaacttaaatcatctggggaatggaaaaaattattccacaatgtgggaaataaaagaccgcctggagctactggtttttgtttttattttctttttgttattcctctttgcacttcccttttccgagcagcattatgtgtgggttatagaaagcttacatgttgactttgttatgtggtcatttgatgtggtcgcgctaacgtttattgtaaatactgtgagtatttttcacccttctggcttaattacctgtggccacatcaacctgaatgtatttgagaggtaaaggggcccaagacttcagtaagagcctttacttaaaaaaaaaaaaaaaaaaagaagaagaaagaaaaaattttcatctttgtgttgtttatcttttaataatggggcattcatgcattttccatatttggggtgatagtatttgggaaggtgaacttcatttgcaggttttataaaacttatttcttcacaatacttaggaatatatttagtataatattttataaaatttaaatactgtcttattcccttaaaaaggatattccttatgctctggtacaagaaaaaagacataagattcttttgtgaaaccatgagatgatgatgttcatgactgaaaacacatgtcctcccatgggtattggctgggtgctctctttcaattacttttgcttagtttttccctagtataatgctttataaaataaaactttatgtactgacatggcccaaaataaaacccattattggaaaaacctatgtttcttaaggccaaaaggtacattcctttattttttatttttatttttatttatttattttgagacagagtctcgctctgttgaccaggctggagtgcagtggtgcaatcttggcttactgcaagctcccccgcccaggttcatgccattcttctgtctcagcctcccgagtagctgggactacaggtgccagccaccatgcctggctaatttttttgtatttttattagagacgggatttcaccatgttagccaggatggtctcgatctcctgaccttgtgatctgcccgctttggcctcgcaaagtgctgggattacaggcatgagccactgtgcccagccctcattcctttattttttatgtgaatttcttctctatttttttggggtgatttcaatggaccatgaaatccaggttactgtttctttaaatagtgaagcaaatacacaatttaaaataatctgagcttttttcttagcagcccgaagaaaagtggttaatttttactcagattatctctttttcttttgaccattgtgcttttacatatgagcacaattcatgaatggataatcttagtcattaatttcaaaacattctattatgaaaacaatttaatattgatgaaatcaagttttaaaaaaaggtttaaaggggagaaaacttgtaataaccagacagcacatatttaaatataatagtgtaatgggaatgttttctcttttcaaatgaatttccttgtctgctagtattacttattaaaataagagtatttttctcttaaaaggtccaatgaattgaattgcaatgagtttaaatgccataaatagaatattttataatactttggaggtttctacttacaaaaggtgctctgagattcttttgcaaaatgagaaatgagttttcaaaataaacaccctgttatttgtgtttataatagattgttagatactatattacctttacttaaagagaaagatgctcgtatttatgttattttcaaattagaaaatctttctatactgtggaaacattttaaactaatacacttgactaataattctctattacctctgtagaacatgtaaactgatgcccacccatgctaaacacagtagaattgtacgtcagttctactatgtagaagagtcagctttatgtcaattcatctatgtagaagggtcagttgtatatatctcaactgtctttatgccaaatctatttgtaatttaattaatttacaagattactctatcaagaaaattgaagaaatatgagtaggggaatagaaagagagttattccataaaaactcagatgagtcccttggaaagactaaaagtgagctattaaaaaaatgctattgcactagggtaagcaagccagctgaaaaaaaattggaaaataagtagaggaaatctaagtaggaaatcagacaaagtataaatggttgaggtttatgcaagacaaatgagtgggtattctaattagcacacctatgctctgaaaagactatggccatacagtagaagatgatatacgcttatatcagttaagttcaaaatgaattatttattttgcaattttcattttgaaacgatgatctttccaattacctaaacaattaatcattcctcaaggttgaacaaaagaccttctgtgctaatgcttactattaagtattcaatatatgtttgcttcatagatttcatttcagttaatatgtctacataaaactgtcatctatttgaaacagttatgcattttctgtcatattaaagtagttaactagaaaaataatatgtttttccctaaaactctacaaaatttgtatgattagactttggagtagttttctagtttttaaagtgaaacccagcaaataattaaatattaaataattaatgtaaaagccaccttttaatttatacaaaagctaattttaagtaacaaatctcatttggcactatttattaggggagtagttcagaatcgggcacattttcatgcctgtggtttaatcatctttccattttacttatgtaacgatttcaacaattccaggaaaatccttagtgtttagaaatgaatttgattcatgacccacctattttgtcaaaatggtaaagctttagttgtttttgtttgggtgacttcctaatcattaaaaaataaagacattttgagaaggcttataaaaataaaaaaagtcatttcagttgtaggctgctgaaatgggccttggttgttgcaaagtattaaaagcacaaatgctaatataaactgtgtagcctcagaagcaatatatgtgtgagctgtcttttctgccactgtggaatgctactcattttggctgtgagaccaataataattcaatatataacacagataaagaccagcgatggtgccattctcttctgaatttataatacctgggaaattagaagtccatccagggagtgacactgtagaagaatagaccatgtagcaaccctgataatctcctcagagggtgccatctcctcaggagtttgcaaggatcttagaatccagagtctgtcccttgctcttttgagagacagtagccagggttttgtcagtctgccaggattgggtctctgccaaaacaggtcatgttggtattttattaatttataatgagaaaataagacaagcctggggaaactgtgtgcccacaacctttagccagccaggacagtcattctttctggcgagctctgtggggaacccattaaaatctggtttttcttggtgagcctggaagcagggattggaatccattggaagacatcaggtttcttttgtaaacatatgcccaggatttgaagtgagctgtgtcaatactcacaaaaacccattctcctcccttgcctgtgtcctgcctgtacagataaggggtgcaggtgggattactgtctccagagtttgcacctgggatctttgttagcatggccttaggcagtcattgcagagtcacacacacctgtgtcccccaggtccagcctttgggcaggggcatcctcattgcctctgggctttgatggacattgctggtggtggtagatcaccattgatgacaagatgataacggtggataaacatggcttttactttgatgtgtcttttgtaaatgttacttgcatacctttgttgtgattatagtccattccaggctcttcccatcttgttccagctgtgtttctgacttatctctcgtatactggaggactcgctcttcccacaggaagctgggaacctcagtatttgtgtgatttttattacctggctttgcatttcattatacccatttctctgctccagagccttcctctgctctcctgtgctgaaatccgagctttccattaaggcctagcacctgtcttacctgagcagggactgcttgcacatcctgtggtgtgctcagagcgctttgttagtgattctaggtggtactggccgctccttcatactgtgacagttatttgagtaacctatgcaagattgagagcccttcttgagtgagtggcttgtgttcacatcatccttgtttcctccaagttggaattgtctagggaggtctctgtatttttagggggaggtgggggatggttggaggggagaatggcacggacaaggagaaacgggtttctgctctagcattttgcatgctttactattttttgccatgtgtcttagcacattcggaggccaccacaggccctgtttatcttaaacaacatgttcctgagacacgtaacagtgataccggggtgggtgaaatgaattcagggtaccattttcttatgtatttagctattgaatgagcaataattttaagatgcacactgagggtaaactcttactcataaagcagccaggcaaaactctgatgaaatatgaatcaatagtctcctgtcaagtgcaagaattccattgaaaaactcaatctcacaagggcaaattcagattatttctgcaatgtgttgaaataaaatctggtataaaaatcttgagttagattttttgacattatctctcactaatatatttctgggcttctcccttaattcttacaaaggttagagtgagaaagttattaggtaagttattgtgacccaggcagccatccagataaaggttcattctagacaaggtatgtatttcatgggcagtgagagggaatatatgaagatacagtttcctacaagatggtgaaattttggttctactttaattgtagcataataaagaaatatgatatagtcagaactgctctacatttgtaaggctacgctggtgtgtcctggtcatgcccatagccagctctctttgagcctgtctctgaacagattggaatctggcacgtggtgattaacaacacttgctcccttgacttcaggggttgttgacttggtcatgtagatcagtgattcacagccattacagtgcatcagaatcacctgccaggaggacttgtgaaaacacagattgctgggccccagctccaaagttggggtcgggcctaataatttgcatttttaatgtattctcaggtgatgcacatgctgctggtctttggaccacccttggagaactgttggtatacaggcttacctcgttttattgtgctttgctttattgcgtttcatagatatacttttttacaaattgaaggtttgtggcaatctttcatctagcaaatctattggtgctttttttccaacagcatatttggaaaataggcccactttgtatttctttttcagattttgataattctcacagtattttaaactttttcattagtattgtatctgttacggtgatctgtgattagtgatcatcgatgttactattgtaattgttttgggatgccatgaaccgtgcccatataagactgtcaacttaattgataaatgtgtgcttttcactcctctgctgctgggctggctgttaccccatctctctgcctttccttgggcctccctctttcctgagactcaacaatattaaaattaggacaattaataaccccacagtggcctctaagtgtttaagagaaaggaagagtcacatctctcactttaaatcaaaagctagaaatgattttgcttggtgaggaaagcatgttgaaagccgagataggcagaaagctaggtctcttgtgccagttaacccaactgtgattgcagaggaaaagttcttgaaggagattgaaagtgccactacagtgaacgaatgataagaaagtgaaacagctttattgctgatatggataatgtttgagtggtctgaatagaagattagatcaggacaaagcctaatccagaccaaggccctaactctcttcaattctgtgaaggttgagagaggtgaggaagctgcagaataaaagctggaagctagcagagtttggttcataaggtttaaggaaagaggctgtttccagaacataaaagtgcaaggtgaagcagcaagtgcagatgcagaatctgttatccagattctgcagatgcagcctgttatccagaagatctggctgagataattgatgaaggtggctacactaaacaacagattttcagtgaagataaattagccttctattggaagaagatgccatctaggtctttcataagttgagaggagaagtcaattcctggcttcaaggagaggccaactctcttgttagggactaatgcagctggtgactttaagttgaagccaatgcttattgaccattttgaaaaatcctagggcccttaagaatgatgctaagtctactctgcctgtgctctgtaaagggaacaacaaagcctggatgacagcacatctgtttacagtatggcttactgaatattttaagcctgctgttgagatctactactcagacaaaaagattcctttcaaaatattactgctcattgacaatgcacctggtcacacaagagctctgctggagatgtacaaggagattaatgttgctttcatgcctgctaacacagcatccattttgtagtctacggatcaaggaataatttgtacttccaagtcttattgtttaataaatatattttgtaaggctatagctatcatagatagttatttctctgattgatctgggcaaagtaaatggaaaacctcctggaaagtgttcactgttctagatgtcattaaaaacatttgtgattcatgggaggaggtgaacatatcagcaggagtgtaatattaacaggagtttggaagaagttgattccaaccctcgtgaatgactttgatgagttcaggacttcagtggagaaagtaactacagatggtgtagttacccgggaggcggatgttgcagtgagctcagatggcaccactgcattccagcctgggcaacagagtgagactccatcttaaaataatactaataataaagaaaaagaaaaagaaaaaaaatgaaattgccacagccactccaaccttcagcagccattaccctcatcagccagcagccatccacatcaaggcaagaccttccaccacaaaaaaaattatgactagccataggctcagataacgattagcattttttttagcaataacatatttttaaattaaggtatgtacatttttttaaagacataatgctattacatacttaataaaatacagtatagtgtaaacataacttttatatgcactgggaaacaaaacaaaattatgtgactcagtttattgctatatttgccttgttgaggttgtcagacccacagtatctgtgcggattactggtacagtattcaggggatgcagagctcttagatgtggagggctgactttttgtattaatgggttctgcagggtgtactacaggacttcggcattcgtaggttttcatatcttcaaggggccctggaaccaatccttgcagatactaagggccaactgcattcttgggataaaaggtagattttaaccagccctatatttgtttaaggaaaggataaaaagtctttaaaacaaataatttactatgtctgaagccaatgatcattttgcttgattctgaaattcttaatgagaaaactcatttgtatattatatccctcttggaaacaatatacaactttcaaatcccccccccccccactgtaatttattgtggttttgggcaaaaagacttaaaaataataaaactctgatatcttagtttacaaatatttaaattttcacattaaagagccttaaaagtttatttgaagcacgtaacagtatttttctttaccctgatctgtgaccaaccctatacattcttattcctagaaggaagactcttataggcactatcacagtgatatagagattcatgatgcagactgtaccgaaccaccttacagtatgctgtttgttcattagacacttgtcagcagaaatggttgaagaaacattataaaacacacatgggtcctttcaacaaatgatgtcagttcaacatctacatgaaaaaaaaaatgaatctagacactgaccttacaccttctacaaaaaccaactctaaatggatcataaactcaatgtaaaatgcaaagttataaaattagacaataagataagagaaatatctttttttttttttttttgagacagtgtcttgcactgttgcccaggctggagtgcagtggtgtggtcttggctcactgcaaactctgcctctcaggttcaagtgattttcctgcctcagcctccctagtagctgggattacaggctcctgacatgacagctggctaatttttgtatttttagtagagatggagtttcaccaggctggtctcaaactcctgacctcaggtgattcgcccgcctcagcctccaaaaatgctagaattacaggtgttagccaccgcgcctgaccaagatgagaggaagcccatgtgaccaggcttcacaatacatttttagatacaacaaaagcttgactgatgaaagaaaacattgctaaactggacttcgttaaaattaaaaactgctcttcaaaaaacacccttaagagaataaaaagccacagactaggggaaagtgttcataaaacataaaaagggttcatacccaccaaaaaagagcccgcatcgccaagtcaatcctaagccaaaagaacaaagctggaggcatcatgctacctgacttcaaactatgctacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttcgttacaccttatacaaaaatcaattcaagatggattaaagacttaaacgttagacctaaaaccataaaaccgctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaattttcgcaacctactcttctgacaaagggctaatatccagaatctacaatgaactcaaacaaatttacaaggaaaaaacaaacaaccccatctaaaaatgggcgaaggacatggacacactcttctcaaaagaagacatttatgcagctaaaaaacacatgaaaaaatgctcaccatcactggccatcagagaaatgcaaatcaaaaccacaatgagatatcatctaacaccagttagaatggcagtcattaaaaagtcaggaaacaacaggtgctggagaggatgtagagaaataggaacacttttacactgttggtgggactgtaaactagttcaaccattgtggaagtcagtgtggcgattcctcagggatctagaaccagaaataccatttgacccagccatcccattactgggtatatacccaaaggactataaatcatgctgctataaagacacatgcaaacgtatgtttattgcggcactattcacaaaagcaaagacttggaaccaacccaaatgtccaacaatgatagactggattaagaaaatgtggcacatatacaccatggaatactatgcagccataaaaaatgatgagttcatgtcctttgtagggacatggatgaagttggaaatcatcattctcagtaaactatcgcaagaacaaaaaaccaaacaccgcatattctcactcataggtgggaattgaacagtgagaacatatggacacaggcaggggaacatcacactctggggactgttgtggggtggggggaggggggagggatagcattgggagatatacctaatgttaaatgacgagttaatgggtgcggcacaccagcatggcacatgtatacatatgtaactaacctgcacattgtgcacatgtaccctaaaacttaaagtatactactactactactactaataaaaaagggttcatgccccaaatatacgattcttaaaattcaacaataagaaaacaaataacccagttaaaaaataggcaaaagatctgaacagatacctcatcaaagaaaatggcaaataagcttatgaaaaaaatgtctgaacaatacatgtcattagggaattggaaattaaaacagagataccactatgtactttattattattattattattattattattattatcattattgttttaagacagggtctcactctgttgcccaggtgggagtgcagtggcatgaacatggctcactgctttctcgacctcctgagctcatgtgatcctcccaggtcagcctcccaagtagctgggaccacaggcatgcaccaccacacttggctaattttgttttaaaatttaacttttaagttctagggtacgtgtatagctttgttatataggtaaactatgtcatgaaggtttgttgtacagattgtttcatcacccatgtattaagcctagtacccattagttttcctgatcctctccctcctcccaccctctgccctctttcccatagaccgcagtgtgtgttgttcccctctttgtgtccatgagttcccatcatttagctcccccttatcagtgagaacatgttttacttggttttctgttcctgtgtagtttgctaaggataatggtctccagctccatccacattcctgcaaaggacaatcttgttctttttatggctgcatggtattctatggtgtgtatgtactacattttctttatcctatctgtcattgatgggcatttatgttgattccatgtccttgctgttgtgaatagtgctgcagtgaacatacacatgcatgtgtctttatggtagaatgatttatattcctctgggtatatacccagtaatggggttgctgggttgaatgggatttctgtttttaggtctttgagggatcatcacagtgctttccacaatggctgaactgatttacactcccaccaccagtgtataagtgttctgttttctctgcaacctcacaggcagttgttattttttgactttttaataatagtcattccgactggtgtgagatggtatctcactgtggttttgatttgcatttctctaatgatcggtgatgttgaactttttttcatatgcttgttggccatatgtatgtcttcttttgaaaattatctctgttcttgtcttttgcccactttttaaggcagttgttcatttttttcttgtaaatttaagttccttagagatgctggatattagacttttgtcagataatatagcttgcaaaatttttctcccatttggtaggttgtctgttcattctgttgatagtttcttgctgtacagaagatcttcagtttaacccacttgtgctggaggttacaaatttttttgtgtgaaaaattagaccttggcgatgaccttgagtagcaggatataaaaaaccccacaagcttagtgttccaataatggaacactaggcataaataggttaattagatcctgtttgtcaatttttgcttctgttgcagttgctttgcttttggcatctttgtcatgaaatctttgccttttcctatgtccagaatagtattgcctaagttgtcttccagggtttttatagttttgagttttacgtttaaagtctttaatccatcttaattttagcatagtatgtagagaaggggtcaagtttcaatcttctgcatatggctagtcagttacaccagtgccatttattgaatagggagtcctttccccattgcttgcttttgttagcgttgtcaaagatcagatagttgtaggtgtgtggccttatttctggtttctctgttctgttccattggtatatgtgtctggttttgtaccagtaccatgctgtcttgtttactgtagccctgtagtatagtttgaagtcaggtagcatgatgcctctagattttgttctttttgcttaggattgcattggctattcaggctctttttttgttccatatgaattttaaatagatttttctagttctgtgaagaatgtcagtggtagtttactaagaatagcattgaatctatataaattgctttgagcagtatggccattttaatgatattgattcttcatattcaggagcatggaattttttccagttgttcatgtctctgatttctttgagcagtgttttgtagttcttgaataggtcctttacttatcttgtttgttagctgtattcctagtttttttgtttctttctttcttttttcacaccggctaatttaaaacattttagagatgggatctcaccaagttgcccaggctggtctcaaactcctgggcttaagtgatggtcctcctgcctcagcgtcccaaagtgctacgattacaggcatgagccaccacgccccacctacacacatgttagaatggctaaaatctaaaacacttacaatgccaaatgctggcaaggatgtggaacaagaaggaccttcattcattgctggtgggaatgcaaaatagaacagctgcttcagaaagcagtctggcagtttcttacaaaggtaatcatagtcttagatatgatccagcaattctgctcctaagtttttgtcaaaaacatatgttcacataaaaatctgcacacatggttatagcagctttattcatttttgccaaaagttggaatcaaccaagatgtcttttaccaggtgactggataaactggtacattgagacaatggaatattactcaatgctaagaagaaatgagttttcaagcccccaaaagacattgaggaatcttaaatacatattattaagtgaaagaagtcagtttgaataagtctgtatgttttatgattccagttatctcacattttcgaaaaggcaaaactatgtacataggaaaaagataagtattgtctcacatccattaggagcaaaagaacaaggaaaagaaatgaaaaaggaaactaatgactattagtgaggatgcagagaaagcagaacccttatgcacagttgataggactgtaaatggttcaaccactgtggaaaacagtatggcagttcctcaaaaaactaaaaagagaatgatccaacattggatgcaacattccacttcagtatatatacccaaaataattaaaatcaaagtctctaaaagaaatttgcacacacatgttcattgcagcattatacacgatagccaaaaggtagaagaaaccccaggtgttcatcagtgaatgaaagggataaacaaaatgaagtatattcctttgatgtaatattattcagctttaaaagggacacgtgttacaacacaaatgaaccttgaggacgttgtgctgagtgaaataagctgatcacagaaagacaaattccaaataatttcacttttatcaggcatcaagagtagtcagatttggaaacagaaagtagaattgtggttccccggggtgaggggagggcagttgagataggagagaagggagtggggagttatgtaatggggatggtgtttctgttttgcggggatgaaaagagttctggtggcgatggttgcttaacactgtaaatgcacttaagactgtgaattttatgttatttgtattttcctataatttaaagaagaaaagatcaatggttgccagaaaagttcagtggttggggatggtggagagggatataaggtagaacagaaggggtttttagggtagtgaaacccttctgtatgatgttgtgatggtgaatatgtgacgtgcatttgacaaaacccatttggtggaactatggaactaggaaaagttctcattgttttccctattcatggtggggattcatttatgctaattgttttatcttctctccatcctcaaaatttgtcctcctcctcctgagaacaggtagccagcttgcagtagtagcagctttatcttgtgcagtcatctggttgtcttattttcatcttccttccccagttctttccccctttcactgctgtaaggccaaggtggatgtgtaggaagcagaggtatctccattttcctttggaaactttctgcttcttaccagctctacactttccgacatacaatgaccctttttgctaaaatttggattctcagtttaacaaaagattgagagaaaatagttgtgtccctgtcccttgactcttcctttaaaagatgtttccagtcaccatacttaccctctgagtttagattttgccaaattgttggcagggtttgaaggccaggacgctctgtgtgctgctatttctggatctgccattgacagcaaccagattacagtgaagcccgtgaactgacagtccagggcaagtgtgctgttgccgtgggcagtccacgatgggggcctctccatccttctgagttaggacagtcattcctcccgaggtggcttgtcctttctgatgatagattgagggagacaagcagcacatgagtagacacacaccttgcccgagcagttggtgccatttaacagtttcttcccactcttgacattttcattttcctccttcacctcgctcatcactagttgtttgcatcttattttctatacacagccgtaatgcagaatgacagaacacacacacaagctccattactcattttctatgccgtattctactcaaattacacagtgattttgcatgagctgagccatgaaaggggcatacgattttaattgtacactggccttgtgcagggcatcattcaagatggaccgaaattttcatgaagcatggctgcttaaaaaagcagcagtgaaatgaaaaggtgttgcatttttgtttcgctcatgctggcttgcacttgccttgtttatcaagaagtctctttcccagggaacaatgaggatttttaaatcacattcctgggggaagaacattgtgttgtcaccctttcattctccctcccctcccccagttttactgaggtataactagcaaataaaaattgtgtatatttaaggtgtacatcatgatgtttcgatacatatatacattgtgaaatgattaccacccctcacctcacatagttaccttttattatttgtggtaaggaaagttaagatttactctctcagcagattgcaaggatacaatacagtattatcagctgtagtcaccatgctgtacattacatccccagaatttgtttatcttgcacaactgaagcttcatgccctttgaccagcctctcctggtccgttcattcttaaatgctgttctgggctctggggtgactcaattgtagaagctatacagcatttgtctctttttctccagcatgatccctagaaagcctgagaatctattaaaaacattgtggcttcctaaaattaaagtaaatttatatatatatatatatatatatatatatacatacacacacacacacgctataaaaatgaacaactttagtacaagaggtagcagaatggtcggtcactgatgcagacgtttctcaaggattttagcttcagacttacatggaatcaaccagcctctctacttccttatttccatgatactcaagtcaccagctgtgttaggggttgcatgtctgatgcctttgattttgagtgctgctttcccctccttgtaaagacgttttattcaaggatggaaggttggctctgaagcctaacataacttacagaaaaagtgccgcacacagtgtcttaactcaggtaggtcctgggtttaatgtttgacgtagtaaacagctgaggacatgagaacatgctgggacatgagaatgtgctgtttttctcacatgaagttttcctagtaaatagactgaatggtgaatgttagcagaaaccatttcttttggccgcttgttttggtttctggcagtgcttttgtgctggtcactgctcttacctcattcattccccagttcttgttatctttgctttagtcacattgatgagatttccaaccttttagctcaccaaccttgcttctgcctcagggcctttgccctttctgtgcatctgcctgaagctctccccagttctgcagacagctaccatttccatattcaggtcttcagtcaaattgtccctggttgctaatgagttcttatttgatgaccatatttaaaattgcaggtatacacatgcacatgtatgtacacacacacacacacacacacacacacacacacacacaatctcccttctctgctttatttttttcactgactgttctccatcttacatactaaatattttcctattttcgtttgtctcctgctactagtatgtgagtccatgaattcaggaatccctctgctctgtattctctgaattcatttctgtgttcccagtctccagaacaatgtctggcacttaggatatccataactatctattgaataagtgaatgaatggtggccagcctgcccacactgtctacagcatcaccacaattcattttccacctaggcacttacctgcagtctaaagttatcttgtttattaatgtgtttccttaattatcacctgtgtctcctttcctgaagtgaaaggaagctccaagtgaggacaggcctggcttaccttgcttaactgacattccagcacctactacagtgcttgacagatagtaaatgctcagtaaacagcagttggatcagtgaagggcttgttcttcctgcttcccgtcttcctaatacagcagttttatgtcattcttcatagcactagctccactgaatatatcttttttatattcgtgacacatgttttctttgacctttggggtgcctctggcaatgaagactcaagtgtcaatgggttgatgggaatcctggtgccaaaagaaatggcccggtctgtaaacttgcttaatctagtgcagaagccttagatctttcctagaaagtcagtgattttgactttcttgcctcatttcaaagtcatctgtcatgtgttcccactctgttgggttcagagggctctgtggacagtttggcttgaagatttcctctccatccagccttctggagggtgaaagtggacgtgctacacttgcttacaaaaaggaaagatgaccataatgtagcattttctggctgggtgcagtggctcacacctgtaatcccagcactttgggaggctgagatagatcacttgaggtcagtagttcaagaccagcctggccaacatgacaaaagcccatctctactaaaaataaaaaaatcagctggcatggtggcgcatgcctgtagtcccagctacttgggaggccaagacagcagaatcgcttgaaccttggaggctgaggttacagtgagtcgagatcatgccactgcattccagcctgggtgacaaagagagacaatttctcaaaaaaaaaaataataaaataagtaaagcaagcagtagaagtgggtttggtcgatttatgcttcaagaggtttttgtatggtggcccaggctgagaagctgagtgtgattaaaaattttcttttggggaaccccttcccaaagtagggaagacagagatctggaatgttcctgctacccctatggatctattctagattcttttcctcagcctccgggagtctgctggattggggccggtgggccacactcctagttgagatcagaaggtatgtcctgctcatgttttccctgagtttcttctcttgggccttagcagtgtccacacaaaacctctagaatgggctctcttgagaccatcacagcctccagagccacagtgtgctggtttagcgtggccttggctgcagtcagacgtggaatttctgttttgccttttacacacctacacatgatgaaaccttgtctctaccaaaaaacagaaaaattaactgggcacggtggcgtgtgcctgtagtcccagctactcaggaggctgatgcaggagaatcgcttgaacctgggagatggaggttgcagtgatacgagatcacgccattgcactccagcctaggtgacagagcaagactccatctcaaaaaagaaagaaaaaaaaagcaaagaaaagaaagaacatagcattttctaacatgacaatgtcagcttagtgacaggatgaatcacttcaggctacagcagaaatatgttttgaagaacaggactatctttgcacagggaaaaatgatgaagaggcaaagcaaaagatctgttcaatttacagatttttttaaaagctgtttttcttttcataaggaatgatctttaggatctttattggtctttctaacactcagaatattcatattacgagctaatgtggcactgatgtgacttttagaagctccccttacagatgtggttaaatttctgaattccactaagaagacctgagatctcccattggttttgtttcttgtgtcagctgcatctgcagagcatataaactgctcatgtgggattcttgccagtgcagtttgctgttgtaaagaccttagccctgactgaattctccacagggaatggttgggatgagtccttgggaaggcagtgacaatgaatgtgccaagaagagggagacaactgtctcttgccaatttccaggctagtaaatggaaatgtaatctgcaccaagtcagaagaatgtcttttacccaatcattcataaaaatgaagtcatggataaaaaccatccagggggatcaagaagacccagtaagtaatcctgtggagaggtgagcatgtttctgctacaaacatgcaactcctgccacatgcaaaatgatttgcactgccagaatataatacttccaatagactcctggtgtataccttctttgtcctgattgggtaagtattgaatggcatctgatggtgaggagcaatgtgggatcatggggtgaagactgcagtaagcctgaataataattgttattgccattctgatcttatttttaatggcaatatagtttgacaggtgtgctcatgtatatgattttttttttgagacagggtcttgctctgttgcccagactggaatgcagtggtacaatcacagctcactgcagccttgagttcctggagtcaggtgatcctctcatctcagtcttctgaatagtggggaccacaggcgggtgccaccggtgggtgccaccatgcctggctaaatttttttttgtattttttgtagagatgaggtttcttcatgttgcccaggctggtctcaaactcctgggctcaagcaatctgttcaccttggccttccaaaatgctagggttacaggcatgagccactatatccagaccatatatatgatcttgatagaagattatgctgagatgcagcactattcacaatagccaagatttggaagcaatctaagtgtgtatcaagagatgaatggataaagaaaatatggtatgtatacccagtggagtattgttcagccataaaaaagaatgagatcctgtcatttgcaacaatatggatggaactggaggtcattatggtaagtgaaataagccaggaacaaaaagacaaacttaacatgctctcacttatttgtaggagctaaaaattaaaacagttgaattcatggaaatagagagtaggacgatggttaccagagtctgggaatggtagtggtagtggggaaagagggagggttaaagagtactaaaaaaaatagaaagaatgaataagatctagtatttgataacacaacagtgtgattataatcaataataatttaattgtacatttaaaaataacaagtataattgaattgtttgtaacacaaaggataaatacttcacgtgatgtataccccgtttaccctgatgtgattattacacattgtatgcctgcatcagaatatctcatgtatcccataaatatatacacctatcagtatggatacctattataatgtatccacaaaaaaattaagaattaaaaaagatatatacattttaataacattatgctgaggaccatgtcttcatcatgtttgcacctccttcacttgcctggaatacttgcttaggacagagtaagtgttctgaacttgtttttgaaatagatgtatcatcccctctgctcttcttggcaggtctgtgtggcagcacattggtcatgggccaggacgtggactctgagggctaagtgactggtcaggagcaaggaaggcaagtcctgcttgcacagtcctaacttggtgccctctccccagaacccccaggccatggacataaggaaaggtcacgcactcactaagcacactggcagtcagcagcatcattgcacactttccaactgtttactgccagtattttaaactagttaaaaacttaactctactggtgaccacctaaagatcaagtttcagcaaagtgggacttcattcatttattgggcaactgagaggggtggggcagtgttctaggcactgggaatacagcagtgaacaaaacaccctcaaaatcactgccttcatggagcttcagtcaaacttgaacaggggttggaaaagaaactgcaaagtaagtgttcttgatattttgttgcacaatcagccaccccagactcagtgacttaaaggaatatagcagccatttccgttgcttacagatctgcagtctgggcagggttccgtgggggaaggcttgtctcagcttcacagggtgtcagccgaatgctggagcagggctcatgtaccatgaagaggacaagggccttttgtttgaaaagcagggtaaaagtgccattaaacatactgaaatagaaaacatttttcctttctcttgtggtctgtttctggacatgtcgtggtgttttcatttgcctcatattgatgggttccctcagggctgaggataattgctgggcagagcagaccgtcataggcacctgggggtcctgcctcagtgcccccatgggactagctgccaggtccctctgcccccctccagccccaggacagatgactcatgccttagctctgagtggggatgtcaagccagacttttccctttcgcttgggcccgccacctcaacccacagtggactggtgaccctctagggatttcagcctccgtgctggatgtgcttggtagctagattgggaaagggtaagggcttactcatacagagtcacctgtcatacatgtcagggttctgctagcccaggatgggacagccgcaacatcccacactctgaaacatcataggcatgtgtgtacccagccctctttgtgtctctctgccaggggcagatgaggcagccctcactgtgtggaggagccagggtggggccagggcgccaagagagtgggtagtgagtggctgagaacctgtcctggggatgtgggattacgcaggagctaaggatccaggtccacagctcatgtgccattgttccacctaaagaacacatattcacagataaaataagactgtgaccacagagcattaaacattgagcataagcccttgtgagcacagggccctggagcctgcgctgttctcatatccacggccctaagctggaggagatgcttccaggtgactgtctcccaaggccagtgggctggtgctggctgttgtctaggagcgcatcccaggtcttgggaggatagagttttctccatatgggcctcttcatgctactcttcatgtggctgggctttccttgcagcgtggtggctgggttccaggaaccagtcctgggagatccaggcagagctgcattgcatttttagggtctagctatgggaaccacagagtcacttctgacataactcttttgttgagggaatcacaaggacccagccaggttcaaggggagaagatacagatgtctggatatattactggggctgtatttttacaaaatactatctgccaccgtaagatggtatgtgagatggggatgagataggatgtgagatgtcattaactgtgatgtagaagtttgtgggggaaaacaggtttggggtgtgatggggaaaatcagaagtttggcttggacattttaaatttgagatgtcactaccttagtggagacgagaagtatgtattggacctgtgggctggtgtccatggaagagaagtctgggttggaggtgaaaatgtaggagttgtcataaaattactaagtgtgaatgtatttcctggtaggggacccctcagggattgcaattaatttgctattgaaggtgacctattcattttatgtttagactgatgatttagaaggttttattgtcaaatcttttcaacttatgtatttcgatagaaatgacagtcagccaagcaattttccttatgagggctctgagtgtgtgtgcatgcatgtttacctgcacatatgtgtaagtactgcattctagaaatctcagccttgaacttttccttatgatgttgtacagtctatggtttttagtttatgtgtattttgagatattcaaattttcatttacatagatatatgcattttacttattacctcgtaaatttttccaggcatactatgtaagatcaggttctagtttaaatagtgcttcaaagattgggaggcaaaattattctttcttctgtcttctggtgattttattttgcttgaagttataatttagaagagcattaaattaggatatttggaattattctttggaccttacctatacttgaatcagggtttaatagaatatattggacaggcgcagtggctcacacctgtaatcccagcacttttggaggccgaggggggtggatcatgaggtcaggagatcgagaccatcctggccaatgtgaagcctcatctctactaaaaatacaaaaattagctgggtgtggtggtgcatgcctatagtctcagatgctcaggaggctgaggcaggagaatcgcttgaacccgggaggcggagattgcagtgagttgggatcgcgccactgcactccagcctggtgacagagcaagactctgtctcaaaaaaaaaatagaatatatttaacttttattaatattctatgaatcataagtagcaaatttcctctcaaacagtaagataaattgactgatggcaaatgatgggatgtgttttgatcttaggagaaagacatgccatcataaaatattttaaagacatatcgttagaatacatttcatttaataaagaatgtttccataaaagacttgaggcaaagctattgaagttttatttaaaaagcattttattcctccttccgtgaagattttcccctttaatcttctgtgttttcctttctttcccactttctctgttccctttattttctcttctctttctgttcccttcctttgtcttctcttcccagaacaaagacctggattcttgcttgcaagggggagattgaaatgcaaatggaaaggaaaacacgaatgataacactaataacactcctgtccatgttactcccgcctttcactgtaactgaacctgaagagggagcaggtatcagggtgcttttgctagcataaacactggggcacccttatgtcttagctaactgttctctttgagttatttaatagaaagacaccagcgtctgacgagtcttcacagtactttgtcccaacactaggggcaattatatagatttaattccacctccaacagttctaggctgtcttctggaaacccaacacattgtcctctcctgatctttccagttcttagtcagtatatcaggaatacagtcttcagactaaggccctgctgtttttgtctaaacatttttgtttttatttatccccttcaagcaacatttttcccactatatccaatgtaaacaatttgcatagcagtttacaaaagggttgtaaaccttattttacttggaggttccaagaaaatcagcagacttcttgagagaactagggatttggcagggggtaggtgggaggtattaagaggaagtcaaaagcagggactgatgatcttattttagggctggcctgggaggatgctgggagtgtgccactccaggccatgtttcaggtgcacagtaattgttttgtattgaagcagattttcagtaaacaatactagggaccaactctgcccagctgagaggaaattaagcacagttacttgactgataatgatgccaaacagtttcaggtgttaggatttcattacgactgtgtgttgtctctggctgtacatttacattttgtgtcaggtatttcaaattaatcatgagcataattaatagttgtagtaattagattaccattttatgatgatatcatgtaacagaatatgaagcagcaggaaaaatgcggaggaccactcaggtctagatagaatcagtgttctgtgagacttatcaaaacaggtcagctctaagagttaacgtattgatgcttcattacacagcagcttcttattacaacaggtgcaaatgaagacaattttaatattaaatggaaccccctcgggcctataggtcccaaagcactaacacagaattattttatgaggataatattttaacaggcattctagttgaattataggttatttgataactgtgaagaagccagaaagcaatgtatggttttacatttcttaaaagctaaattgagttaaggatcagtgtgcgtaataagctaagaaaaaagggagtttggctttttagaactttaatgaattattgaacatatttcagaaagaggatctttaaacagcttttcgaatagctcttgttaacctaaagagacacttagtaaactatccataggctgatagaaaaaggacatttgcatggaagtcacttttttttttccgccatggtttgcctcggaaagatttcaaatgattgtataatgagggcagaaagttgcaaggctacatataaactgcatgctacttaataaattattcatgttagcccaaaggtataattattcagtgaaatgagaactcagaaaattagttctgtattaatgtttatttatactgatcattttttttttctttacatgctcacattttcctgctcagagaggtaatcgaagggcagtccacctacgtgccacaagttctgagtaaatgtggaatcaggttggaagtcccagggttcatagtgtcccccgttttttatttttatggtggtggttgtaatgtatttgcttttagagaaatggtttcttttgtatgaaagggaaagtcaagctcttattatttagcagtccttcttcaaagggtgtgcatggtgaggagctgcaccacggtggtgcccgcagacgctgcttcgtgtcccccatgacagctctggtgtgaatagtcacagtgccaccattttgggtcctggtaatggtggttttccccacttctgtcacttaccacccacagccttttctctctcagcccagagcagacaccattattcttatctttgtcttgtttgttattatgtagctctcagctgcaacggtatttaacacgttttacacatttttgttggatattccctgcttggccccttgactcctagagaagaatcctcagaacattaggcaggtgctcctttcgagacagacacaaggcagagtgaatcattcctctgccattccagaggctgcagtcctcacagtggcctctgagtcctgcatggcctggccccatcacctctgtgaccttctgtctctctgcccctcatgcagctgcctcctgccagtggggcctctgctgcctcagctccctccctggaggctgtaatggctgctttctcaccttcttaggtcctagtgtcaacttctcagcaaggctcaccctggccactgccacagaactgccattcctgcacccagaggcctagaacttccttaccctgagctgtttttatttctgcttagtcaccaccttctagaatactatataatttgtcttttaattatctttgttgtttattgcctgcctctctgcttgaacaggggatctttgtctcttttcctcaatgacatgtgtcagatgccttagaccagtgcctggcacatagtaggagctctataaacatttgttgaatgagtgaatgactgagtttcctgaaattcttcctggaaacactaaatctgctgccccagggtctgttagagagtgctggactgccatgctatgaatgctcaatgaccagtgtgggtttccagttatccttgaaacctaggaaagaaagggcagggagatgtgaaaccactgaagcagtggggagctttcggaggcttaggggagaattcagcagggggatcctgctggtcacaacaccgaatccattcctccattgcttcttggttaccagtcctttggaaagtatgcctctgcctggtaggagtgacaatactacgagagccacacatgtggcttgggtgttgagcagggatggccacatgtgtgttgaagccctgcttgtgtttaactgagagggttttgtgaactcctacaggtgtctgtccatttgcatgcctattgggcccccagtttctagagcagcattgattgccatagctcagctgatttataaagcatgtgcttgcctgggagattggggtcacggtttgcttggaaactttttgcagcaggaagcagtggagcagaagaaatttttggaagagttaaatgtcagggataaggctaaaggcaatgagctgaatcttttgtttcagtaaacttcctgatggatagctttgccgttccctccccatgcaaggcacatgtggtgagagggttagggagagaatgcatgctatcttttactttattttttttgagacggagttttgctcttgttgcccaggctggagtgcagtggtgcaatcttggcttactgcaacctccacctcctgggttcaagagattctcctgccttagcttcccgaatagctgggattacaagcacctgccaccaagcccggctaatttttctttttctttttttcttttttgtatttttagtagagaaagggtttcacaatattggccaggctggtcttgaactcctgacctcagatgatccgcctgcctcggactcccaaagtgctgggattacaggtgtgagccaccatgcctggccagccacaattttaagttaacattttctagtagccacatttaaaaaagtaaagtttaaatatattttatttaacttaatatgtttgttattattttaatctgtcattaatataaaatttactaatgagatattttacctttttttcatgaagctttcaaaatttgcagtgcattttatgcttacacctcaatttggactagccacgtttcaagtattcagtagccacatgtggctgataaattggacagtgaagctatagagagttccttgataacataaaaagcttatctctttgttatactttttacttatatagattctgtctttcttttcaaaaaagtttgatttaaagtatgttttcagcctataaattatgttgtagcatgcttgatgttatgaagtcagactgtggaacacagaaagaaaatgtgtattactctatagatgatcctgaatatgtttaatagatgaaaccattatatttctccccatttaataattgatgagtcaagaagtcttaaaggtatatccagtagaagcagagaacataggaactgagagatatataaatatctgatacatgtttttattttgcttaagtgacactttatagaggtctggtgtaagaattcatatactgtcgctcttttgtatgttgcaaaattattatcatttcaaaactgggctggaacttatatataggagttatatcttagactttctccaatgaattttggctaccaaacacctcaaatgaattctgcagatagtatttcaaggatgcttatggtatggtaagtgtaacttgattaactacagaagatgattagaagttgtaatagacactgagaatcctgtagtggtctttgatacccatgatagataagatgatgaaggtaactcttaaaattaggaataaatattataacattacatttttgtctttaaatttctgagcaaaacaaagttgatgacctttagatttaaaacaagaaattgttgtttaaagatgttaaagataaacatttttatcgttgaatgagtccctgagtttcagctctctttcacatcaggtctttagtttattgctttctttaaacatcatgcacctccttgtgctgtttttcattccccacccccgattcagagagacaggtaattatatacacaccagctaaatgtctggtaaaatctctaggcaaaactgagttgacttgtgtggaactgaatttaaaaatgcttgacggaatattgctccagtctctgaatacttgtcaggttgcatttactgcaattgcctccattaccaggatgtgtgctttggtcctgagagagacacttttccctgcctctcccccttttcttccttttcactatatagctctggcttctgaggggtcacagtccagcagttattcattttgtccctctgaattagaaaagaagtataataatttaactgaaattaggtttgttttaaacctaggcaactgtctttttatgaagaaaacatttacagtataaaataggagaatgtcacatgagctgtataaatggaatatataatagtgtggatgtataatgattatcatttgtaaggcattctttcaaaagtaagtaactggatttagagaaaattaacctttcattcgtaagtgaattaaataaagaattggacattgccaggtgggggcagagaaagccagagtttttaaattaaaaaaataagcaaataaaatctttaaacataaatggagataagatttgaattgtatcatatatggtaacctcttttttggctggtgtaccgaagtctaaaaatgtacaagtggtagagtttataaaaactcattcctacttggcaagggtaagaaaggaaggtggtcacctagaatcaacatttattaacttttaaacgtcgtttcgtagggaagaatctccctcctcaaagcattcagcctgagtttatttaggattcagttaattgaaagataatctgtggcatcgataggaatcatcattttccaaacatcttatttttagaaacgggcttcacaagctctttacaaacattggaatccatagtcattgaaatgggtggcgtgttttttcatggggattgtgaatcagtctaaagcaaaatatgtgtttatgatttgcatgtaaggtaactgaagtttagcaaaaacaataatttgtcatttagaaatgatcccagtctttggaaatatttagaataataaatttcaggttaagtttttttttcacggtttaatcaagttaagatttttgggatacttagtatttggttggctttactaaaagaaaaatatttattggcattacattaaactgcttaaaaattaaacgaagacctagttaaaagatgctggcattaagacatggttttactcaatttttatacctggaaccccaaaaggaacaaaaagaatgagaaacaaagaagaagatgctatgctctgttaaatagctacaacttcaaaccacattttaaagaatacctgccaaatagagtgacatttggaccaaaggagagaggatgctgtgagcttacatagtcctctaatttgaggcagggtatagttttctcaaggagtcaggcctgtagaaattaaatggcttcactaaaataataagagaatagaggggcgactctctctgtgcaacttagttgtgcaccacagaaaactggaggactcggaggtgagggaggaaaagagcttctgtgtagagttgggcaggctgtgacttaaacagctctagggatcccaggaacataaaagtctagtgagtggaggcccctgatgttggagcccaatctgcacgcacacctgcgtgcacacctaggccaccatcgtgactgagtgccatcttaatgtctagggcagcttcctgagagtgggagacttctcaaagtgagactgaaagaaggctcaggaaggtggtgttcaggagcctgtgacatgaggggcttctttctaacctatatcaatgctgctaaagttttacacttgagtgtaaaatactcccagggtacaggacttgaccatagtggagagaactggagattaatgctggacttgaagctggctgctcttcctatgaactgacaggttgtctccactgcagcatgaatgccttctagttctgcctgccacaccttggcataggcaggcaagttcatagaataatggaacacagacaaagctagatgtggaatatacatcagaagacaaattatctcaccaacaaaagaagaattcagaatcttagtattttgtggccttaaaggaataatgaaaactgggttttctcaaagtttaaaggaaagatatatggttaaagaaaataagaaatataggagatagaaagtgagctgattaatctgcgtgaagaaggagaaaaaccattaggaagagggaagtcacattggaagccaccaaatataacaaacacaaatgaaaacacaggaatcaacagacttgagaaacttctacaaaacaaagtgaaaaagatgagagaaaaaggatttctgtgaagatgatacataggagagacaaaggcttattcatcacatattacttgtttttccaaaggaagagaataaaaatggaaacaaaaacattcaaaggtataataggataaagccttgcttataaaaaaagaaagatgtatatgtgcttgcaggtcagaaggccacactatttactaggaaagaaactagaaacaaatcccaagaaatgtgctgctgagcggtcaaggacattgggaacaacaggactgagggacactggggtgagccacacggcctttggtagcctggtgaaagcagtgccaggagacagcacagcaagttgcaaggcactgggtagagcagagtggaggtgaggaaggggagaagagtacacgcagctcttctgagaagtttcatcatgaagaagctgagggagatgtggatggacctgaagggggagatgggactgagggagcctgtgctttttaagatgggaaagacctgcacatatttaaatacccctagtgaatgtgaggaaagagaagggggttcttaaccttgcctgcacattggagccacttggagtgtttaaaaaaaacactgatggtgggtcccactcagaaggattcctatgtcatcggtgttggggatggctggtgttgagatttttaaaactgcccaggtgattctaaaagggagctgaatttgaaaaccatccttgtaaaagatgaaacaaagcttcaagagttgggtttcctcttccactgtagctagaggaagtgatggaagtactttgagataggtaggtttgtgagaggggagctgaaggagttttactgcttatggcttctgcgttctcttgaagggctggtggtgtgatggggaagcatgttgggaggaagatgggcaggcactgagaggagaggagtgaatttgcagcactctttcatggagaaggagggagaacaccaaagaggtgttgaaccaaagggtgggcaggcagtgctgagaaggccgaagtttgagatgataattttatggaggcagctctttcttcttcctaggtagagagtgggcagcccataatgtgtggagaagtaagttttctagtgaagactagagaagttagttacttgggagattttcttattttgcccataacatagagaatcagacactggtagaaataaaatcaattagttaatacacatagtgcattctgttaaatcctgtctagctctgccttggtaggctcttaatcgtatttctgtagttacatagaaatgaagctgaacactatgattttgcttatagggaaaaacatgactttcagtcccagtgtttcaaacgcatcagtaggaagggctaatttaggcgccgactctttccttaaagtgaagcttttgttatattaatagatctagcctgtgattcttgtaaagagtgttgtaagttgacatggtaataactaagatttgaaacaatgtgcttacccaagctgtatcttgaaatacagtttgaatcaacttggaagaaaacctaaactaaattgggttttagtaaaataatcctgcttcgtaaatattacaaagaaaatgttatcagtctttttgggtattgttggcggagtccttagatcagagatttttgttttcgttagggccttccttctttaatgttttaaaaacattatttcagttgtgcaggtagtttgcattttaaatcatctcacacaacttgctggaaactgaaatggatgctgaggacatggtgactttttaagggaaagatgaataacatccgctgtgcgagagcccttgttccagagcacaccacatgaacaccagggcttaaactcaccaggagcccactgagagcccatgtatttagatggaaacaaaaatggacataaaaattaagtttgaaacaggtagtctaaaacatcaccgggagttcactaatgtcaggacagaataaacattgactactcaggacaagttttcagaagttccccaagccccttctcacttggttgggttctgctgacgctggtttactctgcatctcacccctttgcacacagtaacctttggagatattcggcatcgtagtaaacttggtggttgttggggaaatttttgtttgctttttcattcagcattttttttttttttgagacagagtcccactctgttgcccaggctagagtgcaatggcatggtctcggctcactgcaacctctgcctcccgggttcaagcagtcctcctgcctcagcctcctaagttgctgagataacaggtgcctgccaccacacttagctaatctttttgtatttttagtagagacgaagtttcactgtgttggccaggttggtcttgaactcctgatctcaggtgatctgcccgcctcagtctcccaaagtgctcggattacaggtgtgagccactgtgcccggcctttcagcatttttttaacattgtgaaatggatgtatgggtgatactgtgctaggcaccaaggcatgaagacataattcagacttggctcttattctcaagaagtggactctagacttttagaagcccagggaagcaaagacatttttcttggcttactcttttaagtgtttccacagtattcttagctattagaaaataaaaattatttattgttgcaattgttagaaaaagtcattcatctcctgtctcttggccactgtggagccctggcattaaggaaaaaaaagtttggtggctggcgatcagctataattgtgggtgtaaccttctcttcttctagggtgttggtgagctttagcctcctgtccgtcttgtcctttggcctgacttatactgtgttcagcttgcaaaggacagctgtaaaggagcagcatgaagccaaaatcaataatagtgatgtttttagctcagctgtcatctccctacccccaaacctcaccaaaattttatgtctcagacagtttgtcaaggacaaatgtttggtccatgtcccaccagggcaggttttctgtcagccaggagattctagctgtgtgtgtgtgtgtgtgtgtgtgtgtgtgtgtgtatgtgtgtgtgtgtgtgtgtgtgtgtgcgcgtgcacgcgcacgcgcatggattaggtgttaggacacccaagtctaaagatttaattgtacaaatcttactgacaaatgttttactgatttgaatgtgccagattatttaaaaactggaacaatataacagatgttttttaagttctgtgaatatgaaaatattttaaaaaggtgagtatgtttttagttctttgacaggggcttatatgtctctgaactgatattaattatctatgctttgctgttttgccagtgaagtcactgataagccaagactaggtccagcgataaaaattatttgggaatttagttcaggatttaaagagtggcatttcctctgacctttttttagagctgacactttgtggcaggccaagtgtaatattctattccttctaaatacccttctctttttctcatcttaaaatctttctctttcaaagctgatgcaacagtggtgtaaaaccacgttatttctagaattgctctgggccacctgatggtatacatatttcttacagtttacgaagtcctaccagattcttctctgaatatgaccacggggaattgtttggacattaacaagtgcattgtgtaagggaagtattttacttttcagcagtaatattagatgtttgtgaccaaagctgacgagtgattactggtttaacagccttatgtttcaacagatacagcataactataatgtttaaatatctgcagtgatggccaccaggactgaagtttctttctcctcttaccttgaacaagagaagcagaagggccactgtttacagggagttgatgagaccaccttccttagaaggcccttacttctctggttgatgaatgtcatactgattgcacccaagactgagttcttggtacacgtggctgggcaaattcttggaacaggtgtctgggctcatttccctgagtggcatggagagccttcttccatgatcaggcctgcaacttccctcctactcacttatgggcatcacgctccccctctggagcccgttcctgctatttctcctgcctgaaatgctctgtgcccctttccttccatctctgcctaaatgctgccttatcagagaagcccacacgccatgtaaagagcagtacccactcccttgtcctgttgcctatgtcccctaccctgccctggtttgctgtgtgggacttatcacctatcctattagatatctgtttatttatttatcatctctgccctaggtggaatgttaggtccacagagacaggatctctgtactcctcactgtcgtactccgggcacctgagtgtatggcaggcacttggttattgaatgaaggactgaatgaaggagtcataggggctctgtgtgtatttgtggaatgaaagaggggggaaggaaggacttgacacttagagcacctaagtatggaaggacttaggacattgtcccttggaaagtgggtggtgattgtcccggataaaggaaaacacccctccccacaaaggggttgccttgagaaagtgggtagttaggaagtcctggcttcacgctcaggggtagggtggctgtatgtctccttttccaggggatagggctcctgttgacacctatttctccagctaatgtttcaaagcaccctcttccattcttaaaagtttcccaatctgggtgataaatacatggtcacccacttaagggatttgattgcatcagggatggagttctgtatatgagaactacatgcagggagcactgagaggagtgactctgggagcacaggcattttgtacccttgcctggacggggccctgagggaacgggaggccggccttcagaggaccactgggcgtgtgcagttaacagtttggtttgtgtttttctccatgtttctctgtatacagaggtatataaatttaaatatgtacatacatatgaagtccacccctgttttatttttacagaaatggtattatgtcataccgtacttaccaaagtcttttttatttcgtatttcagaatatctttgctggtctgtacctattgatctccttcgttaccgttacttttaattgcagcataatattctatagatggatatatctgacttatgcagtcgtgcccctgttgatgtgctttcagactattttcatattctactgttaaaaatactttttttgtgacaaaagatatctgtatgcatgtatccgtatgctgagagtgggatttctgagtcaaagtgaatgtgcgtttttaaacagtcatcaccagatgctttccccaaaggaagtacagttcttcctgcctgcagcaatgttaggcgtgccctttcctcacatcttgcccagcagtggatgctcagatcttttaatgtttttctaatctatcaggtaaaaaatgagattatcttttcctttggctgtacatttttgagcctttatcatagagtcaagtgttgtaatgcattctgtaactccaagatatgtagcatttactaactgcagtcattcattaagtaaaacttagaccattaggaagatatactgtttaagtatttaaataactgaacacatcttcctgtgttttatcactttttttcatatctagggcatttcacatgtttccaggtttggttcctaggtatggctattaaagaactttcagatcaaggttgataattgggcatactgggctggggtgcagtggcttacacctgcaatcccagcactttgggaggccgaggcaagtggatcacttaaggtcatgagttcgagactagccttgccaacatggtaaaaccccgtctttactaaagataaagaaattagctggctatggtggcatgtgcctgtaatcccagctattcgggaggccgaggcacgagaatcacttgaacccgggaggcagaggttacagtgagctgagatcgcgacactgcagtccagcctcggcgacagagtgagactctgtctcaaaaacaaacaataaataaatacataattgggcatactgtaatattctcagagatctatatgtaaaatttgtatagtcatagttttatggtgggttataattgtctctagtagattctgtgagtctaaaacaataggaagactgtgctccattagcttgtcatgcaatttttaactttgacaatagactttttttgaaaaaaaaaatattttattttttgcgacaagatctcactcggtcactcaggctggagtgcagtggcatgatcacagctcaccacagcctcaaactcctggagtcaggtcatcctcccacctcagtctcccaagtagctgtgaccaccggtaagtgccaccacacctggctaatgtttttggattttgtagagacagggtttcaccatgttgcccaggctggtcttgaactcctggactcaagcaatatacctacctcagcctcccaaagtgctgagactacaggcatgagccactacgcctggctgacaataggctttatttactcatttattgagatacaattgacggaagctataaatgctaaatatttcaaatgtgaagggatgaaatgtgatggaggggcaggcaaaggagcagtggtgccaggtgtggattctgtgtagtgtgtgaatggcgtctctgtcccttaagcccaaggcaacaatgtgaatagccacttgcgtacagcagcgtgccatattcaacttggcaggtttccatccccaagggccttagtgtgttgtaaacactttattgattgatgttcaatacattgcagcacaatataagaatatattgtcatcatatagtgatgaggggaattgtgttgtggtgcctcatgtttgtaagggatgacatttcgggtagacgtaggaaaaccgtttcacatgctacaattgttgtatatttcctctgtccaattgcacatgggccagagacttatgtgtatgggaaatgtttctttgctgctttaccaggatgtcggtcattttgctcggatagggaaaactggaaaaagaaaaagaaaaagatgtgcccagatacttactggttttcggcttcctggtgaaagtactttatgaacatagtgaaatgtgtcattctttctaatccttaaatctgcataggccatgcccataaggggctaagtgtgggctatggggtgggagtgttgcttttccttcccccacccttgttcatgcctgtcttagcatgtgactcttgatagtgaacttgcccagatgcttcaaggtcaccatttcccatattctctggcagctgaagagctgtttggatcttggaatatggagtgggatgtttgatattgtcaagagaaatgtgggtgaacagtgcgtaggtcctccttgagcccctgggaaaggcttgacaccacaatttagaaacccttaactttcttaaggttaacatctgaagaaaagaagtaatttgttctgaggattttttttcccttttgtgatgtagttcatattttaatatgaatctcggaactgcctgaataataataataataataatggataaacttaatgagcccattttatcaactgttatgcattatctcatttaatcctttggtaactttgagaaggtactgatgttatcctttttgttgttgaagaaattaaatagcttgccaagatcaagcatgactagagagtagcccacactttataggacttggctgaaagcactttttcttaatgagcaaatgtgtaattgttggtttacagggaagtggagcctgattaatgtcggggctgttacacgggccatcaagttctctcctcatgatgatgtttttagcatcagttcgttgatgtgtatctctgctcagtactctttcacttcctgtgttttggaattaaagaggtgttagattccttaaaaaaaaaaacaaaaaacccttatttttgtttggaaatggttcccaaatgcactgctggtgtaattaccaaatgctgacttctagatagatagctatagtcactgcataagccacgttgctcactcaattctcaattgcatttcttttaataacaattccgaagttctaacattatttttttcatttctgtatcaaaaatgtggtcttctcatacctatggctggagataagtatgtttatggtttaattgggtggatataaggagaggggcccctggaagtccccagaggtctctcctggatgcttctcatgcactgacagtgctgtgatgagagtttgtgagtataacagaggcaaacactcatgagggctgataattataactaagtctggcacataggagcactatatcagtgctagatgtatgtttattcattttacctctacaaccctgtggggtaggtatgattatgattttcattttccagaagaagcagctgagattatatgttggtctcaagactgcacagctagtaagttgcagagctgggattccagttcagttggtcagattctttaaccagttcttaacctgcaggctagattttagccttatcctggttcacatgtatttaaatattctggccggaggataccccactaagtataaaatagctttgaaataaagctatttcaagggaatgtctaagaaggtatctgaagcatctaaatgaagaaactagcattagaaaacatactaactggcaattttatttagaatcatgtggctgtgcattccatttcttaaagatagtaaattttcttaagaaaaagaataaagaagaaagcctctagcatcttaagtttcactcatttctgctccctgacttttattaggttacacctgatttattttagctttctcagggtatgggacaattgtttataggattggtatggtgtctacttagtctgcatttgataggagaaagtatttaaactgctctttttgttagagatgacaaataaaaagacccattgtgttgtaaccatagggttgatgaaatttatgacctctttgagttagttttaaaatgtagcttaaaaattagacattatttatttgtaagaaatcacaaacatttgaggttcacaaataatttgctgaaggggcttggaggaagtcgtttatgattttttattttaaatggggctcagatgctgcctctttcctctctgtcttgggcattgggggggtgcaagttatgctggccagagggccctgagactgaaacctactctggatacttttttagtgttcatgtggtttagtatcctgcagtggttttggggtgagtgcaaatttaagagtaaaaagccagtttataagagagaagcttgttccttgtttgctttttacctgctgctgtgtaatgtttagcccctatttgaggtcatgtccatgaggcttagtgtctctgagtaatcaatgaggaagaacagtctcatgtcaggcttgccatgcacatttaatgacgactgcccatgaaatccctggcactggattggcttgccattttttttttttttttttttgagatggggtcttgctctgtcgcctagactagagtacagtggtgcaatcatgccttactgcagcctcgaactcctgggctcaagccatccatcctccctcctcagcctctcgagtagctaggactaccagtgtgtgccaccgtgcctggctaattaaaaaaaatgtttttatagagacagggccttgctttgttgcccaggctggtatcaaactcctggctggaagggatcctcccacctcagcctccgaaagcactgggattataggcgtgagccactgtgcccagcttggatcaccattcttaactgtaaccatcctttcctttctttcttcatcttcagtgacaagtaaagtatcttattggatgtgggagattggcataggaagttagagaatgacttcccaaagtcactcttttctgtgggaagagacctagaaatcctggtgtgagaagtaatttgaggggatcaagaacttcttgattaaaggatggatttgttttcttttgttgcataataaattgctacaaatttagcaaattaaaacaacactcacttattagctctcagttctgcaaggctgaagtgagcgggcttgctatgctcagggtatcaggaagcccagatcaaggtgtctcctgactcagcctttacctggaggctctggggaagaatgcacccccaggctcattcaggttgttgggggaatccagttgcttgtagttgtcagtctgaggttcctgttttctccctgatatcagcagggggttgctcgcagcttttcaaggctatctgcctgccttttcctgtggctccctccctcttcagggcctgcagtggtttatccagtggaagctctctgacttttccctggacaccagtctaagaaagcgctccactgagaacagcctcagtgattaggtcagactcagaaattagaatctcctattctgttttttcagttatggtagcctggtgtggtggtacatgcctgtagtcctagctattcgggagactgaggcaggaggattccttgagcccaggggttaaaggttgcagggagctatacaccactgcactctagcctgggtgacagagggagacctcatttaaaaaaaaataaataaataaaataaatgaatgaataaaataaataacatggtaagaacacgtaacatgggatcataagatctactctttgagcatatttttgagtgtaccatatgttattgttgattatggtacaatatagtacagcagatctctagaacttatcttggagtactgaaactttatacctgctgattaggaactccccatttccctctccccgagccctggcaaccgtaattctattctatgcctccatgagtttgaatgttttagatgctttgtataaatagaatcatacgctatttgtccttttgtgttggcttatttcacttaacaaaatgtccccaaggttcatccatgttatcgcacattgcagaatttccttctctttaaaggtgaataataatacattgtatgtatatgacacagtttctttatccattaatctgtccatggacattttggtcttttctacatcctggttgttgttaatagtcctgaaataaatttgggagtactaatagctcttcaggatcctgatttcaatttcttttttgggtaaatacacctaagtgggattgctggatcatatgatgtttctgtttttaatttttttgaggaatctctatactgttttccataatagcaaaaccaatttacattcccaacaactgtgtacaagggtttcagtgatactctcccactcttaaggccaactgtgccatctaacaacatggcaaaatcatgttatgatcattattatgcttatgatgataggcacacgattataaacgtaatcacaggagtggcacatcatcatagtcacgagttctacaggatgtgggatctggggtgggtaagtgcatttttaaaattccacccaccaccagggtcatctcagaatgcctccaagtgcccctgcccctgtctgaaccctgctggaacaagcccaagcttgtactgttatttgctggcctgatgaacatcctatttcagtagtgatggctaattttatttcatattaagggatttgtggaaagaaattttaactaaagtatgatcattgtatcttgatgccccgaagggtgtgagagattcttaaagatgatagtaaacgtattagaaaaggagcaattactgttctagctttgtagaactatttatatccagactcttaatgtgtattataggtgagacaaagacataatatggattagttcattgcttattttattgtgagaaggagtctatggaactgggtcactggaatttttacaaatataattgagattatggatcataagttagaaggttgattgtatgaatgggcaaatgtagcattaccatgttgatagttaccaagtcctagggccacacagcaaaagcaaaaccattagaagtagttttcctaaggctattggttttttttttgtttgtttgtttttaagtttacctcctaaggactcctcagagccactaggcaaggtcaggctgtaattcatctctagaaagagcacctgatggttaaaatggagtcaatatccattactttatcatagagatgatctcacaaaagggcacctgcatcatttagggtgctttggttgcaagcaataaaattggactgcagttcacttaaagcagaaaaggaatttattataaggacatgaggaagctcacagactctagtggcaggccagaaaactgggctcagaataaagattgagagagatagagggtagttttagggagcaggatctactatctaactactgccctgtcttttcagggcatgttgtaaaaaatgaaatagaatcatgtctctgtccttgcaccatcccagtcaagacccagagtcctttggagaaaggtccatgggacaaggatctcccaggtctgcacctgatggagggataaatccatcaaaatgactcgggatgctattactaaccaaagagagaatgaatagatgctgggggcaaaactctaaagcaaaaacctgatgtttactgtagaatctcttgttacttaaaatgctttctcaaaaactactcaaaaaatgcattgagtggtaatttaaaaaacacttttgccttaaacaatagtcttttattactacacaaccactgccttaaatcatagaaaccccaaagcactcctcccagttaagttagaatatttcaggcatattcttatttgcataatatcaatgaaatcctttgactagtgtataagaagggtccatttagcatatcatgatgaaaacggattgccaaaaaaaaaaaactgcaagcaaatacagaggagccaaaaatcattgtctgttatcctggagtcatgttcactgattatttatttgtaaggtgaatataaactacaaaaataatcctcattctatttgttgcatgataatggcttttaaaatgaacatttgtgtctaacatgaaaaaaacctctgtatctaacagtttatgggtaagtgatcatgttctaatagcattgtatcaaaagctgcttttctttataaatccttatatttaatccctccaaccagccaacaagccacaagcttcccagggaattaatttaagattgaagataaaaaagaggccaaagttaatgacatcagagagaaagctcctgaaagaagtaatagtttcaaaaagattttgactgttttataagacaaatataagctgtcgtagaaagaattgttataaaataaggttattgcttctggcttattcaaaatgattttttctagtttataacctcaactaatcttgtaataacattttaaagtaaaattttaatgtgtaccttgggaatgacactgaccagttttactattagattgcaaaaaatgttttaaatattgataatgtaattttgtcaagagcagatcatcacttttgatagcacagaattctatacttaaaatatgagatttctaaattcacagcaaaaaggattttgttgtgaatgagataaaatttaagatttaattgtggtctggcaaggaaataatagcataaaaccaccagggaaattcaaatatgataattttggtgaatgttctcaattttaaataaaaattttttaatgtaatgactttacctatggtgggattgaagcaatacattatttacacatttaatcttattttgatttactctaatttatttgatatcagcagcctgttagatgataatttaaaaatccgctgctaccatagttgctttaggaaaccttcctgatgataattttattcactagaataatttaagtttccatttaaaatgcgtatttaaacattataatgtgttggcagcagaagatgtttatatcaggtagaatgatgatttccttaatggacagcaataccgtacctcatattttatggtaaaggagatggattaaaattactttttactacatgtaccttctatgtttgcatggagcataaacaaggagctataagattttttttttttttttttaagacggagtctcactgtgtcaccagactggagtgcagtggtgcaatctcggctcactgcaacctccgcctcccgggttcaagtgattgtcctgcttcagcctcccgaatagccaggactacaggcacacgccaccatgcccagctaatttttgtatttttagtagagacagggtttcaccatgttggccaggatggtctcgatctcttgactttgtgatccgcccgtctcagcttcccaaagtgctggattacaggcatgagccactgtgcctggtcaaaatttttttaaaaattaaaaacattctctagtcgtgccttcatggaggcatactgagcatatggcatcatattttgtcacactctcacgtatctgctagtgtaagctacttcccagcccggtagcacttttgaaagacttacattgggctttttgtggcggaaatggggagcaggatttgttctttgtctttctgaacctgttttagcactgcacaccctctcctgatagtgcctgtggcttctctaagggagctttattcctcagagaagaaacctctgctagaagaaaggaaagagaataatggagaaggaaagattctgtgggggaaatacacaagatggtccttccagaaaagctgctcagacatctgaagcttttgtctatgagtattgttggccaattgttggaggactgaggcttctacctttcttcctgcgaaggtcgaggacaggttaggtgttgggtaaaactaaaccccagatgatggccttcaggagtattccaaggtcagcatgtgatggggagagaagagttgtggaagaagactttatgcccaagactttgggaagagagtagtccaggccctttccagggatttgctgtaaggtgacacctgttccccttctggcatctctcatcccgtgcgtttgacttttgttggaacatccagcacggttggttgtggccaacttgtcaggaataaatttattcctgtatttgattttgtcagccagggaagatttatgagacagagctgctgtctggatatcccttagaaggagacagtgctcctggtggcttgggtggcttcttgcctctctagtgctggaagaaaccctcagccctggtgactgtgagggaggtttcagcaactaaatgcaaaatagcatactgatctagctttaagaatttcaggagttactcatttagtttttattttgtgcctgtagtccaaacaggatctcagctaggaatatggcatgtcctgttcttaaggatctgattataatatggaaggaaagaggataggtatgtaggtaattcaagtataaatgccacataaatgagatataaagtaactgggattcatggaagaaagaactgcatcctggttgacgagattttaaaaaagtttgtatcaatcaatcaaaaactttgtgtcaatgcagagaagataagttaaagaagaaggagcagctgtagaagtccctgagttctaggcagtgtcatctcagactgttcgggattgggctcaaagggctggaaaggtctcaggcacatcaggtgcacgcacccttggagccacagtagcaatgccctccctcggcccaccccatgtctctttgaggtggcttttggattttctcctcaccaaggaaagatgttgatctcctcatacttaggaaatactccacaaatgcttttaaaattccaatgacatctacgctagggttacagttaagccctatggcctcctgctcattttttaatcaacttgatctcaggcctgaaagtaaccagaatgttcatgtgtactgttcttccatgaggtaattaattgaatgagcaggatgaatgggaacttgaaattaacaatgagctattgaaaaaataagcaacaagtaataattgctccattaatggactttccttgtctgttgacatgactgcctttattcttatttactgcactcgttaagatggtaataagtattatcttttaattttttaaaaataatattcttaattcatattggtggtttacactcagtgtttttactgaataatgtgccttcctacaaagagcttaacatgaaggtgataaatcattatcctttatcactcattgctctatttacattatcttttacattcacgtgccttaggcatttatactgtataaagagactactgtatggacactttgtttttttaaaaagtatcatcagaaatcaaaggagggatccatttgccaaatgggcaccataaagaccttttaataacagctacagaaatcaatctcattcagcagcaaatcctgaattgtgatagatgatctgtatatcatcaaagctacagaaagctagacttctctgttaccattcctgtctagaagagcacatgtaaatacacatagattcacaatggccctcttgctagtcacaggtggtcaccagtgtgcagtggaagctgcatttctgtaaggtaatttgttagttgcttggaatggttttcttaaaagaaattgtgttttaaactgtagttaggttctgaggtcagctctcaaggtacatagttaaccattgtgtattcttccattgttctactttatatgttatttacattattatacatatcacattattttatactttcttttatttgttggaatggcttactgggctgagagtaccttataaacagggacagtgtgtcttaaaaagtgctcaggcctattcttggcaaatatgatttgttaggtatttttaaagtgaatgaaagttgacatttaataggttctagagaactatatgtctgataagtgttttcaagagagaagtttattcagaatttcaagtctgaaagccaggaaatattcctggcatatataaattgaagaatgtctgcaagtgatatagttcagtactttaaaattatggttgttacctaaagttcattaactcttattgccttgataaagctcttcagggaaagcctaacatttcttcagctacatagttatcagaaataaagagttagtactgagcttcagggcaggccttcttcaagtgtatacttcttttctgattcaaagataaattaagttatgattatatgtatattgagttctttgggtttttttggaattttaatggaatgtgaaacatgccattacaatagatttcaaaagcttagtcctataacacagaaaaatatttacctttttttcactatggaggtgagggtatttctgagatgccacatctcgactaagtaatttttaaaagagaattattcagtaaatgttttgattttatttttttttatttttaagaccttgcattattctaaccaacttctttatagggaaatatatgtaaatcagagtgcttttgcgtttggaaatattggaagcaaaaattccaaaatgttttatgttgaacatatgggaacagcatggaaatttgtgagcagtgctttaaataaaaacctgaatcatattatatgtctatattttgagatttaaatctctgttaaactagccccattctgactgccaggcatttgaggagacaccatgtcttaattttctcttatctcaagtgacactcacagagcctggtacataatagagctaccgatgtttgtgggaggagtggagtatgaaaactgactttggcatgttgaaaaccaaattcggtatttcggtgccttttctttctgggatattatatctcatatagtcctaactgcatattaaaatcagtgatggtacctttgatcaagcctgaggatattaaataactttaagaagtcagagcgtgaggctaggcaccatagttcacacctgtaatcccagcactttggtactttgggaggttgaggcgggaggttctcttgagtccaggagttcaagactggcctgggcaacatagtgagaccctgtttctgaaacagaaaaaacaaaaaacaacaaaaacaaaaaaacaattggtcatggtggcacatgctcgtagtccaagctactcaggcggctgaggtgggaggatggctagatcccaggaggttaaggaggtgggaggatggctagatcccaggaggttaaggaggtgggaggatggctagatcccaggaggttaaggaggtgggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggctatagtgagccaagtcacagcactgctctcccgcctgggtgacagtatgaaacctttcttaaaaaactgggtattagagtgtggatagcagaacattttaatgggattaaaaaatgtattcctttaatggtattattaaggggccaccaacatttttattttgaatcattatgtgaaacagttggataattagaaatttttcagtgatttgtgaagccagccatgcttattcttgagttccttggatgactgctactatagtcacaaagtcctatcttcctctgttttcactggtttaaatcaaatcattgtttttctaatgataacagcaacatgccatacctcgtgtccaccacaatgtatggattacctgatgattggagagaaatgcagtgactctggaaatggcattattgtgatgtatatatgcatgagagatttgggtgagagatggtacatttatccttccttaattaacttgccaatgagaaagagagagttcaagaacaaaaccttggaagttatggaagaatctgaaaatgatgtcctggaattagtttgcttatattttgggagtaatttttcaggggcactgaatttcacatgagcaccttaccaaatgcttacgtgttgtgtagcactaatgtaaacactgtaaatggtcactctctgaagatcagttatgatgactgtggctagcaggccgagttggactgcagaccagcctgccttgacattgcttattttattcttaagtgagggagactgatctacatgaatgtgtttttatacaaagattaacgggtgacattggaggggtactacttgatgaacactccacatgcaggatcttattcttcttaccatccttatgaaggtaagagctgttcttatccactgttacatagggctcatttgatgtaacttgtccacagtctcacagtcagtatgtggcagaataggattggaaaccagaccattcgatcccaaagacctaccttcctaccgtttaataataccctcctgttccagaaatatgcaaaagccaatgacaagacataaacaggaacatatggtaaattggtaaccagtaacatatgcctaatatttgaaaacttttaaggtaattcactccttctgccaaaaagatgtattgactacctaccatgtgaaatgctgtgtggcgtgtatacaagtcccacttaggttcttggttcagggactgagttgggtgtaatagaagcaatctgtaatatcaatgaagaactctcctacaaagtgggagattgctgctattaaaggactgaagaagagagtaaatacacttaaggaaaatctgggaagacatcatggaggaagctggatttgcactgggcttgggaaggccaggaagttacctgagatgcagacacagggtggggttggggcactggggtgaaggaaggtggcacagctatgaacaggagtaggggaaggaagagataggactggcgttttcaaaaatgggaacagtagtgtgaatgaatcgtaatggagcaattctgtggtgccgtatctgagcaagccttgatacctgactactactcagtaggccgtggggtgtcacagaaatccttggagtcatgttgctttctgccatgccagtgaagtgatcaagtgtgacacaagcaatcacagaagcctggtcatctgcattctggcagtgtggtcttctccaggcctaatgacatctctgtttctgttacgtttcccttgtattgtcaacttctcttaaacttgaggactcaccagccctagaatggaggaggggagtgtgttagtcttagtgaattccatgtgtctcatgtttctaagtcactttccatttcatgaaacattgtgagaaattactggtgtataatgatgactccgcctcatacagagaatgcttttgaacatactgcctttgaatttgattaggtgtagacagtcaatagtaggaaacgtaggaaactcccttcttccttccttccttttttttttttttcgacagagtctcgctctgttgcccaggctggactgcggtagtgcggtcttggctcactgcaacctctgccacccgggttcaagtgattctcctgcctcagcctcccaagtagttgggattacaggtacccaccaccatgcctggctaatttttgtatttttagtagagacagagtttcaccaggttgtccaggctggtcttgaacccctgaccttaggcgatccacacacctcggcctcccaaagttctgggattacaggcatgagccgccgtgccgctggaaacccttttccacagccgtataaaatatctatagaaggaccaagatataagaatgggtgaatgtattcatgaaacatttatagctcttttagagaatgtgaggtcaggatcaatatatttaaaacaatattttttaaattgaagttaaaaaaaagtaaaaagaaagaaacagaaacaaagctttattgaaggcttactgacgacttactacaggcttccttagctcctgtgctaagtctttcctaagcgcttttccatttaatcctgacagtcgccatgagaaggagggcttgttgttatccccattttgcagatgaggaaacagaggtttagagtgtgatttactgatactgtgtaactgctcagtcgcaaagtcagggttggaacacagcttggcctcactccccatgccgctgttttctaacgtctcctgtaagtggtgcttcggctcgtaatgccagtaaaatcacttatcaagcaaacctacaaaccggaaaggagtcccaggtcgtttatattctttctgacagaaaaatgtatgctttagatgtaagactggttttgataatactttgctccttttggttttgtctacatgaacacaatgcagcgtatggtttgggtttcttcgagtcactagagatgggctgcctcacaatcatttgtgttattgcatctcatgctgatcaatggaccacttattgcttacatgggtttgctggggatgttgggttccaccgtcttgcagttatttctgaaagttttaagtgcattcagccacacatgctattcagtaagtttacaacaatttgctcaatctttctgtgcatcattttataattttagagctttaaaaaatgctcttgtctgtttttgacatagagttgtttattttctatttacatggtattcttgtttagttttcatctacctcagaaggctttcatatagaattatctgctctgttggcttctgcagagttagcaggaagagtggcacttagtgccaggctgcatattaaggtagttcgagtggtatggcccacaactgatggccaccctcctgtcaaaatgtggtctccactttgtatcatccacaaagcagttggattctgattggaatactgacattgttctcataatcatttaaagataaatgggctaaaaatgttgcataaattctgtgttgtaaaatttattctttcgaaagttcgtttctcagtgccatagatgacactgacagcattattaatactttcaatattctagtgtcagaaatcatttgatgtcagtttaatccttttaatggttaatgtcagcattttagcatgaacgtttaagtgtccccaaagattgggttgattattcttcatcaagtaggctcattttaaagtcaagaaaatggctcacttgtactatcagctatgccttttcagggttttttcttctttaaatcaaatcattacaacttactatgctgacactgagttatagatctattttgacttactttatttcttaataagatcataggaaatctttttgcaaattaggcctttggaaaatgaaaacaatctcgtgtttctgtgattctaacaatgtgtttaaatcttagtgcatgacatctaaatttgaattttcgtagaaacaggtttccagagtgtattttcatgtttttatatatgatactctgttgtatttatatcacagataattatttgaatcagatttatcacttttctggcatattttgaaatagtcatacatagaaatgtggaaatacttcattagctgtagaggtgcaaatgtaccatataagaattatttgaaaacttatgtgcattctgagtatcagtacaggacttgggaacacaggccacatgtggagtttggtggtagactgctattgtttcaaggggcgaggatgagattttgttgtggacaacttcagttcatccaacaggtacactgaaccactcatgtcttccacggtgtcccgtctgttcttgcatgttcctctgccatacaactcacgaactatttgtgcacatttttttgttaacacatcaaacttgactacaacagaaccaaatgacatagtattctgtgttttcatagcttccagttcatgctgatcatcctattgctgggtttttgtttatgcatgtttttatgcagggcctgtcgatgggggtgtctttactgtgcgggctttatgtttgcagatgatccatagaaacacaaacaagaaattgtagcagcagtatttcattcctaaagctgaatgatgtcaggcataattactgaaactaacatctggagtggtttattaaagggaaacctgccaagattgttagcatataccaaacagcattatccatatgtgccattttatcactattgaatgtcggggtgtgttagtatgaagggaaatgaataaaatccagcaaaggatcactactaacacattatcttcccagaactgattttagtttagctcgatgaagcagtttgctggagattttcaaaattgtgcccatcacccatctggagggtttctgcatacctcggtacctggttatttggtcttgttagaattaaaatgtaccccttcaggaaagttctcttgaattctttttttatgttcctgaatcctagactataaacaaacaagcaaacaaacaaacaagatatcagatattaattgaggacccactgttcagtcttgttgaaaacttggcacacatgcttgaggagtttaatagggatcttgtccagtagggcgatgaaagaacactattgtgtgattgtcagatttcttgaagtagtactgaattactactgttcactcttttccttagaagacatctcaatggttgaatagagagtcttaaggcagcgaggtgatccttgtcaaactatgagagtttcaatccttatgagtaatatagctctaataattttgccattcagcttatttacagagtaatctagagaggctacaccaacctggcatggtaaatgttgtcttccttaggcacagatagaggatgtcatgccagtctacattctgtacatggagatggaggtggaattcatagatcttcaaaaatcatactaggacagtttttgatacaatggaaaagaaagtgttctccagaaaatgctcctaagttctcctttgtgccaattattgccaagtggtaaaaactgaaaggcaaatgacattgctgtcattttgttctgttgtagtcaagtttgatgtgttaacagaagaaatgtgtacaaatagttcgtgagttgtatggcagaggaacatgcaagaacagaggggacactgtggaagacatgagtggttcagtgtgtttactggatgaactgaagttgtctacaacaaaatctcatcctcaccccttaaaacaatagcagactactaccaaaccccacatgtggtctgttgttccctagccctgtactgatactccatttctaaattctgcaccaatacagtggctccacagctgctactgaatatctagcaatagacaccctgctcttaaatggctctggaggtgaagcttccattacttgtttttttcctgtaacagcttttcagagaaataccatttggctcaatttactcatcatcctaatcttagaatttccatgttttacgtagttcaatttagtaaacctctcaatttatatcattactttatcaatccagcatcatgataaaaggaagatgtatcacatgaataaaattttcttggatgatggaaacttacctcattaagtacaaaatatttcattttatgggataattgtctaaaatatattactgtatcaggcttctaagatcttagtgccatctttattttctgagtatatatctagaagtggaattcataagtgttagaatatgcatttgtttaaattcagtaacacaagcagttttccaatgtgattgtaaaaattttactccctcaacagtgtaagagtgttttggtttttgcacatactactaacacttggtctgtcattttcgttttctccattctggtggttatgtggtattgtcacattatggggctggttagcaattccctgatgactagtgaagcacctttcttatattattggccatttggatatctttgaaggatctattcaagtattttttgcatattttcattgaatagcctatcctttaaatcaggggtccccaacccctgggctggggaccagtaccagtccttggcctgtaaggaaccaggctgcacatcaggacgtgagtggcaggccagggagcattactgtctgagctccgcctcctgtcagatcagcggcagcattagattctcataggagcacgaactcttttgtgaactgcgcatatgagggatctaagttgtgcacttcttatgagactctaaccaatgcctgatgatctgaggtggaacagtttcatcccatggaaaaattgtcttccacgaaaccagtccctcatgctgaaaaggttggggactgctgctttaaatactcattagggtagtttctttatgttctggaaataagtcctttgtcagatatacttatcgaaaatatatttttctacttgctaggttgcattttcactctgttaatgatgttgtttgataaataaaagctattaatttatttttatttatttattttttgagatggagtcttactctgttgcccaggctgaagtagagtggcgcgatctcagcttactgcaacgtctgcctcccaggttcaagtgattctcctgcctcagcctcctgagtagttgggactacagccacgtgccaccacacctggctaatttttgtgttttctagtagagacggggcttcactatgttggccaggctggtctcaaactcctgactgcaggtgatctgcctgctgggattacaagtgtgagccactgcacctggccaaaagctattaattttaatagagtctaacttacaagtttttttttttttttaatagttaacattttctgtggcctgtttaagtttttttagcctatgccagggtcaccaatatactctgtgattttccgtgaacactttattgctttatttttcacatttacacttgcaatccatctggaattggtttttgtgaattgtatgaggtaggatcaagctgcctttcttccacattcaattgatccagcaccattaattgaaaagagcatcctttccctcattgcactacagggtcactgttgccatacatcactctattatgctgcctttgtaatggaaaactataatgaggacttctagaagtttgtatgtgtcacaagttttgtttcttaaaaatgtatgtgttagaatatgcaatcagagtcagttaatgtggaactccctgtcttgccatgccaacatgaaaataatagataaaatattttatagagataaatatgtatctgagattgaaaataaggaagaaaaaatctttagctgccaagaaagaagttaagactctcagtgctgagagagactgaatccacctaggtgataaggtgactggacccagtaaaccctttgtgtgctggggggttttatgccttgtagaacccagtgtgagcaagatttgggtaccctacatacattcagtagccaggaaagggtgattggattgccagactctgcctgctggcaaaaggatgagctgtagaagctgaagtcctaggtagtagatataaagaagacaaattaggtggcaccttctagactgtgcaatgcatggatttggaattgaatttttcctctaattattctagggaaaccctgggctaagaaaccaatgtaaaacctgatgaggtagtctgtagtcacactgggtagaggtagaggcaaccacaaaattattcttaagaatgcctcccaggcgcctggaagatgaaactttctggtgaatatgagctcatggtaaaaatttaggtcggatgcagtggctcatgcctgtaatctcagcactttgggaggctgagggaggaggattactttagctcaggagttcaagactagcctaggcaatatggcgaaacccatgtctacaaaaaatacaaaaattatctggacatggtagtgtatacctgtactcccagctaagtgtgagaattgcttgagcccaggagacggaggttgcagtgagctgagatcgcaccactgcactccagcctggcaacagagccagagcctatctcaaaaaaaaaaaaaaaaaaaaagaaagaaaaagaaaacaagaaaaaaaaagccatgtgcggtggctcacatctgtaatcctagcactttgggaggcctaggcgggcggatcatgaggtcaagagttcgagaccaccctggacaacatggtgaaaccccgtttctactaaaaatacaaaatttagctgggcatggtggcatgtgcctgtagtcccagctactcgggaggctgaggcaggagaattgcttgaattcagaaggtggaggtagcagtgagctgagatcacaccactgcacgccaactgggagacagagccagaccgtatctcaaaaaaaaaaaaaaaaggctggatgtggtggctcacacctgtaatcccagcactttgggaggctgaggtgggtggatcacaaagtcaagagtttgagaccatcttggccaacgtggtgaaaccccatctctactaaaaataaaaaaaagtagctgggcgtggtggcgcgtgcgtgtagtcccagctactccagaggctgaggcaggagaattgcttgaacctgggaggtggaggttgcagtgagctgagattgcgccactgcactccagcctggtgacagagggagactcgtctcaaaaaatatatatataataataaagcatattgaggagagaaggagactattatgagctttcaaagataataagcaggtaagtatcaaaaaatgatggacttcctacagactattttttattattattatactttaagttctagggtacatgtgcagaacatgcaggtttgttacataggtatacacgtgccatggtggtttgctgcacccatcaacccgtcatctacattaggtattactcctaattttcccctactccccaaccccctgacaggccctggtgtgtgatgtccccctccctgtgtccatgtgttctcattgttcaactcccgtttatgagaacatgtggtgtttggttttctgttcttgtgttagtttgctgagaatgatggtttccagcttcatccatgtccctgcaaaggacaggaactcatccttttttatggctacatactgttccatggtgtatatgtgccacattttctttatcctgtctatcattgatgggcatttgggttggttccaagtctttgctattgtgaacagtaaacatatgtgtgcatgtgtctttatagtagaatgatttataattctttgggtatatactcaataatgggattgttgggtcaaatggtatttctgcctctaaatccttgaggaatcgccacactgtcttccacaatgattgaactaatttacactcccaccaacagtgtaaaagcattcctatttctccacatcctctccggcatctgttgcttcttgactttttaatgatagccattctaactggcatgagatggtatctcattgtggttttgatttgcatttctctaatgaccagtgatgatgagggtttttttcatgtttgttggcctcataaatgtcttcttttgataagtgtctgttcatatccttcacccactttttgatggagttgttagtgtttttcttgtaaatttgtttaagtactttgtttaagattctggatattagccctttgtcagatggatagattgcaaaaattttctcccattctggaggttgcctgttcactctgatgatagtttcttttgttgtggagaagctctttagtttaattagatcccatttgtcgattttggcatttgttgccattgcttttgttgttttagtcatgaagtctttgcccatgcctatgtcctgaatggtgttgcctaggtttgcttctagggtttttatggttttaggcctcacatttatgtctttaatccaccttgagttaattttttaataaggtgtaaggaaggggtccagttttagttttctgaatatgcgtagccatttattaaatagggaatcctttccccattgctgtttttgtcaggtttgtcaaagactgggttgttgtagttgtgtggtattatttctgaggcctctgttctgttccattggtctatatatctgttttggtaccagtaccatgctgttttggttactgtagccttgtagtatagtttgaagtcaggtagtgtgatgcctccagctttgttctttttgctcaggattgtcttggctcttttttggttccatatgaaatttgaagtattttttttctaattttgtgaagaaagtcagtggtagcttgatgcggatagcattgaatctgtaaattactttgggcagtatggccattttcatgatattgattcttcccatccatgatgagcatggaatgtttttccattttttgtgtcctctctcatttccttgagcagtggtttgtagttctccctgaagaggtccttcacatcccttgtaagttggattcttaggtatttaattctctttgtagcaattgtgaatgtgagttcactcatggtttgcctctctgttggtctattattggtgtatagaaatgcttgtgatttttgcgcattgattttgtatcttgagactttgctgaagttgcttatcagcttaaggagattttgggttgagatgatggggttttctaaatatacaatcatgtcctctgcaaacagagacaatttgacttcctctcttcctatttgaataccctttatttctttctcttgcctgattgccctggccagaacttccagtgatgtgttgaataggagtggtgagagagggcatccttgtcttgtgccagttttcaaagggaatgcttccagcttttgcccattcagtatgatattggctgtgggtttgtcataaataactgttactattttgagatactttccatcaatacctagtttattaagagtttttagcatgaaggggtgttgaattttatcaaaggctttttctgcatcttttgatataatcatgtggttgttgtcattggctctgtatatgtgatggattatgtttatggatttacgtatgttgaaccagccttgcatcctagggatgaagtcgactttatcgtggtgaataaggtttttgatatgctgctggatttgcttcgtcagtattttattgaggattttcgcatcgacgttcatcaggcatattggcctgatattttcctttttgctgtgtctctgccaggttttggtatcaggatgatgctggccttaaaaaatgagttagggaggatttcctctttttcttttatttggaatagttccagaaggaatggtaccagctcctctttgtacttttggtagaattcaactgtgaatccatctggtcctgggctatttttggttggtaggctattaattattgcctcaatttcagaacttgttattggtctattcagggattcgacttcttcctggtttagtcttgggagggtgtgtgtgtctaggaatttatccatttattctagattttctagtttatttgcgtagaggtgtttataatattctctgatggtagtttgtatttctgtgggatcaggggtgatattcgctttatcattttttattgtgtctatttgattcttctttcttctttattagtctggctagtggtctctctaacattagatgaaagaagacatcgaaatttgaagtgcaaagagaaaataagtgttaacctagaattttgtatcaagctgaattgtcactggggattaaggatgagtatattttaaaacatgaacggaaatatggtatctttatatcaataggcaatgaacataattctaatttagagataaaaatttaaataataattgtttacttatttaaatctgtgaaactgagaaagattgaaaaatatagtagacaatcttgttgacaagaatcttgggacatagaacaacttcacacttagctgggagatttacattattcaatttttagagaaaaagtgacaaaggccttaaaattatgtgaggcctttgaacctgtagtttcactatgtgatatattctgaggaaataatatttaagcatttagctaccaagtgagtttaagagcttgaatttgaaaataaagtaaatgtgaaacatagggggatgggtgaaataaattgttaaatccatttaatagaattactgtacattcactagaaacaaattttttaacatgtcatttgataagaaagaacatgttcaatgaaataaatatatcaaacgagaaataaatacaaattgtgaatagcatgacctacttttacaatagcaaataagtatttatatctaaaatatttgaaaatatctatttatctatctatctatctatctatctatctatctatctatctatctatctgtctatctagctagctagctagctatctttctgtctctctctctctatcttcctatctgcctctctctttctttctctttcaaagttttaatggtggttgtacttaggtgttaatattgtatagttttaaaatattcttcattgcctatgttttattatttttctaaagttggattataatgttatataagaagagaagaaacctcatgttggagaaactcaaaccagtgtaattgttattatgtagtattgaatatacacattgactttacagtattgttgatagacagaacctgtctgctgtgttggttcatagtttttttgttgattttaaggattaagatgaatttctttctttctctctctttctttcattctttcttctttactttctttctttttctcttttcttttgagatgaggtcttgatatgtttctcaatctggcctcaaactcttggactcaagtagtcctcctgcctcagcctcctgaatagctggaactacaagtgctttctctaagatgaagttatttctgtgttttcaagtccactagatagttttcatgtttttcttacagtttctttaataacccaaatgatacaagagcactatagtgatttatatatatatatataaaaggtaacataccatatataaatttatatatttatatataatatatatactataatagaaaacatactatatatgtgtgtgtatatacatatatatagagagagtatgatttttgttaccttttaaaatagttctttttgattctctattcttaaaagcctttttatatttttttccagtattgttttgggtccagaccatttgagagtgacatatagaagtcatttgttacacgcatgagagtgttagaagtgacaagaaagaggcaataaagagggttttctggatggggtcagtttttaattccttattgagattttacagtagctcaaaagagatgcctgttgcaggccagttatgatggttcacatctgtagtcttaaaactttgggagccaagatgggaggatcacttgagcctgagagtttgacaccagcctggacagcatagggagaccctacttctacaaaaaaataaaaaaaattagccaagagtggtggtggtgcacctctgtaatcacagctaattgggaggctaaggtagaaggattgcttgggcctgggaggtcaaagcttcagtgagctgtgatcatgccactgcactccagcctggatgacagaacaagaccttgtctcaaaaaaaaaaaaaaaaaaaaaaaaaaaaacaacaaaatgtgcctgtttccattagaagataatttataagggattggaaaccaagattctggtatggagggatggactatcccagcggaacacaatgaaaagtataccttgttcttgccaataagaaagaaagttgcttctacctgtgttatgagattacacttaaatatactataaatattgagaattttgagagtattagcagtgagttaggatttttaaaaaactatggaaagaaaacatcaattattaatcctttgacgttttaaccttcctaggagagaaattttttcttttgagggtagccttgtaaacatacttccagattgggggataggggtgagttggggtgtggacatgaaacaaatacaaacattgacatttaaggcagtcatttttagaatattgttatttagtaactcttgatgtctggatttcttatagagataatgaaggaggtagtttttaaaacctgcctcatgtataagagaatgtttaggaatctctttataggaaaatataaagcattattaattacttgagcttttaaccttttaactttgtattatagaagtcaaaatcatgaagggagaaaagtgtttcattaatcactacaggatatttttcaaaatgagttaatggaagtttactctgggtctttaaacaaaatataaattgacataccgtgccaggtatctaaaaatactctgtttagggtcagaagcatgatggctcatacttataataacagcactttgggaggctgaggcagggggatcacttaaggctggaagtttgtgagcaacttgtgcaacatagtgagaacccttctctaaaataataataataataataaaattagctgcgtgtagtggtgcatgcctgtcattccagctactcaggaggttgaggtggggggattgcttgagcccaggaattcgaggctacggtgggctatgatcatgcaactgtactctaggctgggttacagagtgaggccctatctctaaataataaataatgaatacataaatatctactgtctcatactttataagatatgttcatattctttgtgttaactggagtttagggagagaagcagatagagtgggattaatacttgatggggaagccccaaactagttctggctctaacagtaacttggtatgtggcttagaaaaacactcagcctccttgagttcagttttttctcaatttttgggagagggtttaatttattagtgggtgatcttcaaagtccctgccactacaatatttcatttctgtgtgcagacacagtgatcccaaaagttgacattctgtctattgactgtttctaatattctgtatccagaattactttagcactagaatattgcagaatatgctactcaaaagtgtttttgattatttttacctagctgctttattaggctctttcattggcttttagaaagcattcagtaaggtttttaaatgaagtgaatatatagattttagaaatataagttaaacagaggttcaagtatatatatttttggtaccatgtccagcttttacaatatcatattgagagccttaactgtaaccaaataacgttttccagtctgtgtttaactatacatcaacccagtggatggttcataaagagtataattgacagctagtaaactcctagcaaaaatgaatcagcttttaacttcatattaaattatccttttctaaaaagactgaaaactataatcaagctctttctgtgtaatttgctatagattactactttaagagaataacatcctttgttaaaaaggctttttatactactggcttgtggtgtcccctcctcccactgaattaaagccttcaacctgctgttgtattccatgagcttttcacctgaacatttttacaatgagagcataatgagtgttgaaactggtatagattatttaaaataggcttagattagctctctattgctgttcttgacctccagggagaggaaaaaaaacatgcttcttagtacagaagtggaatttttatcaaatactttaaagcttaaattatactggtagaggctagactccacagttcattttttttatttctttagtccacttatcagatgagcaaatatgaatactgtgacggttatgatgtacctacaatagaaacaatagaaaatagcataataatcaatattttacatagaataattaggagcttaaaattgcttatttaatgatttatcaaaaatagtactaaactattatagagtgttgaaaaatgtgttcaggtttgctcacttcatggaatttatggaattatggttcagatgtttattataattctttttatagatgctgaaaagttcaacaccaattcctcactttaaaaagcacactcctgctgctgcttctacttttatatttcacactactccctaaatctattctggctctaggtaggtttaaagcctttcatcagcacgtggaacattctctaagataggccatatgatagaccacaaaacaagtctcaataaatttaagaaaattgaaatcatatcaattatcttctcagaccacagtggaataaaactggaaattaacttcaaaaggaaccctcaaaactatacaaataaatggagattaaataataactgaatgatctttgggttaataacgaactcaaggtggaaattaaaaaattatttgaattcaacaataatagtgacacaacttatcaaaacctctgggatacagcaaaagcggtgctaagaggaaagttcatagcattaaatgtctacatcaaaaagtctgaaagagcacaaatagataacctaatgtcacacctcaaagaactagagaaacaagaacaaactaaacccaaacccaacagaaggaaagaaacagcaaagaccagagcagaactaaataaaattgaaaccaaaaaaatacaaaagataaatgaaacaaaaagctggttatttgaaaagataaccaaaattgatatatcattagcgagattaaccaagaaaagaagatgatgcaaataagctcaattagaaaggaaacaggaaatatgacaaccgatatcacagaaatgcaaaagatcattcaaggctactatgaatacctttatgtgcacaaactataaaatctagaggaggtggataaattcctggaaatatacaaccctcctagaataaaccaggaagaaatagaaactctgaatagaccaataacaagcagtgagagtaaatcagtaataaaaaaattaccaagaaaaaatgtctaagaccatgtggattcacagctgaattctatcagacattcaaagaaaaattggtatcagtcctactgaaactattccaaagataaagagggaatcctccctaagtcattctatgaaaccagtatcaccctaataccaaaatcaggaaagaacataacaaaaagagaaacctacagaccaatatccctgatgaacacagatgcaaaaattctcaacaaaataacagctatccaaatccaacagcgtatcaaaaagataatacatcatgatcaagtgggtttcataccagggatgcagggatggcttaacatatacaagtcaataaatgtgatacatcacataaacagaattaaaaacaaaaatcatatgatcatcttgatagatgtagaaaaagcatttgacaaaatctggcatccctttatgataaaaccctgcataaaactggtatagaagggatgtaactcaaagtaataaaagccatctatgtaaaacccacagccaacatcatattgaatgggggaaaagttgaaagcattctccctgagaactggcacaagacaagatgcccactttcgccactcctattcaacacagtaatggaagtcctagccagagcagttaaacaagagaaaaaaataaaaagcatcccaattggaaaagaggaagccaaactgccgctgtttgctgatgaaatgattgtatacctagaaaaccctaaagattcatccaaaaactccttgatttgataaacaaattcagtaaaatttctggatacaaaaatcagtgtacacaaatcaatggcactgctatatagcaacaatgatcaagctgagaataacatcaagaactcaatcccttttacagcagctaccaataaagtaaaataaaataaaatacataggactaaacaaaggagatgaaatatctctacaaggaaaactgcaaaacactgctggaagatattataagtgacacaaacaaatggaaacacccatgctcatggatgggtagaaccaatattgtgaaaatgaccatactgccaaaagcaagctacagagtcaactcagttctcatcaaaatactgatgtgggttgggggggaatctctcaagatggccaaatagtaacagctccagtctgcagctcccagtgagatcaatgcagaaggcgggtgatttctgcatttccaactgaggtacccggctcatctcattgggactggttagacagtgggtgcagcccctggagggcaagcagaaacagggtggggcattgcctcacccgggaagctcaaggggtcggggaactccctcccctagccaagggaagccatgagggactgtgccgtgagggacggtgcactctggcccagatactacgcttttctcatcgtcttcacaacccacagaccaggatattcccttgggtgcctacaccaccagagccctgggtttcaagcacaaaactgggcagccatttgggcagacaccgagctagctgcaggaattttttttcatgccacagtggtgcttggaatgccagagagacagaaccattcactcccctggaaaaggggctgaagccagggagccaagtggtctagttcagtggatcccacctccacagagcccagcaagctaagatccactggcttgaaattcttgctgccaggagagcagtctgaagttgacatgggacactggacttggtggggggagtggcatctgccattactgaggtttgagtaagcggttttcccctcacagtgtgtaacaaagcctgggggaagttccaatggggcggaggcctccacagctctgcaaagccactgtagccagattgcctccctaaattcctcctctctgggcagggcatctctgaaaaaaaggcagcagacccagtcagggtcttataggtaaaacccccatctccctgggactcagcaccagggggaaggggtggctgtgggcatagctttaggagacttaaacgttccttcctgatggaactgaagagagcagcaaatctcctagcacagcattcaagctccactaagggtcagactgcctccataagtgtaagggagctccgctaagggtcagactgcctcctgacccctgtatctcctgactgggagacacctcccagcaggggccaacagacacctcatacaggagagctctggctggcatctgacaggtgcccctctgggacaaagcttccagaggaagaaacaggcagctatctttactgttccgtagcctctgctggtacccaggcaaaacagggtctggagcggatctccagcaaactccagcagacctgcagcagaggggcctgattgttagaaagaaaactaacaaaaagagaggaaaagcatcaacatcaaggaaaaggacatccactcagaaaccccatctgaaggtcaccaacatgaaagaacaaaggtagataaatccatgaagatggggagaaaccagagcaaaaaggctgaaaattgcaaaaactggaatgccgaatgcctcttcttattcaaaggatcacaactccttactggcaagggaacaaaactggatggagaatgagtttgatgaattcacagaagtaggcttcaaaaggtgggtaataacaatctcctgcgaactaaaggatcatgttctaacccaatgcaaggaagctaagaatcttgaaaaaaggttagaggaattgctaagtggaataaccagtttagagaagaacataaatgacctgatggaactgaaaaacacagcacgagaacttcgtgaagcatacacaagtatcaatagccaaatcaatcaagcggaagaacgggtatcagagattgaagatcaacttaatgaaataaagcatgaagagaagattagagaaaaaagaatgaaaaggaacaaaccaagtttccaagcaatatgggactgtgtgaaaagaccaaacctatgtttgattggtgtacctgaaagtgacaaggagaatggaaccaagttggaaaacacacttaaggatattatccaggagaaattccccaacctagcaagacaggccaacattcaaattcaggaaatacagagaacaccacaaagatacaccttgagaagagcaaccccaagacacataattttcagattcaccaagattgaaatgaaggataaaatgttaagggaagccagagagaaaggttgcattacccacaaagggaagcccatcagactaacagtggatctctctgcagaaaccctacaatccagaagagggtgggggccaatattcaacattcttaagaaaagaattttcaacctagaatttcatatctagccaaactaagcttcataattcaaggataaataaaatcctttacagacaagcaaatgctgagagatttttgttaccaccagacctgccttacgagagctcctgaacgaagtactaaacatggaaaggaaaaaccagcaccagccactgcaaatcataccaaattgtaaagaccatcaacactatgaagaaactgcatcaactaacgggcaaaataacacagctagcatcataatgccaggatcaaattcacacataacaatattaaccttaaatgtaaacaggttaaatgccccaattaaaagacacaggctgacaaattggataaagagtcaagacccatcagtgtgctgtattcaggagacccatcttatgtgcaaaaacacgcataggctcaaaataaagggatagaggaatattttccaagcaaatggaaagcaaaaaaaaaaaaaaaaggaggggtcgcaatcctggtttctgataaaacagactttaaaccaacaaagatcaaaagacacgaagggcattacataatggtaaaggtatcaatgcaacaagaagagctaactatcctaaatgtatatgcacccaatacaggagcacccagattcataaaggaagttcttggagaccttcaaagagacttagactcccacatagtaatagtgggagactttaacaccccactgtcaatattagattggtgagatggaaaattagcaaggatattcaggacttgaacttagctctgcaccaagtggacctaatagacatctacagaactgtccccccaaatcaacagaatacacattcttctcagcaccacgttgcacttactctaaaattgatcacataattggaagtaaaacactcctcagcaaatgcaaaagaacggaaatcataacagtctctcagaccacagtgcaatcaaattagaactcaggattaagaaactcactgaaagtcgcacaactacatggaaactgaacaatctcctcctgagtgactactgggtacataatgaaattaaggcagaaataaataagttcattgaaacccaggagaacaaagacacaatgtaccagaatatctgggacacagctaaagcagtgtttagagggaaatttatagcactaaatgcccacaagagaaagcaggaaagatctaaaattggcatcctaacatcacaattaaaagaactagagaagcaacagcaaataaattcaaaagctagcagaagacaagaaataactacaatcagagtagaactgaaggagacagagacacgaaaaaccctcgaaaaaaataaatgaatccaggatatggttttttggacagatcaacaaaatagatagaccactagccagactaacaaagcagaaaagagagaagaatcaaaagacacaataaaaatgataaagggggtatcaccactgatcccacagaaatacaaactaccatcagagaatactgtaaacacctctacgcaaataaactagaaaatctagaagaaatggataaattcctggacacatacaccctcccaagactaaaccaggaagaagtcaaatccctgaatagaccaataacaagttctgaaattgaggcagtaattaattgcctaccaaccaaaaaaagcctaggaccagacggactcacagccgaattctacgagaggtacaaagaccattccttccgaaactattccaaacaatagaaaaagagggaatcctccctaactcattttatgaggccaacatcatcctgataccaaaatctggcagagacacaaccaaaaaagaaaatttcaggccagtatgcctgatgaacatcgatgcgaaaatcctcaataaaataatgacaaaccaaatccagcaacacatcaaaaagctcaaccaccacaatcaagtcagcttcatccatgggttgcaaggctggttcaacatacacgaatcaataaacgtaatccattacataaacaaaaccaatgacaaaaccacatgattatgtcaatagatccagaaaaggcttttgacaaaattcaacacctcttcatgctaaaaactcttaataaactaggtattgatggaaagtatctcaaaataataagagctatttataacaaacccacagccaatatcatactgaatgggcaaaagctggaagcattccctttgaaaactggcacaggacaagaatgccctctctcaccacttctattcaacataatattggaagtgctggccagggcaatcaggcaagagaaagaaataaagggtattcaaataggaagagaagaagtcaaattgtctctgtttgcatatgacatgattgtatatttagaaaaccccatcatctcaacccgaaatctccttaagctgataagcaacttcagcaaagtctcaggatacaaaatcaatgtgcaaaaatcacaagcatttctatacaccaataatagaccaacagagaggcaaaccatgagtgaatttacattcacaattgctacaaagaaaataaaatacctaagactctaacttaacaagggatgtgaaggacctcttcaaggagaactacaaaccactgctcaaggaaatgagagagaagacaaacaaatggaaaaacattccatgttcatggataagaagaagaaccaatatcatgaaaatggccatactgcccaaagtaatttatagattcactgctatccccatcaagctactattgactttcttcagagaattagaaaaaactactttaaatttcacatggaaccaaaaatagtccatatagtcaagacaatcttaagcaaaaagaacaaagctggagggatcacgctacctgacttcaaactatactacaagtctacagtaaccaaaacagcatggttctggtaccaaaacagatatatagaccaatggaacagaacagaggcctcagaaatcactccacacgtctgcaaccatctggactctgacaaacccaagaaaaagaagcaatggggaaaagattccctatttaataaatggtgttgggaaaactggctagccatatgtagaaaaccttttacaaaaattaactcaagatggattaaagacttaaacctaagacctaaaaccataaaaaccctagaggaaaacctaggcagtaccattcaggacagaggcatgggcagagacttcatgagtaaaacaccaaaagcaatggcaacaaaagccaccattgacaaatgggatctaattaaactaaagagcttctgcacaacaaaagaaactatcagagtgaacatgcaacctccagaatgcgagaaaatttttgcaatctatccatctgacaaagggctaatatctagaatctgcaaagtacttaaacttatttataagaacaaaacagccccatcaaaaagtgggaaaaagatttgaacagacacttctcaatagaagatattgatgcaaccaataaacatgaaaaaagctcatcatcagtggtcattagagaaatgcaaatcaaaaccacaatgagataccatctcataccagttagaatggcaatcattaaaaagtcaggaaataacagatgctggagagaatgtggagacataggaatgcttttacactgttgatggagtgtaaattagttcccccattgtggaagacagtgtggcaattcctagaaactagaaaaccatttgacccagcaatcccatcactgggtatatacccaaaggattataaatcattctactataaagacacatgcacacatatgtttattgcagcactgttcacaatagcaaagacttggaaccaacccaaatgcccatcagtgatagactggatagggatgggagcaaagaaattctaggcagaaaagggatggggtttctggtgaaaaccccactctcaagttgaaaaacctgaaactgtgaggacttacatccctattttcctgcttgaatgttgccttttcctaaaacacccatggccccaccccaccccatcctctgcccgtaaaaaccccagactcagctggtagatgggactacggctggatgttggagagaagcagcttgacttcagagggacagcttgatggtgtaacttcgaagaagaatcagatcagagacggctggacttgagggaaagattacctacctgccccatcccctttttgtctccccttcctgcggagagccactttgatcagcagtaaaatcgcccacagttaccatgcttcagttcattcatgtgatctcatttttcttggacactggacaaaagctcgggatccattagtgtagatacaaaaggcagtcacactagttcattgccttcactggcagagggcagctgcctcatgcgaaaaggcaaagggcccactgagctgttaacacttaagtcatctgtggacagcagcgttaaaagagcactgaagcctctggggcttcaggagtggcaggcaatcctgcctggatgctgctgtggggcttcatggagtttgcccctgcctgtgctaaagcatctagctggttccagcacccactcacctgtgtgctccctcctgcaaggagtggaacacagcaagtcttgagtgagtggagtttgatcccgctgtcactgaagtggctagccctttccagtgcttgttgactccagttcccgcacctgtttgcttgtgctccctcccttgaggagttgagagtggcgggctaagtaaacaaggcacccctgttgagagtctcatgaaggggtcagggaaatatcctgcttcaataccatcatcattcttcacagaagttagaaaaaaaaaatttaaattcatatggaaccaaaaaaaaagcctgaatagcccaagcaatactaagcaaaaagaacaaatctggaggcatcacattaccatgcttcaaattatactacaagtctctagttaccaaaacggcatggtactggtataaaaatagacacatagaacaatgaaacataatagagaactcagaaataaagccaaatacagccaactgagcttagacaaagcatataaatacataaagtgggggaaggacaccctattcaataaatggtgctgggataactggtaagccacatgtagaagaatgaaagtggatcctcatctttcaccttatttaaaaatcaactcaacatgtatcaaagacttaaatctaagacctgaaaccataagcattctggaaaataacaacagaaaaactcttctagacgttggcttcagccaagaatttgtgactaacaactcaaaagcaaatgcaacaaaaacaaaaataaacaaatgggacctaattaaactaaaaagcttcggcacagcaagagaaataattagcagagtaaacagacaacccacagaatgggagaaaatatttgcaaactgtgcatctgacaaaggactaatatccagaatctacaaggaactccaacaaatcagccagaaagaaataattccatcaaaaactgggcaaaggacaagaatagatgattcttaaaagaagatatacaaacaacgaacaaacatatgaaaaaatgctcaacctcactacttatcagagaaatgcaaattaaaaccataatgagatataagaatggccataatttaaaaaattaaaaaataatagatgttggtatggttgtgatgaaaagggaattcttttatgctgcttgtgggaatgtaaactagtacaaccactatggaaaatagtatggagattctctaaagaactaaaagtagatctaccatttgatccggcaatcccactactgggtatttacctaatggaaaagaagtcattatatgaaaagacacttgcacatgcatgtttatagcagcataatttgcgattgtaaaaatacagaaccaatataaatgcccatcagccaatgagtggataaagaaaatgtgctatgtatacactgggaatacaactcagccataaaatggaatgaaataatggcctttgcagcaatttggagttggcagccattattctaagtgaagtaactcaggaatggaaaatcaaatactgtatattctaacttgtaagtaggagctatcaggatgcaaaggcatgagagtgatataatggactttggggacgtggagggatggctgggagggtgtgggtgataaaagatgacatattgggtacagtgtacactgctcaggtgacaagtgcaccaaaatctcagaaatcaccgctgaagaacttacccatgtaactaaacaccacctgttcccaaaaaactattaaatttagaatacaaaaaaaataaaaaataaaaaacacacttaataaaatagtaattgttaaacaattcattaggtgtagataaaacatttagactacagataaggtcagcataatacttagtggttaaataagagaggcattcctattaagtttccaaacaaggcaaggatcccactgtgttcattgctgtttaatattacattggagataatagccaatgaaatcaaacaaggaaaaatagaggcttaagaattacacataagaaggtgaaactacctctttacagatgatactagaaaatccaaacaatcaatgagaaaacaaacacagtaaaataattcaaataagatagcagaatataaaattaacatacaaaagtcaaaagccaggtgtagtggtgtgtatctgtagtcccaaactactcgttagactgaggtaggaggatctcttgatcgcaagagtttgagtctacctgggtgagatagcaagaccccgtctcttaaaaaattaaggaaacccttaaacttctcctggagggcccacaagtagacttgaacaaatggatagttataatttgttctttgataggacaactcattatcataaaaatatcagctatcttcaaattaataaatttaattcaatactaataaaagtgacaaagttttactttgagcttgatgatttgattctaatatccacatataaaataaacgtacaaaaataggaagacctgacagtagaagagtaatggggaaattgctttttccaatatgcacactctagagcctctgtaatgaaatagtgggtgctggcatacgaattggtcatcagagaaaaaaaatcaggacatagacccaagaacacatggaaattcactgtaataaaagtggcttctcaaatcagtgggaaatgatagacttaaaaaaattaatagactatgtttgattgtggtaaaatccatactacataaaatttgccatctgaactattttttaaggtatacagttcactagtgttttgtcatattgttgtgcaaccattctccagaactcttttcaccttgctaacctgattctgtacccattaactaactcccagcacctccccatcccccagccaccggaaactatcattctactttgtgcctctcattttgactactctaggtatcccatataaggagaatcatacaatatttatctttttgtgactggcttatttcacttagggtaatgtccttaaggttcatgcatgtggcatgtcagaatttccttcctttgtaaggatgaataatgttccattgtatgtgtatgtaccacattttgtctgtccatttatttatcagtagactcttgggttgcttctactttttggctgtgatgaatgattctgcaatgaacatgggtatacagatttctcaggaccatgctttgaattctttttgatatatactcaaatggaatgcaggatcatagggtaattctattttaaactttttgagggacttccatactctttaccacagagactataatattttacattctcaccaatagtgtgaaagggttccggtttctccacatcatcatcaacacttattattttctttttttttttttgatattagctattccagtgggcatgaggtgatatctgattgggttttgatttgcgtttccctaatgattaatgatgtttggcatctttttatattctttttggccatttgtatatcttctttggaggaatgtctattcaagtcctttggctattttataattggattttttgttattgttgatttttaggacttcttcatatgttctgtatattaactctttattagatacatgatttgtaagtattttctctcattctatgggttgccttttcactttgttgattgtgacttttgatacaaataatttttatattttgatgtaatccattttatctatttttattgttgttaccagtgattttagtgtcatagccaagaaatcaatgccaaatccaatgtcatgatgagtgatacagtttcacctctttcatttgggtctttgatacattttgagttaatttttgattatgatataaggcaagagtgaaaattcattatttttgcacgtggatatccagtttattcagtaccgtttgttgaaaagactgttcttttaccactgaatgtttttgacacacatgtcagaaattactcaatcatatatgccagggtttacttctgggctctctattctgtttcattactctgtctgtgtttatgccagtactacattgttttagtttgattttattttttaagaagtttcaagtttacagaaataatcaaatgaaatgtatagagttcctatatattccttctccccaccagttttcctttgttcttaaaatcttgaatttgtgtagtgtatttgttgtaattgcataggcaatattgagagattactgttaatgaaggttcatagtttacattaggattcactgtttgtattgtatatgctatggggtttgacaagtatgtaaggacatgtgtctagcattacagtatcatacataaaacaagttttactgctctaaaaatcttctgtgctctgcttattcacccttttgtcccactaatctctggcaaccactaatctgctttctgtctccatagttttggcttttccagaatgtcatattgttggaatcatacagtgtatagtcttttcagattggcttctttcactgagcaataagcatttaaggttcctctgtgttttttggtggcttgatggcccatttctttttatttgaaaagttagacttttaataagttgtgttggaacacctagataatcatttggtaaatatgaagtaggagacatactgtacaccgtacaccatcataaaatccagatgggtcagacatctaattgtagaaaaaaagaaaagaaaaatcaagaaaaaaagtgaagccagataaatactaaaataaaatgtgggtaaattcacttataaattggatataaagaaagcctttctataactcaaaaccaagatgaaataaaagaaaagattgacaggtttgccagtggcaacataaaaactttcaagaaaaagtttttatgtatgaagaaaactaccataagcaaaaccaaaagacaaatcataaactgggaataaatgtttacaacacatcatatataaagggataatctacctaatattaaaggattcttaaaaatcagagaacacaggagaaacttaagagacaaagggataaaacagggacagagagctcatgtaaatcggtacgcaaatggcttttagacctatgagaaggtgttcaagttcacttataataggagaaatgcaaattagaatggcactatgtaactaaactcaggtctgagccacttgaaaaccaaaaactcaagagacaagttttggtgaatggaaagttagtttttttttccaagaagccagcaactccaggaagtcagtgaactagcgtttgaagaccgcctttctaagttgtgaatctagatcaggagtttttaagggaaataggggaaatgatgatcagagcattcttgtgaacatgcatagtatcaggtggctgttaatcattgctttttcttggtgaaagtcttgtggcctcctacaggctattaacaggctggtcagcccattcccagcgctgctggtattttcttttatctttcttgaacatcctgttttcctgaggctgtattagatgaataatctacaaactcatgcaaaataataattacattcaagcaagcaagctttttctaacatggagtcagtagataccattaacctaatagatcagaaaacatttaaaatcttggtgaattctcttggtaaagacaagggcaaaaagagcccttaagtacctggctggtgtgagtgcccgagggtcccactccatggagagagatttggcagtgtctaagaatgagacctccactgactgtcagtgcccacccctgccctctgtgctctgcatctttccatgttccagggtgaattttcgtgctagaaccgtgtaagtttcctctgcccaccagcttgtaggctggaattcacattctctgggagaagctctcaaccagtggctctcctgttgctgttattcctcaggaggcatgattttgaggcatgttccttgcgccacttccagcgtttcccttcgggattctgagaccctgtcccctgggggcgcgggctgggagagcaccctttttgtctgccttttcctcctgtgttacctcctcgccttcctatactccctgcatttccctcataagcaacttgcactcttttccttgttacaagttctgcttctgaagcttccttacaaatatctttcagtgattgaaattgaaattagtgttctgtgcctccaggccctgctcccaacaccctctaaaagtgacctgctctgaattcctaatgatttaccatttctggaaacttaactcacatatcttctatgtactccctagtaatttcctttttttttttaatgtgaggtgtaaactcctggaggagaaaaagtgtgattctcaagggtcaggtgtcgtgtcttgcatatagttgtcacttagtacatttgttgaatggaaagtagtaacacttttctaattttttctcaaaattcttgtatacactgatgtgatatttataaagcttctttcttcttatgtgttttctttttcatctgttacacaaagacaatcatgatcgtttctgttgttgaaaaagtgtgactttaaccattttttcctcacttctcatttaaaaataaaaaatttacagcaacatggacctagtaaaacctgatttaacctagaccaaacctacaagaaaatatggctcttgacaagtagtaactgtcttaaaaagaaggcggattcatttaaaccattagcacacctgtaggttgctggtacccggcattatccctacaacattggttttctgtaagatcgattacttgaccttgcctgaaaagattttttcagaatctagctgtgaacctgttattattgttttaaccccaatatgggtacataaaatggatacaattcccagtggtcagaggacatacactggaatacatttagcaggaaggctgtagcagagcgattagcagagattaagaaagtagtattaaagatttggtggctgttcctcgtatattcatatattcaaaataaactttaaaatgtgtagggcagtgggactctgactcataatgttagttttaaactaattactcttatagtagtgctgttccctttattgaaaaataagtgttgtattacaatgttcaggctctttgtctttatacacataccagttacataaacgggtagtattttctaattgtatttgaccctaggactcaacagatgcaaatggtttatttgcattccatctatggcagctagttcagaaacttattcaactttctcctgaattggcagagacaaagggtcttcagtagtgacacagttcattctggttattcaccacatctaaatgatggacatctaaatgatggactgtcatatttatcctgtccctaaatctcattttctcattcttctaagtgttgatatttgggtctccctactgaaattgtacagagtatcatttttggggggtccttttgtaaggcaacttttttgagatataatccacacattgtacagttcactgacttaacagatgagcattcccagttctccatatttttgccagtgcttgttattgtccatattttttgttctagccaccccaatgggtatgaggtggtgatagggacaggaggcagggaaattctgggcagaaaaggacgggtccctggtgaagtccctatcctcaagccaaagagcctggaactgcagcccaaagtgagaacttatgctcctgttttctgctccaatgttgccttttccaaaaccacccatggccctgcccccaacccccatcctgtgcctataaaaaccccagagctctgccagcagaggggagaagcagctggacatcggagactatggttggatgtcggaaagaagcagcttaacctcggagggacagtttgatgatgttgctttggagaggattctggccaggacggctggactccaagggaacattaccttcctgccctgtccctttttcatctccccttcgcgctgagagccactttcaccaggaataaaatcccttgcatttactgtcttcagttcgttcgtgtgacctcattccttctggacgccagagaagaacttgggtgccacaagtgtgggtgcaaacggttgtcacactgaccgtccactgagctgttaacacttaagccatccacagacagcaaagctaaaagggcactgttgcacttcctctggggcttcggatcacgggcactgtaccctaaaccctgctgcagggccagtacagagttcgctcttgctcctccccaaaagcgctcgccccagctcctgcacctgttcacatgcactccccctcctgtgaggtttggagcagtcagtgagtagaattcgcccctgccagcaccagcacgagtgcactccatttcccgcctgtgaaggggtcagggaaataatctgcttctgtggtacttgtggatttgagttacatttctctaacgactaatgatgagcatctttttttgttcatggtggtcatttacatatcttctttcaaaaacgttttcagatcttttcagatcctttgctcatttttaattgggtcatttcttgttgagttttaagatttctttatagattctggttaaaagtcgcttatcagataatatgatttacaaatacattctcctatcctgtgcgttgttaataatatcattttatatttaattttttaagctctcatagaaggattactaatcttttacttgcacacttctggtacccagaagttcttcagtagaggtttatgaataaatgagtggtgtatctttacctcccttctcaactactaaccaaactaaatatgcttagttcctcagttgagcctcatattttgccatctctcaatctctcaagagtgagaatgaccattctttggaagtctgttgatgtaccattgtgccttattgcagaatggtgttccaaactggactgtaatgtgacttccctattttgggtacattgagggtatcagttcctttgaacttgatactgcttttctatttattcaacttaagatttcatgactttttaatgcaactctgttattattttgcaaatcagtgaactattgttatattccgtggaataatagatcaaagtcagagaaagtgcgtaagtgaaaaatagaggatatcagccttgacagcagttcatagaaaaagacctgggctttttagttaactaattttatataattcagtggtaagacaaacttcaatagttttgttgttctttgaagtttcttggtggttttatttttaatgaagttcttcctgtcaattagagctgtgaaataatggaacgggtgacttgaaaagtaatgacttccctgtcaccaacattatttaagtagaggctgggtgactaacagggatattgtaagaaggggctcttgaatggagggtccatgactgagtaacccatgagaccagcttctttcacctctaattttgtgatctaaggatcacctctgccaagatccttaggagaaaaggtcagttttttgtgtacacatgcattatattttcagtttattttctcatcaagcagatgcctttaaccttgaaaggctgctttatttcttcattgaattattttggcttataaggaaaatatgtctgtagtactaatcattaatgattttaagtgtatatactcagataaatttttgcttagttgtgcattcccacttttttttgtcatgaagtttcacagctgtatttagtaaaatcttttgagagacagccaagtaactgatttttttgtggcaagccaatggcatgtcaaatttggatttatgttggaaagctgttttgcagacataaaagttgaaataaacagccaaattatcatttctcccaaatttggatgtgggaaagtgaatatgtgtttggcttttatttctggaataacttgagaatggataaataggttttcctgtgtgctgtattaaacgtgtgcaattttgcagcaagtccaaatgtgagaaatttaatcccaaagaattatgttaagtgtttgaaaaacatctattacttgggatcatctcctgtgtgccaggcactaggccaggtgctttacaaatgttatctcatgtaatccccaaaatagaactgtggttttataatcatttctgttacaggcactaaaatcaagggcatcacagtttaaggtaatttgctcaaggtcacagaatcagtaagtatgaattacaaatttgggattcggacccaaatcttcttgtctctggtctctggcctattctttgaaggcttccccaagttcttcaagttttacttatttttgtgctgtaataggaaattataagtaaggttcagatatttgttatttaataatgtgacttctgattcatacttaacagtatttcagtatgtttaattctggttttgtataatgatttaaaatccaaaatagcagtgatgcaggattttgactccttagttcagctaaatctgggttcttatctcatgaccagaaagaattaagcacatggacacattgaagggtgaggagggtggaatttattaacctctaaaggaaagctctcagcaaagaaaagggtcctgcaagaaggtttccacctcacaaattgaataccagggccaccatacaggagctgaagaggctacgctcctccctgcataaggcgcaaattcctgatggctccgcccagttccctcagggcacatgtgggcatgcccaggcaagccataggtagtattggaaaagacaacattccattggttaaaaggcattattcagaaagaatcaattaggaaagggcaggcaaactggggcagatgttctccctttgggtcttgggtttcatctgagaccagcagtccggtcttcagccttcaggctgttttaggcttgaaggtgaggtttcaccagggacccttccctatctgcctaggcatttgtctgcctcctgcctctatcagcagcatttctctattataattgttaggaacagaaataattaatctgtgtcctagactatttgtaaactctacctcaatgtaaatgtagttttataattaaaatgaaggatcatcaagaatctagctattacttttttttgaaaattaattttcctccaaccttttttttttttttttgagatgcagtttctctctattgtcaaggctagagtacaggcccactgcagtcttgaattcctggcctcaagcaatcctcctgcctcagcctcctgagtagctgggcccacagttgtgcaccaccacactgggctaatttttaaattttttgtagagacaggatctagctttgttacccaggctggtctcaaactcgtgggctcaaatgtcctcctgcctcagcctctcaaaatgctgggattatagatgtgagcccacactggccccctccaactttttatgggaggtgttcctgaatggaatggcttggcctttgttgtacatcaaggtaataaataaatggtcctcacttatggcttaactttattttccccaaggatttggcacaggtgttgtgtgaccctgattcagggtttgtggaaccccctctgggtagtgaaatagatgatcttctcaagatagattatacaatcatgccttaggctggtctttgagtgttatattatctcttcctggctcttttaattttctgctacagacagaacttccattgtatttaaaatagcatttattttataataaggctgaaaaaaaaacagtacaaaagacttagaagaatatagtcaaggtagagttgatgtcaaatggaaatggtaacattcatttaagtagagcaattaaaaatggccttggggctcttagttttacttgccatattgtcagttctggagccactggtaggtattttgtccttatcatttcaaagcacacagttgaatttattacttcagttattatcctcagttacttctattttttaggatacttttaacttgaaggattaaaaaaaactaatcatatagaaccatctaaagccaacataaatttaaatcttagtctcatttttatcttaatgataaaataatgaattaaagcttttatacattccgtgttgaagttgtctctagtgtattcatgattgaaaaatatactctacatgtactttcaggcttatatgaaatacttttcaagtatcaaatatttatggaaaaaaaatctgcgttggctctgaatctgttacacctagagcctcactgtaacactgtccttgggttctgtaatgattaacatttggcacttaagtaataaaaccagttttacaagggccaaaatggacccttgtaaatgaaagtggcctctaaacatactaaaatgcatgataactttaacaaatctttaattctagattctttagagggtgtcaccataggatgattgatgctgaaaatgagctatgtcatgttcactttttctctgttacgtactggatgcttatttatttagaaatttggtgcataaattgttgtctgacactgtttgaatatttaatggccagtcatttctatgttacccctaaggatgtcttcctttacttttagagttcctatggttcctcctcaagttatgaattagtgttttcatgaggtagcagagaagtgtccatattaccttaaagcacacataattagaaacataaatgcactgaatacacttagcactcaacaaacacctgtattgttacctaaaggccaaatgattattcttggattatccacagtgtagctggtctgtatcactcttcattcgaatttagaataggtaattaaaagtcatttatctgtgattgtattgctcagaaacatgaagtatgaaatttctataccagtgcctcatagtaaattctttccctaaagacaagtaattatggatccagaaacatttttccttcactgaggagaggggtgattaaaaagctcacttcgaagtccaaaatactgcagatttgttgagacagttttgtttccctgacatgttgattgcacttcacatcacacacaataccgagggacttattctgtaaggtttctggccttcccctttatcataattgcagagtgtcacattgatctgatggagatggatttagaacagttgttgattggaagctcttgataaagacagggagttcaaacacagactctgcctggaaattcagcgtgaacatccctcatctatcataatttaaccgatgagaaagatcaagttaacctgccatccatcatatctatttaactgtactccagagtgaattaaattgtatttaacaacttttatcttacagggtttgcacactgaaagagaacagcacttcttcatcaagttgttgctctctgtttatcaatttaagattttgaaacttgttctaaaacattcaatatccagtaaattcctttcaaagactttatggtccttaattttcccccaagttttgttcttactggtaataatcaatatcagtttagtactatagcaatggagaagtattcttaggatgcaatggtataaaatagtatcttatccttgaaaatagacgtgctcaattgaaataagcttggttggtattgcaagtattaatttggagtactttcagacattttaagaggtatcgttttagggccatagaatagtagagttaggagggcacctgaagatctaatttaatcctttagtttgcagctaaggaaactgggctctaagggtacatgactgtcataacaaggccatctaagttatctgcaatagtgctgggataaacatgcaggatttctgactcctggaatagcttttctttgatcctaccatgtatctttatgtacagattctatgtggattctctgaaactcatgtcttatcagtatcttttaggattaagggagaggggaaagataaccatggcacgaaataatataacagacccttaaaacttgataccatcaattttgagttacaagaggaaataaatggggaaagtaagggaaaggagatcactctctgttcttgcttttctccaacctactaacattagagaactgataaaaaatttattcatagactttgctgatcaaattgttatgtgttgccatcttgaataatttgtacatctgcagaagcaagaaaaaattaagttttctttttggagagcaagaaaattcaataagaaaacattttctaacgtcttgatagaaattattggtataaaaacttaggtctttagttaggatttgatccagcccaagatggaaaacacaaaataagaatggtgtaagcaagtagaatttatttttcctttaaaggaaaaggagtacacaggttccttctttgccttctctgtcttcctaatgtggcaatgaaggttcaacataccttccccagccctggccatcacatcctcagctagcctgaaggggtgagtgatgaacagtagggcgaggggaagggccagtatgagctggcttcgaaggtggtgtcttaagcagccacatgatacttctacttccatttcattttcattgatcagaacttagttatgagaatacctattgcttcaaggaagactggaatattcagtctgtattctgggtagccaggagtccagctaaaatcaggattgtgttactttatttgatcttaataaattataatatttgattttttatttttaaaaatattactttttttagagacagggtcttgctctgttgttgctcaggctggagtgcaatgacatgatcatagctcactgcagcctttgccttctggtctcaagtgatcctcccaccttggtctcatgagtagctggaactacaggtatgcacccccatgcctggctaatttttgaaattgttgtaggaacggagtctcactattgcccaggctggtctcgaactcctggtctcaagtggtcctcccaccttggcttccaaaaacgctgagatttcaggtgtgagccactgtgcctggcctcacaatatggactcttgagccccataactgaaccgcagaataagaatccctgtgtttatttggaggttcttttccagcaagcttttccagggctccctatgcagccagcttcacatgtttaggaatcattgcactacaatataggctagacatactgatgcaggatttttgctccttagttcagctaaatctgggtttttgtctcatgaccaggaaaaattaggcatgtagacacattgaagggtgaggagggtacaatttatttattttacttattttgtattttaagttccgggatacatgtaccgaatgtgcaggtttgttacataggtgtacatgcgccatggtggtttgctgcacctatcaacccatcatctaggttttaagccccacatgcattaggtatttgtcctaatgctcccttttcccttgccccccaccctccaacaggccctggtgtgtgttgttctcctccttggtttccatgtgttctcattgttcagctcccacttataaatgagaacatgtggtgtttggttttctgatcctgttagtttgctgagaatgatggcttccagcttcatccatgtccctgcaaaggacatgatctcattcttttttatggctgcatagtattccatggtgtatatgtgccacattttctttattcagtctatcaatgataggcatttgggctggctccaagtctttgctattgtaaatagtgctgcagtaaacatacgtgtgcatgtgtctttatagtagaatgatttataatcctttgagaatatgcccagtaatgtgattgctgggtcaaatggtatttctggttctagatccttgaggaatcagagcacagaatgtattaagcaaaaggaatgctctcagcaaacagagggtccctgtaagcaggtttccacctcacaaactgaataccagagccaccatgcaggagttgaagaggccaggctcctcccctgcataaggcacaaattcctggtggctccaccccattcccccagtgcatgtgggcctccagtccactgtgggcatgcccaggcaagccccctgggcaggttctcttttctgcacaaaacatctggtgtaaacccttgtggggcaggttggagattctccgggtacccttccctaatcctaggggatttggctgtctgctgcctctatgactaccttacctaccatagagatgaaggttcctcacactaaacatttcacacttatgaaggggtcagaactctcagtatattccaaacctacatccaaaagtaaagctggcacacatcagctttgcattaaatatcttgaagccatttctgagctcactaggacaatgggcccagaggacaaatgagtaatcttcatttcgagtaccacaaaggacgacagagatcaagcaccccaaatctgtatgtgtcaggggcagtggagtgtggaggaggatctacaggaaaagaaggaacatgatggtacattatttctgttgaaagcaaatgagggcacagtgcaaatgccaggcaggcacctgtaatctgtgacatttcagcttttaaatttgattttggcttatctaataaatatgggatctgtttatattattgtgatttcatgtctacttaagagtttaatgttataattaagtccttactagttttgtgagtactaaatcgaagaattgctatcatgtaattctttgaacagataaacatttttgggagagggaaggcaaatctggattctggtagggttgatatttaatatttatcagttatggtttcagaagaagtgaaactgactacagatctattacctatgttaattaaaagaagggagcaaatggcatggaattttactactccttgaaaaagttctactagcattaatgttctagggggtattgctaaattcagttaaaattagtccatggtagcctcgttggcataatagggaaaaagtgaattctccaaagaatgaagctttcaaattcattaggacaaaaaattacctgtcttcctctgggtatttatttttgctacagcttgagctcctctcttagtttcagtgccacttgatagtatggacagataaaactccacggtgggggtcacacacacacacgttaaccaaaaataaaattctaagccctgcaaccaactgaatggatcccccttatggccgaggggattccaaagaaacctgaaaaactagttcaggtcatgaaaggaagtggggaccaggcatgcctcattgtaccttctctcttttggagtttagatacaactgaccagcattaacattaaaacagagatctggctgggcatgatggctcatgcctgtaatctcaacactttgagaggctgaggcaggcagatcacttgaggtcaggagtttgacactggcctggccaacatagtgacaccccatctatactgaaaatacaaaaattagttgagcatggtggtgggcggcgcctgtaatcccagctactcgggagactgaggcaggagaacagcttgaacctggaaggtagaagaagttgcagtgagccgagattgtgccactgcattccagcctggccaacagagggagactctgtctcaaaagcaagcaagcaaacaaacaaacattaaaacagagatcttaagactgatagaacatagtctttgtaccaaattccagcctgactctagtataacatcacatgacagataaagaaggaaatagaaatattttaccctaaaatatgtctctaaatatacctaaaaaatatacctaaaaaatttgccatattttgaaatggctcttttcatctataaagaatgtctattaacataactagatctttccccttgcagtccttcccagtcctaaagagattaactaatagtctggcacctttcaaggtcttaaaagaggcatttaccatctattctttctgaagcctgctactgggagtcctcatctaatctacctaacaagaactttggcttccacaacttcccttatcttaaagtcaagcattttttttttttttcctgttgacttcaacttcaggtaaagctgaactcttttaaccaattgccaatcaggaaatctttgaatccttctttgacctgaaagcaccgcctccccccaccccaccctggccaaaatatgtagtattgattgatgccctttgtctccataaaatatgtaaaaccaagctataacctaactacctcaggcatatgttctcaggacctccgaaggctgtgtcacaggtcatggtactcacatttgattcagaataaatctctctgaatattttatagagtttggctttttttggtcaacactcacatgacttcagggctgagagacaagtgaccttagtcactaagtggctgggcataagaagggtcacaactgcttagctccaggtaggaatataggtctagttttggcagatcttctgagttttcataaatgccaaactctggaatttattttatttatttttattttaattttttttgagatggagtcttgctctgtcacccaggctggagtgcagtggcatgatctcagctcactgcaacctccgccttctgggctcaagcaattctcctgcctcagcctcccaagtagctgggattgtagcaggactagctgcggacaaaacctctcagacaccgagttgtagaaggaagggctttattcagctgggagcatcaggaagctactgccttaaaatccgagctccccgaatgcttaattactgtcccttttaagggctcacaacactaaagatttcacatgaaagggtcgtgattgatttgagcaagcaaggggtacgtgacaggggctgcatgctctggtggtcagagaaaaacagaacagggcagggagtttcacaatgttcttctatacaatgtctggaatctatgaataacatcactttctaaattatgagttgatttttaactactgggtttaggccaggcagggccaggcctggtttcgggcctggcgctgggctgcctgtctttggtcttatttccttgttgttttttcttaaaacaggtactgagtataaaacaatataaaataatatgagaggtctttctcttccttcaggattacaggcttgtgtcaccgtgcccagctaatttttatatttttagtagagatggggttttacatgtttgccaggctggtctcgaactcctgatcttgggtgatccacctgccttggcctcccaaagtgctgggattataggcgtgagccaccacgcccagccccaactctggaattttattttattttattttttatttttttggagacagagtcacactctgtcatccaggctggagtgcagtggcacagtcttggcccactgcaacctccgcctcccaagtagctggtattacaggtgcccgccaccacgcccatctaattttttgtgtttttagtggtgacggggttttaccatgttggctgggctggtcttgaactcctgaccccgtgatccacctgcctcggcctcccaaagtgctgggattacaggcatgagccacagtgcccggccaactctggaatttttaaacggaaacttttttgtctttaaatgttgccagtgaatttgaaacccgtatgtaatcttccgtctacctgtttgtttttcctctgctccatgtaataaggtgtagtttgttcccatagattagacagactccagggcttgtattcaaccagtgtgcatctggctactaaagtgttaaaatacctgtggactggctggtaagtagccactgcctagtgctagtggtcctggggaatgttgtgtgttcagtgctggggcctgtgccagcccctggtctcctggcctgtctatggcagtttcctgtactagccctgtcttctgtacctttggaccaatgtgggcccaagtcacgatgagaatctggcattctcagcataggggcaatgagacacgctgaaaaccaaaacctggattctgataggctctgctccttctccccaggctgtggctgttggctgctcattggcatatcccagtgttgtctttgtgtggccagttcagggtactgtagctttccctttgattaatgaatataacattcattaaatattttggatttcactctgccatctttaatgcacgcttctcaaagatgctttatcaatatgttttgcccttagagtgatctttttccatagacatagagttttatcattcattcctttgtattgataaggctgcctttcttttgattatattaggttggtgcaaaagtgattgcagttttggaccatgatttttaaatcattataactaggctcaaatacatctttattaatcaaaataggaaccattgcaatcaacacatttttgccaacgagaagtaagtttgtttattcctgtagcataaaaatccatgcttcgggattcagtgaactcttggaaagcattttctgcattctgctggttgtggaagcgttttccctgcagaaagttgtttagatgcttgaagaagtggaggccagttggcgagaggtcaggtgaatatgttggatgagacaaaatttcatagcccagtttattcaacttttggtttttttttttgagacggagtctcgctctgttgcccaggctggagtgcagtggcacgatctcagctcactgcaagctccgcctcccgggttcatgccattctcctgcctcagcctcccgagtagctgggactataggcgcccgccaccacacccggctatttttttttttttgtatttttagtagagacggggtttcaccgtgttagccaggatggtctcgatctcctgacctcgagatccacccgcctcggcctcccaaagtgctgggattacaggtgtgagccactgcgcccggccagttcgttcaacttttgaagcattggttgtgtgacatgcagtcaggtgttattgtggataagaattgggccctttctgttggccaatgccggctgcaggtgttgcagtttttggtgtatctcatcgatttgctgagcatactcagatgtaatggttttgccagtattcagaaagctgtaatggatcagactggcagcacaccgccagacagtgaccatgatttttttttggtgcaagtttggctttgggaagtgctttggagcttcttcttggtctagccactgagctggtcattgctgattgtcatataaaaatccacttttctcgtcgcacatcacaatctgatcgagaagtggttcgttgttgcacagaataagagaagatggcactcaaaaatgacagttttttttttctaattttcgctcacctcatgaggcatccatttactgagctttttcccctttccaatttgtttcaaatgccaaaccacagtaaagtggtcgacgttgagttctttgacaacttctcatgtagttgtaagaggatcagctttgatgattgctttcagttggttgttgtcaacttctgatggccagccactatgctgaacttgaataagaaaattgctcaaatttgctttctgtctaacatcatttccataataaacagcaagtagtaagtcattagcatgacaacataaagcgagaaatgtgcattaaaatgatgtataacataaccacatttgtttaaaaatgtattccaatatcaaacagaaaatttcagcaatgcaaaaactgcgattacttttgcaccaaccattttccttttgctttcccattcttcaactttaggataaatggggagtggatacagcaggcaccttgggagtcattggattttcctagtttgtctagtttgtctcttatccgttgtattgccatgttctgctcattaccgtcttatgggcctgctccttggggcttagacagtctccttgcctttgcttctgcggctcttgctgcttagaaaacacttctggttctatcacctatgctggtggggttgcatcatctttgattttctacagctataggtaatgtcttttccttgaacatttaaggaaagtggctccatctgtgtgtctcttagagtatttaccactttgtatttcctgtcctgtattgacgtgaaaaaatgtcttttgtctctacttaaactccaaggctgcaatgtccattacagtctctgttagccacattgtgctgtttaaatttaaactcataaaaattaagtaaaaaatatagttcctcagtggcattagctgcatgtggctggtggggactgtatggaacagtactgaacatttctatcctcagaggaagttctgctgaactgggctgctcccatggcttgagggcattggttggtcctgccaaccccaccctacccctcagctccaagcttgaagcaggcctgtgaccctcctgaattgtagtaggttctattgcagaagaatcagtatagagtagtgggattgacctaaaaggaggaaactgaagcaaaattaacataagtaaagagtttattggggccaagtttgaggattgcaacctgggggcataaatgcaagttgccccgaatatacactctgtatagcagcagttacaagtggatttatttcattttattttatttttagagatgggatctcgctctgtcacaggctggattgcaacggtctgattataggtcactgcagcctgaaactcctgggctgaaatgatcctcctgcttcagcctctccagtagctgggactccaagcatgtgccgccgctcctggctaatttttaaaaatttatgtagagatagaatcttgctatattgcccaggccagtctcaaactcctggcctcaagtgatcctcctgtcttggcctcccaaaatgttggaattacagttgtgagctgtggagccaggccacagtggatttttaaaggcagaaaaaggagacagagtgggcagatgcaaagttgtttgtcaggaattctcattggtttacagaaataacattgattagtgatatggctatacatggttaagctatacggtatgggttatagtgtccagtgtggcattattagattaatttatagctacttttggcaacaggaagctgctttgagagacgaatacatagctgaagcagggagtagggcatgattgagttctcattttaatgcttctctgggcctcacagtttgtaagggctcacattcctcagatgaaagtgctttctttcccccgtggtgtgtgtgtagtgtaaattcttggagcttagctgcttggctctgtgtactggagcaagtactaagttttctgagcctacatttttataatgggtaaacagtcataatgtgtataaataactctttattctgagttcaaaatgagaaaccttctgaaaaatttttagcatagtggtggccatacagtaggtgttccgtgaacatgttctttcatgtgttgtgcacaggtgggcattgctcctgagaatgcaaggtggtaggcggccacctgggtctgtagccggaaggtgacatgcgttttcattgaggccagaggagagtggccttctactctgaaacatttgtcttttcggctgagcaatggcccaaatgacttgcagtttaatccacagacaggatcatttttaaaacatgggcatcaaggaatttatcttcccaagcctggtttttcttgatgatttctaatgaaactttgtatttgttggtcactgatattttcagttaacgaaaacacatcggtattggactttgttttttttatggcttctgtgaagcactgaaggctgtcatttttgacaaaactattgtaactcttaataagttgtctaagctttaaggctgggcaaataaatcttaaggaattttcatcttggtaaggtgcctgtccctctgatgagattagcttcatatttcagggtgttctgttctggaggaaaccaagaatttcttcagtataagtgaaaccttagcactggcttcacctcagcagatgcaggggaaatcagcctctttgtcctgtaattgctttcatcaaattgaagatcccatgggaggaagttttcctgcagggaaattcctgtttatgggaatggctgtgcatccatttgtcaagagctattgttattctgatgtgacaccttccattcctcccagtcctgtaaaaaatatgacatctattagaacctaattacttatgccattaacatgttgttccccactgaaatttcctggagtttgaaggaagacaagatgtgggtgtatgatagatatatttagatatttaaacattggaattacgtgggaaaaggtggtatatggtagcacagtgtaagaaattctatgtagaatttttatcttcctatttttaaggcattatatacagttaaagtcaaattattttaagttacagtgactaaaaaatatgttgacagtttctaataactttaaaaagtagtccaacacagaattttggatgaatggatgccaaaaaatgggctttcagttcattttcttttatggtgactaggctcctgggattttcttcgatctgattgtgcaaaatagttgatgcactggatttttcctatccattcacaagtatcctcccacccattcctccagtcattcagccagccatctggtaatcatttttatttatagtgccaggaaattgggtggataaaaagatgtatatttcagaagtgcagttttatctttttaaggaactcctatctgggcacagtggttcactcttgtaatcccagcgctttggcaggctgaggtgggaggatcacttgagctcaggaattcgagaccagcttggacaacatggaagagaccccagtctctacaaaaagtgaaaaataaataagtatataactcctttggtttgaaggagattctgtaattctgcatagcagatcagagttctggctctgaacacagactccagagcgtacttgaatcctaccagccagaagtatgagaaatagccaaagacagcttgtggtaagcctcaatttagaaaattgtcaatcatttctcttgaaagtaaaaatttaatttaaaaattggaaattaaattggattgatttgcatagattatttacccattagttaggtgctacatgtgctttatctgatttaattttcataacaatgctgtgaaagaagcaatcatattcctgtctgacggatgagaaagaggggccaaacatgcatggctgccacctaaccattaaaggagtctggtcttgggctgaatccattaaagtcccatgcttaagctttaagttgttctcaatagaaaggaaaaagtccagtcatccagttctaccacttgctactgcctgtatggccgctgattgtcacttagcttttctttgcctaatttttatcagctaccacaatgggaattaatgcctttcttatcaaatttaatacactgttgtgaggatgtcgtggaataatgtgtgtgaaaatgcttgctacagtgtatcatgttacatacatgaaagttaatattcttatacttattccactgcatttttaaatggagtctttcacaacagtctgagaaattcttctattctagctaatgtcagtgagttgtcaatttgttcctaagtgtttattgggcaattattgtgaaatactgaagtggtggaagtagagacaattacatgacaaattttgaataatatgatattaaaataaaaagagaaagagctgctaaaacctggtattttaataaattagacatatggaactcctgctttatttaagaagtagacatagggctttattagtgcaggattaagcatgtagttggctaatgtcagtgaatttttcttgaatattcgggacataaaacagaaaaggagtttatacgtagtgtaattatttcttacatatgttttggtcagtaagccggtttatagagaaacctatgcttgttccttaaactgtagattaagaatataggagttattaaaattaataatacttttgtttacataaaagtaggactgcattatttagtagctgttattcagagcttagtgtgctcttttctaagaggcttcatgagtatcccgaaataactgcaaaattcatcaaatggaaatgattaccatgaaatcaggcttctgacttagatttttccacaattagtgggaaagcatcacacgtggatttatgttatttggacagactggggaaagcctaaaccagactatacattttcaagaattactcagtagagcttcttagagaggtctagtgaaaactaagtaaaatcaggtttgaaaaaattagaccacatatctctacagatttgaggctcaaaaaggccacggtgtgaagaaaactggattctgttacaaaagaatgattagtgtgtttgttttcctgcaagtcataaaggcaagctagtttctcagaatgaatattgagtgctgaggtttttgtcctagggccttgaaaggtggtggaatctaggaaactgaaatggcaggtggaaaaaaaggttcaattattctgtaaagaggcatgtcttcatgaagaatagagtgggagtaaggtagagtaattatcaactatatttgagaaggtcttatataaaagtaaaatactgcaacctacccagcactctcagtgcattttatgaggttctgtttttcctctcatagaatttaagatctatatgattggcttattatgtttattgtttaggttgtctcacttattaaaatatattcctagtgcctagactagtacctggcacatggtaggtaataaatacatatgtattgagtgaataaatgaaccagaggctaggttctttgtggcccttggtctatttgtctgaaaaatgagaactgtattggacacccccaatatttttcccagagccactatgaggataattgtgttcatcgacttttatcttatttttgactgagctggggctgtattgtttgcagttcaaatatattttctcataagaaaaaaacaaaagctaagtgtatttaaattcttaactctagttgagagaccatccaggggatcagagtctgaagtcagaatactagccctgaaccccagcatgccattttctgagtctttctatcacttatgttatagaaaggatgaaatcaaaggaataataatagtggtcaagaaaatcacctctaacttttattgaactgggttcaaatccttagccttttgttagctgatgaccttgggtaagttacccaaattctctaaacattccatcttctctgctgtataattttaataagtggtacttcttagagttgttgcaagggttaaataagataatggaaataagagtgtatcagttcatcagtcaatggcaatacgtctaaccctttaagccaacccttttgctaagaacaatcagaaaacaggaccatatatctggccagctatttgaagtcatgagaggacttctaaagaggagttccatgatccagaaggtccagtgcagtgattcctgcatttggggccacttttttcctcaagactgagtgtctcagcctctcagcctgaactttggtgtaacttgacagtagacatcaaagagcagagctctcagaagactcacaggctctgggagaggcaactaaattgaagtttagggcctgccaaggaagaggtaaatacctcaggcttttggatcccaaaggccacatcttaggtgttagggtgaataggaagtagaccagcttgactcatcacaattactgattagatcaatgtgggatggattgccagtgcccctagcatatgtacttggcagaagacaatcaccattagccaggcatagaagagatggtaaatcagtgaccagaaaccaagagaaaatacagataatagaaacagatataagggcatctagaaaaaggaattgagagacatttgctttaaagtaaccatgattaatatggtaaaggaattgaagacaaggctgagaattttgatatcagttactggaaattataagattgtaaaatagctaaaattttaaaatgatttaaaccgaggattaggcacatatgaaaagtagtgaaaatacagaataaaatatccaaactgagtcaaagagagacaaagatggaaaatacagaaacaaacctatgagacaaatggacatggtgaatataacctaatatggaaatggagtcccagaaaaagaggagagaatagggggataaaggcaatgtctgaagagatgatccttgaaaatttccaaaattgataaaagacattaagcagaaatttgggaaaattacaaatgtttacaagacaaacacaaagaacactatatttaggcacatcatcatcaaatagctgaaaaccaaagacaaagagaaaatgctagaacagccagaaaaaaaagacatgtaatcttcaaagaagcaacaataagattttcagttgatttctcaacagaaacaatggaatccagaagacaatgacatgatctttttgaagtcctgggagaattctgccaatgtagaattctatatctaatgacgatatccttcaaaaacatgaatataattcagatattttcagatatgtaaatttttgtcaacctagtaaattcttttttttttctttttttcttgagaagaagtctcgctctgtcgcccaagccggagtgtagtggtgcgatcttggctcactgcaacctctgcctcccaggttcaagcaattctcctgcctcagcctcccaagtagctgggactacaagcgtgcaacaccatgcctggctaatttttgtatttttagtagagatagggtttcactatgttggccaggctggtcttgaactcctagtctcatgtgatcttcctgccttgacctcctaaagtgctgggattacaggtgtgagccactgcacctggccccatcatagtcttgacagtaggacagtaagacgcttcctttccacatttctttttaccagccacgtggtggctggatggcgattggttctgtggccagcttgctctctgaagggtggatggaggaaggtgacccagcttcaagtgtacgtgtaccttccagggagagggcagaggtaaagcaggtctctgctactccagggtttctcccggtgtgaactcccagggctgtttctcactctcagtgaaagctttttcctccttttcccagggtgtttcccttctgctttctgttgtttgtggccatgatttttggtcatctttggaatctcagtctcaaagcttttctctggcttttttgatcctagaacaagcataggatctttttaagtttcacttttgttttttaaatgtaacagtatgggacatgtaaggagtcagaacaccactcccagacatacgcattactgcaaagcatggcagtgtccaggatactgaagtaggaatcaggtgcactctagagatgcaccacatggcttgtttgtctgtccacactggaacagagagatgaagaggcagaaaaggagagggagcctccatgagctcctgtttcatatgccagccatcctaggtggtggtgtattagtgtgctagggtggccggaagactgggcgggttccacagcagaaattgattgtctcacagttcgggagactagaagtccaagatcaaggtattggcagacttggttcctttggagggctgtgagggagaatctgtttcatgcctctgtcctggctcctggtggttttctggctctcttttctgttccttggctttgtaggtgcatcactcctgcctctgcctttttactcatatggcattcttgttctccctgtgtgtgaatctttgtgtctaaactccaccttgtattagaatacaagttactttggattaagggtccaccctacttgattatgtcctcatctcaacgaattatgtctgcaatgaccctatttttaaataagacctgattctgaggtcccgaggggttaggagtacaacataagaatctggggggatgaaatgaggacagaatttgacccataacatttggcatttcaaggggaccatttttatataaggaatgtatgaaaagtttaaaagcctgtatttgaggattatctctgtggaggtgacacctttgagatttcaggaaaatgtttgagaggctgcactaccctcttccccaacatactgccttcttctacaggaagggattgtatgattttatttgggtacgtggccccccaccacaaggactatatttcctagtccctcttgcagtaggtgtggccaggtgtgggctgtagaccagaactgtccaggagaactttctgtgatgatggaattgtctggtacagtagccactagtcatacaaggctactgaacacttgaaatgtggctagagtctttaaggaaagaatgtttaattttagttagctttagtcactttgagtttaaagagttacatgtggctagtagccctgtgttgaacggtacagctgtagacagtggggtaaatgtggaagtgcttgcacagcacctgccaagctccttgtgaggagggagtgcccccttcttcctccccttcctctgtccttctgcgtgggatgtggatgtgctggctggagccccctcctgacagtgacgatgaggactgtaccacaggtactgtggaactgtgggtggaagggttggggttctttaaggacactgtggagcagagctgccaaatcagctccgggctacttacacacatgaaatatattttggtgagaaatattctgataccttatttaacccactgacatttgagttttcctgccctctttgtctaattggatcatagttaatataggaggcaaaagccaagtataaatcccagcatcattagtgatgatgatagaaatcttttatctccccccaaatcctccttgccacttttaaacaatctgaaaaacaggaagcagagttgttgacttaggaacccacagccttccattcccattattggaggaagcccttaaggaactcccccaccccagtgggattaaccaccaatgttgactacatgtcctgaaaacttttcttctgtaaaaagtttagaccaatttgtccatgttaaactctagtataatttcagaattcctccattgatatttcttgattacaatttaaatggtctgtttctcatgatgagacaactgcatttgaggagcagtttcacttacctgtgacatgttcttaagtcttcgagctgctctcatgcttgcctttggagttacttgcccagaaaaacaccctgaatagtctcatgaagaaccaaggggcactgcaggaacaggcctgggaggtagcccactcagtcactgctgaaagggaatggaggaggggacagagttgttcttctcacccaactgcatttcggcacccttttagctggcagaattaccacccactatttttgctggcagcactactgcaagttgtgagttaaaaaaaaaaacaacaaaaaaaactcacatttttttttggtcaagctgttttgacaggggttttgtctttaaatagtaatcactcattaattgcctttctccctgcaatccagaaccttcctggtttccttgtatactttggaataggcagagatgtgagccactaacgtttttattttaagtgagattatgggtgtgtttttaaaagtattccttggggccctgtgggaagtgcatgtcctgacctctgtaggactggggccctctggaagggtaattagagtctggccccatttgctcctgtctgagccgatcagtgtgaggaggtggtgtatggtttgtgcttatcaggtcacaggcataaagatgaggcttgctgctagactcactccagtgatggatggatctactgccttgtggtttataaagtgtagatatatattctcaattccatgttagggatcttgaaaaaccaaaaatctttgcagaaatctctggagttaagcaattgtgtttttaagtggagttatctgcctcccaaggccagacctgtcttcgctttgacaagcatttaaaaaattcagttaagcaagtgggataaaagcctgtgtttgcaaatggcttaagaggcctgctgtctaccattataatgacacataacgttggttaacttggttttttgactccctaagcaaaggtcttattcatttttggttttaagatctggtattctacttgataagggtttccataaaaatccacaaatacataatatctaggttttgctaggaaaataggaattacaggatagtgttgtgactaaaggatatttttctctgttatcgctttaataactataaaaggaaataccatggtttaagtttagttttgataagctaaatttaagtttatatcctcttttcgcttttacattctgttgtttcatttgttttaaaaaaaagaacactcaagtgatttctaagcctcttagtaaaacaagctcgttaaagactgttttataacatctttcacattcctctgaagtactttgtagaattaaccctttaccctaactttggaaaccacctgtgtgctcactggctatgcctggtctagttttctttttgttctggtgaatattgtgcagctgcggatagaataacattcctcgtatcagtctttactcagctgttcagaatgactttttactggctattagagccaatagaagttttctgttttatatttaagaccctccaacgctccaaaatctgacattcttacctctctcatgccatgcccctaccttatcctccccacctgttggtcactttcagcacaggttcttttccccacaaatctggaaaaaatacgtgctatctcatgaccacaggttacttcatttggcttctttgctttcgtatgagtacacacccacctagaattgcctccttcacagcctctgtctccaacaaaactgaactcccaatgcggctatgcatttcaacatccagagttgagcatcaaaggccaaaaatgatcaaatggaagcaagtcccccttggggtaggaacaaggatgctgcctgtggcagaacagagctctctatgcaccaaatggctccaggtgaaccccccccctccattccacatagcccccctccccgcagaaggacagacactgtgcttttcacttaccccagtgagatgcacacatatttgctttctgtatgtgccatggtaatgaggaaggctgggaagcactgactgggaagcatcagcctcgaagataagcccttgcctaatgttcaaggtcaatgtcactttgttcccagcttacctttctgccctgatctgctgaccccaggaatgcctgtgcttcttggctcagactacttctgccacaactttgaggtgaaactgacatttctgcctgtctgccggatgtgtctccagtcgctttccactggaccctcccctgactcactgtgctgttgtaaatagcctaaaatgttagaatctcattcaacgtttttgtatccctccacccacatatttaacttgcttggatcttcaattcccattgatactcctcttaatacattgccactgccataatctgcctttattgaccatgccattccaggtaagtgatttcatgtcctggggtcttgagtctctcatctgaaaacaaagggagtcaggagtcatgttctttacgtattatttggaattagacctgtgtctggaaagtcaagtttttcatgtccaagttgtgtgatttggggtagaaaacatattccctccaaaccccagtttcttcatgtgtacagtatatacagttctttactgatggtgttgctacatcctgatagagaattaaatgagacccatcttttcggtgtgacctgcacactaccaggcacctaatatacatctggtatacactaactactgcaaaagccttcaacctagtcagttcactctctagggcatgattcttcctctgtgaaaattttccacataccttcctctctagctaatagaaaatgctttctcaatttttgtcgtttcttttacagttagtaaataatgacaagtgtgttgagtgctaccaatgtgaagtgcaagtttgacgggacatagggagaccttatttggttagggtgggctgggctgccaccccaaccaaattaggttgcccatgcagagttgttggctgaatgacttttctgctgtctggcatttaccaagcgtaatgacacctttttgatttttctttttcctcctgtttcccctccaactcacacatacagaattaattaaatgttttttggtttcaactctttatctcatcttgtatggattagccaaatttcctgcctaagttattaaaccaagttgaattctgctatatgtgtgtttgtgtcttcgggatctgatcatctttgaggtatgattctgaatgtcatttgagcttattctttatgacattctagaaaagtatgtatgctaggcctcgaatatattctttttttaaaaaaatttctataatttcaaaaggtaggaaacatgacagtaatggttagttttagattttatttatttttattttttaagacggagtctcttgctcttgtcgcccaggctggagtgcgatggcgtgatctcggctcactgcaacctctgctttccgggttcaagtgattctccttcctcagcctcccgagtagctgggattacaggtgcatgccaccatgcctggctaatttttttaatttttttattttttgtattttttgttagagatggggtttcaccatgttgtccaggctggtcttgaactcctgacctcaggtgatccgcctacctcggcctcctaagtgctgggattacaggcatgagtcaccgtgcctggccaattttagattttattaatgttagacatagactcgtgtgtcatagaaaacaatactcagagaaaactacgtacctagatgttttttggccttttagttaggcacttggcaatgaatgtgttttctaagtttattagttactttgatagatattcctggtctaaaatctatttctttttattttttgtaagtattctttctgtctaacccctctttaaaataaaaagttatttaggagtttaatgatttggggggaggggcagattctggtaatgtgatgaacgagatggggaggagcagtcttgcaaacctttggtttagtagagaaccaaaaccagtttggaaggggatacaggtctctttctagccatatgtatttgactgaacatgtttgtttggaaaaactagtagttttgtaaatcatccattgagagccagcaagttatctctacatttgtgaaagaaaaaaattgaggtggatatgggtttcctttttctatgtgtgtccgtattgttttgattgtatagaggtagatatttttcttcattttgactgaaagtaaagtcagaattatatgtatatctatacatatatatgtatagatatatttattttctacattttaagaggaagcagcgtgttttaagagtgaaagaaaataagctttgaaagcagacacatcttgatttgagtgctagttactatcattagcttgcttatataatcttgagaaatcttttctttctcgaagccttagtttgcccatcagctaaatgagcacagtacatcctatatggtagggttgttgagtatgagtgttaagtgaggtaagttaagtcaacacaacgtagtaagagatcagtaagtatcaaattccattctcactcactatatgtaatataaataggtttaaatcaacagagtgagtttatctgtaactgcagactttctttgccataacacctttaaaaagttttaaatgcttaaatttactgttctttcaactgccagtttagtgttagttcatatcattttgttttggccgtatttgctaatgttattggtggagtcataccattttctgttggcttcatttataattctattttttttttggctgtctacacattatttcattttgggacctgctacactgttggatttttggctttactcaccttttccccccttctccacttttgacccatctcctcctatttcattttggcaccagtaaagtaatggttcatgtgtatgctggaagcctaccccatacatctctatgggtgcagtattcctttttattgtgttttatttttcaaaatgacaagcttatatttccagtatgtgaaaatgctttagaacttcttgttgaatatagattagttgacattttaagtcttagcccatgttgtatggttgtgttttggttttctatttcttctttactcttttcatcatataccttgtagtttttgtcatcagtgaatgatttttgagaatcctaatgtgcacagcattctgctggatcttgtactaagcagtttaaagagaccctgtgcaattacccgacatttcctgtgtgcttcttataggcagaatttcatagaatacaaattatcctcttctaggtacttgaatctaaaacaaatatggacacacagagcaagaaaatagctgaacagtgagtatgtgaagagtaaaccaacagacaccaggattattcaccataggccagccttctagctcccaagatgttccctccctgccagtcttcattgtctctcagtattgagatgtcagcctcctttccatattacctggaataattgccaagcagtcatgccacttgaaaatgaggtaacaagtcctttgattgaactggcagtcccactccctgtcatagcatccttgtatcagtgttgtttattcatttcatggtctgttctctcaagaaataagcatcaggagtggacagtgatgtttggggggatcccaaggcacatgggaggcagatcttacctctttctgaggaggccacagagagctggatagtccctctgtctgctccctggtagctggaatgtggatctgtgactccatgcagccaactggaagcttaatgcagggaatgtgaactttgaactagttagagattattcactgtgaggcttttgcaaagggcacaggctggatgagtggccgtgagcgtccgtgttcctgagcagactgtgctgtggcccaatcctgtgcgtgtctcctcttcaggctcctgccggagcatgcttctctaatcttaccatttatcactgacccttcggtgaaactctcttctgtttaaatttaccagggtacactttgtaatacttgggaccaagaatttgaagatagtaatcagacaaatcaaacaactagtagtagtggagagacacgtagccctacaggaaggggtagaattatcattaaaaacacagacaaaccagagactgcctgaaaaaaaaaaaaagatgaactggaaagattcaaagtaggctctattggaggtgagtatggaaaacaagcttagctttttattttgaagtttccttccaggagttggatactgtgatctcttcaatcagcatgtttatatagtgaggaggaagaccagaaatgagaagaggaataagaaaatggcagcacagccttttggggtatggataagggtggtcttcctgctacagcagaggagaggggcatgtgtggcccatgtggaagagcaactgagttggtggctgactgaatttgggtccgaagcaaaaataggatatgaggataggtataagaattttattttgtgctatgtgtgtcatttggcttttaaactgtctagaaataaaatgagatgaaaacaatctgccctcatttcttggttgcttttcttaaatatcattggcccaaagcatagccaagccttttatttagaaaatcctaccttcaaaaagtgataggttacactaattatatttgtgctgttctacagattttctattttgcactggtcctttacctgctgctcgctgtgcgggcagctaaggtgagagtttgaagactatggacttttaagctgagaggctgctgtggtcatacagttttcaacacaaaacttgttctccctctagtgttccacttgcacaggggtaagttgcacaactttgttccattttgaattctttgcaagatttgtcttcatttcctctgttgtatcagattcctatatttccttgtactgtttggccaaactccattgttttcatcttactgagtggaacagtagatactgttccagctttgatattaatttcctctctagtacagcaattccgagtctggagtacattagcatttcaattttgaagagagattttgatctctgagcacccttgccttgtgtctgttttcttgatggttccttgtggttgctttcagtgttaggttaggtttctccagttaggtttctgatgcagattgaaaagcaaacaagcagttaattctgtgcatccctcattcttctgtaaacatgcctagtgcagtgtattgcctctccaagtgctcttgcttaattaacatgctttagtttgtaaaggattgatttgtttggcagaattatccatagttgattctgggagcaaattttctcggatatcaatttgaggaaataaatctcacttctccatgccttttgttaattaatttgtttctgttaccatcaaatctttacttaataagtctgtaaaggatctccagtggtgttgagatgtcagtgctgtttggctataaaattcaaggatgacatctaatgtgtgccttttagtagagatgcaatttacttatgtagtagatttgtgaggagcatccatggaatagtcatcccactatgattgtatataacaattgtatgtacaatatacaatatatatatacaataaggaaaatgtgcctcttaggggttgggaaaccagtggtcaaattccacctctggcatcatctgctctgggactgcaggcaagccacatcattcggatggcttcccttgtgttgtaaaggggggacaacgtttttgccctccttttttgccaggctgctgtgcatggccctgtggaatcatcaatgtggcagtgtaatagtctccttcctgcccagtgtggaccccagcttggcctgtgctgctcccatccacctttgtagcctgatcttcagccatgttttaaatattctttgcgctgcagcaaacttttattccacacacacaccatggccttctcataacgggccacctgtcctctgttaaggctcttttggaatgctctgtatgtgcctctcagaacttctcccagcttcccagctacaccttaaatgccttctcccctgtgaattcttccttgttcttcctaatctgaagtaggccttttagtaatctctgataccatgtcatcttctggtcacaatgttgaattatagtaggtcacacatgtgttctgtattcctgactaaattaaactcaagggtcaggattctgtgttgggcatctcttactgtgctaagagtgccctcggatgaatcaggagtttttggatgttgactggattgcttttgatgaatcagccttagtttttcatatttgcacaatacttttgagtgttctctaaggtcagcttcacctatggagaatgacataattctgtgttccactgtagaaatgtaagttgggtatccttcagtcttgctaccatagtcaaggagtgacccctgggcagccagcagcaggtgggcgtttctgcagtaagcctctggggctcatctgttcttgggaagccaagtaaaaacacacacaccatgtggggtgataaggggcacaatctcgtacgtaggagaattgggatgaagtgaaaaatgaataacccaggaatagagaagggtgctagtacattctgtggcagtgggtcttaatggatgagtgagcaggagcttattgggatggtaggtgagaagtgtctccaggtaatgtccagaagggggtctgagcttaatgtgcatggttgcaggcgagtgggtatggggtatcccaagcccagggtgaagagtgggtggggatgcaggggatgctggtggtgatgccctttagtcatggggagataaaagagcttgggcttctcagggaaaattaagtgcatgccatagcaaaatggccataacagaggtgcttacctgcccatcaaccagtggcataatcacgggggacacatcctaaaattcagagccccaacctcactcccaacaattctgattccgtaaatctagaacgggactcaatattcatgtgttagtaatttatcccagtgattctgatgcaggtggccagtgaagcacactttgagtaagtgttgaattacctctaagaaaggaattataaaatttgcacagatacgcatttgtcctagggaggaggatcctgggtagctctgttcagatactcaaagggatccataagctcttcaaagtttcagaaccactgagctaagacaaaagcttgtaatccagaatgagaatagcagcaccattgcaggaatattggagatcagtaacctttaaagaaacattttgtgtgatagaaattgttggtgttttcaggagccctactggaaacacattagggaagtgaaggcttaccacccaatttgtaaatcaggatttaggtttgtgttaatatctcagtgtttaaaggacatacagtgtttagtggctctagcaattaacaatttgtctgtaataggatttttttggaaacacttcaagtccacatctttctctgacctaattaaaccttctggtttcccctgggttttactttttaattctgaagttagaaatatattaaagttcagtagaatgaaggtctttattactaattatcagtaaagatatcacattttgctctcctgtggttaaggtcttatctgtatttctgtgataaacatctctctgaagtttatagagcatatggagaaaaatgagattgatacaacttggtttttactcactcccaaccccagaatttttgaatcagtgaagtgtactgctgaaaagtgatgtacacgccctcatttctcccctgaacccagggtaaaatgaacatactgtttatactggcaaattcagtacagcaaatgggatgaagtaactgtcggagggagtctgtgatcagggatgtgtttcctggtgatggctgagacagagctatcagctggtaactgtagcttgtccttcagcaaggggttgcagctactaagcacacatttgatcattggtttaaaccttacagaaattgagctggtctgtgaagcctcctctaggcaaatttctagctccatgaagggttactatttcttaagtccagtcaatattccatcgatgcacaagtgtttattctctattcacaacacacacagtactaggtattgttaaaggtaagtgtccaatatggccaagggccaacaataagggtatttaaagaatatctcaaagagagatccaagccacagataatcaaatataaaattacccactcagactattaaaaccaaatatatggtgacactttgtttaacttatcccagcaaccacaagttcttacaagtcagccatatgaaaaataaaaaagcttcctgagaaacagaactccctactctcttggtatattaaacatatcccaatgaatagtttctggacgcagataaggctcatcccaggcatattatgaagtcattgaatttgatactgtcttctttttttaaacttattttccacccacttttcatatgtctaatattcttatgtaatctgcatcaaaataagaaatatctaatatctagttatccttacttgtggattgtttatgtggccctgtgcacaataggtctaaataaatatttttttggagtagctgtggttagaggactggctatgtgaagccattttcatattatgttcttttgagttttaaatttcaagcctctttgttacagatggaaaaatgtagacttactcaaataattgtagacgttagtaagcagaggctgagaagaggtttgggttaaggagagttgtacggaaactataatattaggtgttcttcagtgatcttttcagcaaatatgatgtcattttggattgactgggataggaacagtcacctaaaatgggtcccagcccatgtaggattgacaatcctagatgccttgtcctgtaacctcaagtttcttactttttcacaatagatagggagtctggccagctctagcactgatcttcatatcagtagggtttcttctgccttctcttctgctgccgcttctctttttgctttagcattgagcttagccatccttcttgcttgtatatttaacattattttatttagtttttctattatagccactttccccaacagtccacctgatctaaccttaattatgttgctgataaagaattattgtctttaagggaagcaaagaaaaaaataatagcatgtgcaatcttagagtgggaatattaccttagagataatctaggcctggaagagtctagtattgttaaatattaattttttttgtggcctagtctttctgttgcccacagtacaccaacttttaagtaaatgaaagttgaatatatctggttgaagcagggttttagaagggcctgcgctgggttcgccctcgtgggctgagagagcctgaggattctgaggatcacagggtgaaaaactcagtgatccaagtcatcatgcttttttttatagacaggactgagacccagaaaggaaaggaaacccacagttaactatttactaggtagctagataggtaagtgcgtcccaggtagctagataggtaagtaggtcgatagatacatagcataatgtatgtgtttatagaaacacacacatatatgcagaatcacttaattcttataacattctagaaggtagatggttttatagatgaatagatgaggaaagcttgtaagttgatagggttggactcacctatgctccttctggtggcaaatctacattctttccaccctagctccattctgctgcttggttgccttgtccaaagccacacacaggcaaggacaggactgaaacccagaccatctgcctcttggtccagggttgttctctcagcagatctgttctcttcagtcagtggtaaaataatacatgctaaaaagtaaatggaatattgagtaaacactcagttagaaaaagagagaaagacgtcccagctgtgttgaccttgagaagggttaatgtttttagttccctatattttagcaactaattggtcatggaaaaggatgggaaggaaagctgattcatcacagttttttgtgctaagtattgctcagagcttggagaattgcatggaatctagcttccttatttaaaaaattaataaggaaaaatttttcattaaagcatgctttctttatggcctgagtattgaaacttgagattgaatatgtattaactacttgtatgtttcataaatttgaaatacacataatatgtaattattgacattcttctcatgtttgaaacaaaagcggcagacacactgactgaggagctgaaccagagttccagtatgatgcacataaagtccgtgtgctttttgttgacttatgctgaggtctgccagataacagccttattacgcacattcttagaataacaggccattgatatcttagtagattcttacatttaggtactgactctctggttttcttttttttatctggctcatgtaggaaaaggagaccttcaggatgagtttttgttcttcctgttggctcttacagcatttttcatatttatccttttaactcctctgtgttccacaagttgtcttccttgaggacaaggacttctttttcatcctgtccgttctcttatcccttccccttttcctccctagtgcctgacatcatgcctggcacacaagtccttaggaggagtgatggtgacagggaaggagggagatgccatgagtcagataaaaaaggcaaaactctagaatcaggagtttcttcttcctttgatgtagccagagtgttcagtgaatggagtccattagatgttttttcttcagcgctcctttctaataaagatagagcagtaaacagtttttattcttacctttgttacaaaaaactttacaacattctgttaaatctagcaagtatttaatgagtggcaaacacctttccaggactggggagacagagatgaacagaacattgtccttgttcaaggaccgcccagtgcaatagagaagacaagcatgtccaaagttacattgccctgcagtatgataaggacatcaagaaaacctgtatatttggcagtgatggttaccacatgggaaggagtgattgattttatctgtgaaaagccctcagcaacaggtacctgggagaggtgttgtccgagctgggatttgaaaagtgtgcaagagttttccaagcagatgctgggggaggggtgggacaagtgctgaacaggtgcagggaccgcatgagcataggggtagcatatgggcaggaggatcattgggggtgaatctacagatagtcgggaattactagagtgtaaaactaaagggaagtggtggcaaggaatgaagataaagaggtagacgggggttgaatcagaaaaacaacagatgtcacatgattaaaatttgagtactatccgatggacaataaagggctgatgaatagttttaagtagggagagagcattttcagctgtgtattttataaaaattcagcttgttgggagtgtgtgggatatactggagagagcagaatccaggtttgagggaatgggtcaaatcaaacgggaacatgagctgaaactcaaattgtggcatggtaggaataggagactgaaagaaaaatttaagcagttgtttaggagataaggtgtcaggcagagagaggcagtcactcagccaatataggcaagataaagaaagaaatgtctgtgactttgttatcctgtttcagatagcatgtgccaaacatagttgtgactttctttgatgttcatcaccttgtaacagtgactacactttcacatacacctctaagttcaatcttccctatttccctgggagttaggtgatagatattacaaaggactcatacattctatagggcccacattctcagggacttgctcatgttcaaaattgcaccccaaaatccttaaggaaccttttgggtgggagaccagcataatgtttctcagtaagtccaataaagtcatcccctgcacccccttgtcattggattgctgtttatgcatttgagcataggattagattggtgatttggattttggacacactttaattaaaatgctgatctttaagcatgaaaattatttggaccccagtgaaatgtcacactaagcaaagcctggagatggaaggagcagaggctaactaggtggaggtggaggagcaccagttcatatttctaatttcttagtttcagcttgtttggagcgtaagattgttaggcttctggactaaatgtatgatttctctgtcatatgccccttccttttcaatgttgaaatcatgtaagttgagcatacctttgatatgaagactgcatatctccttttgatgcaaagagcaagacacatgtaactgatccaggactctctgtatctcagttctatgatcccaattaaatacactcatctgtacgagttccccatggttgtattagaagaagttctcctcatgataggaaattggaatgaatattttaccgacaggatatgtgaaactatatttactttttccttataatttgattctacccaatgaatataatgtgtagaaaaaatgttcattgagggaagtacatttagttgagtttaggttaatcaatgtctggtgaaaataaatagttggctgtctgttttaagctgaataaatagcatggtttggctgtactgcatattggtgagttcaggagtttatcagctgtcccagataatgattttatgctaataaaatcaagaggtggatttgtaaatcacactaaactggcagcagtgctactgggcataaaatgcaattcttttttttttttttaattaatttcctgggtatctctaaccagtaaccaggattgttttctacctaagatatctcttcttgttttgagtaactctacttaggagaaaaattatagatcagggttttcttagcatgaaatttaagcaaaaaattcaacactttgatccagccgtgctattctgttgtcctttatcatctgagaggtgtttatgactgaaaagcattatttagagcaataatctctgaatcactttcttcacaacctttttgaggaatacagtacaactcattgatgtatggaagaaaagatttgaacttcagcttacatgtattttctaataatacttaaaaaggtcagtatatgcatgcttgtaataatctgcatatgtagagcactacatgattataatttatacataaacacacataggatggttatacctttttaagaaaggatgtcttctgaaaaatgtttgagactactgatctctggagcactctttctgggtcaatgattagattattctgggacctttttttaaaaccacagattcatggggctgttcccagaatattctagttaaataggttgatccagaacagtgattaccaaacattagagtgcattggagccacctggagagttgttgaaactctggctgccgggcccaacccccagaggttctgactcagtaggtctgggatgaagcctgagaatttgcatttctgagttcctaggtgatggtggcttgtccagggacccacttggaaaatcactgctctagtttgggactcaggacaacagtgatttcagagatcaggtcataaatactgatttagtttgacgatcttctccctgagacatttctggcagctgtttcatcattttgttttcatttgttactcctgcttctacgatagaggcagacaactattttttacactctctctcgttttcactattgtggtatagaggataagagcaccagtattatattcagatagattcacatttatgcagggaattcatgcaagtggtttaattcaatccaatagtagctctatgaggtgtttatttgtatgtggaaaaattgagatagtcaagttcctaataatttggttgcatctgtacaatatttaggaatagaataatactactgcacattaaagaaaattttactatcaataagaaaaatacatctttgtttgtcgcaactcagccttttaaaaaattaggaatccatagattgatatgaaatgaagatggggtaactgtaataaatcatagaaacttcaagaacaaggcaacttatttcctttgtatcatataaaatatatccatcggcaaatagcacttcttataatagagcatagcattagccatttaaatgcctgtgtaatgtgtaaaaactgcttgctaaattaaattatgtagaagagcctttctataatgcttagtgtctgattcactaaacatcactggggcactcaaagtttaggaggcattatatgcttttattgtttgtcaggcaattaaatgtagaagtcactgtgatttaaaagaagaaagcagggcctctgctatgttggtatagtttttttttaatactcctaaaataattatgtctattaaatctcactttctgtttatcctttgcattgtgtagtttatagccatttattctacacagttttaaatttgagataaataggatcctctgagatttcatgtaatttaggaaaatagaacatataacattaattcttttggggggtactgtagcactattttttgatctgccttctctattgagagacccatttaatactttatgcatttgatgaaggctgacttaaatggggtcattctgtatttggaacaatgagaaaaattttccagaaaactcatcaaggagtattacagtctttttacaaaataactttaaatggactataattataacaggaagaatgtttgctagtgtatgtaagtcaatttaacctgttaaaggcagaacaattcaaaatatgtgtgtatcttacaagtttatgaaattaacatttgattgtcctccactggcttcttagaaacagcactttcgagagcttatttacaatgcaaatcactgaacagttcgtatataagcactgtaaattgttgtttacttactttctagagcttggtgaaaatgtgtgagtacagaccttgtttgaattgctagtcctgcactgaagctcctgtgtctttgggtgagattatttgacccttctaaactgccatttgtaaaaataagaatgtaccgatcaggatccaatcaggagagagaagcaacatagtaatttaattagggaacatttataactgtaacgggtattagaatacaagagatgggttagtacaagctaaggagagcattgaagaataaaggaatagtggatgtatggagctgacgttagcccaggggcagagacagagctccagggaggagactctttcattgctgagatccaggggaaggctgtggctcagtggatggcagaggagttactatggggctgcacctgcaggactcagaggtaatgtgccctctgattggccgtgaaagttattcatagggaatgttctgctggaggcacttgctacagaaccactggggcactgtgcaggggcaagctgctgctactggaggagccaggcaggggggcgaccctgcgttgtgccctgagggacctgccagggagctcagggaggccactccttcctcctgcaggatctctcctgtaccctctactgataaagcttataccttcttgcccactagtacagaaaacgtagttaaagcatctggatacatttttgaaatgaaaaagatttagagctaagaggtgtaataccttgataactagtacagggaatattgatgcttgcctttagaatttttttttaaattaaaattaggtaatacatgtttatatttgcatggcttttgttctgtaacatgttaattgaatcagacatgttgagtgagataaaagtcttactggttgtgaggagtcaatgacatcatgactatattttgccttaggcagaatctgactggcacatggtctgtgttcgcaaaatggtagctgttgataccagagaactttgtagcttacaggttccccttagactgtgtggcagtgctctcacacagtagtgttggttgataacttcaagctaaataaacagtcttaggtgatggctctcaccccaaaaccttaagaatacaagtagcaatcttgaaggatcttgaaatcaatttagtggatctagaacctccttttagaacagaatgataaatatttgtatatctcagtagagataaatttggtttttaaagtgtacagatgatttacgtgtactgggtcaagatgtcatgactatgagtcacaataaaaaaaacaatttttaatatactgctttaaatggtagactctatttcttgtcaatttgttttccgttgttttgtctccaggcctgaagcttcagtaggatgtagaatggtcacataaggtttcctttggggtgaaaatgggccattttctttatagcttatgacttaatgatttcatactactcttggatcaactgaatcatcctcagctgttccaaagaaataaaaaagataaatatcctccattatgcaagtgacaatattttattttcataaatcaagaatgacctttatcaacaactagccttgctgtctaataattgccaggaaaaaaaaagaaagagaattcaacttttgtaagtcaaaagccataatttgtggagacttcattaacatttaacttgcttatagtttccaaccatactagaaaaatgaacaagttcgttgattttgtcacattttgcagttggttcttcctgggatacaccaggacagggctggatggtttgtggaggaaggttaagattgtttttgttgttcagatgtttattatgcttcttttggaaatttccaggcaaaataattgcagccagattttgcatagaactttgggggattcattacctatccttttaaaaaggctttattgggtgtttatcatgcagcctgctctaaggagtaccaaggtgactaagacacagttataatcagtattgctttggagcagattttctactctgcctatgggcttttctgttctgaaactctgtgattttcaggagagaatattgggcccaactccattttctttgatttctaaaacatgtaggatctgcgcatggtggctcatgccttaatcctagtgctttgggaggctgaggtgagaggatcacttgaactcaggagttcagaatcagcaacatagggagatctcgtctctatcaaaggaaaaaaaaatttagctaggcaagatggcatgtgcctgtggtcccaggtactctggaggctgaggtgggaggactgcttgagcctgggagatcaaggctatagtgagctaggactgtgccactgcactcaagcctgagcagcagaatgagatcttgtcttgaaaaacacaaagaataaaaagcatgtgggtctgcacttgaataacattagcacacactacctgcagtttttagttggagtaaatgtgcaaacttatagtagcccacgaagtcattgttgagagcaagagtatccataaagatatatatatatatatttttttttttttttgagttggagtttcactcttgttgcccaggctggagggcaatggcatgatcttggctcactgcaacctccacctcccaggtgcaagtgattctcctgcctcagcctcccgagtagctgggattacaggcatgtgccaccacacctggctaattttgtatttttagtagagatggggtttctccatgttggtcaggctagtcttgaattcccgatctcaggtgatctgcccgccccagcctcccagagtgctgggattacaggtgtgagccacagtgcctggcccataaagataattttaaagcatatttcagttttaatctagaatgcactgggctcccaccaaatcaagcttgttgacttggagtgtggtcacatactgtcataagatgttattgaatgggccctaaacctcattgctctgttctgagggatgctgttgagaactctgttcattaacttccaacaattgcttcttcccagggttctgggaaggaagatagttctctctgaatttagggtgagggtagttgtgtatcttcttggtctccagtttgggagatactatcctgtagtgttaagaatatgggccccttatgactggatgcctggattcaagtatctgcttcacgactctccagctttgagaccttggacaggctgtgtaactttgtatgccttggtttctgtatctgtaaaatgaggatcatagtatctacctcatagagttggtgtgaggattaaacaagtcctgggtaaatgttagtctctattatcagatttatatattattttatagatactgtaaatttatgatcagtcatattttcttctttgcactggctaccccaaaactcaaagtgaaatctgtggataaattccggtacatgaacttagtgactttttaaaaaattttttggtggtgggtgggtggagtcctagccacatttctagtgtccttttctttgctctactttccttgccttttaacttatacttttaacagttttatcgatttaatttttatgttattgtgttgaattgcatgtcttggaacagtataggaatcatcactgtcatcaattacctgggtatttgccatccattgacgcttctttttgcatagtaactcattcttatctagaacctgtgtgttgtattcaaagttgctaaggaaaagcctttcccaaggtatgatggagacatgcaggtacacgtgtgtgtgtgagagacagcgagagagaaaaagagagagaatgagtgatgccaacaccaccccacccagcttgtatcaactttcctccatcttgtatatgacttgggtttagtcgtgatttagtcgtgattcccccctgtgaaacatgaataatttactttgatttaacagagaaatatagtacaaccatggactgctgggagccagtccaggtgtgacagttctggagaaaagttagggagtctgttgctgaccatactgctgtagatgatggcaaaatttgtctgtattattcagaaaatcaagaagactgtatttttagaaatgcgtccttttactgtgtttcaggggactttgcctccttaacatatatttttcattgtcccccatagcatttatttgaagaacctcactaactgcctgttcttggcacttccatgtttaatagaggaacctacaggatgttacctatgtgaatgctcacaactcttcatcttctcatgaagtgcaagttttcaattatatattccaactagttgcaatgaaatgcactcctgagagtgctttgttctatgaggtatatctggcaagaagaatttaagaactgataataattgatgctggctgaacatgcctgactcttgttacactgactttatatttgctgtctgatttaactgtcagaaataccatgtgaggtacatgttatctctgttttttacataaagaatctagacttgggagactaagtgatttgtctaaaatcaccaagctaacagtggaagaattggggatatgcgtgtgtttgactcagaacctatacattttgctattacctaaagctgtcctgaaaactgaaagcttagttgttctttctttacttggttattttaattctgatgtcatttactttaactcatcttattttagctcaataaaccatctttgttattttgggggggtcccacatctgttgaatgaaggctaggggtggatctgaaaattggtgtgcagggaaatgtatcttcactgggaaatatgaaattcatagttgatcccattttccagtagttcaataatcattcataagtcccgaaagaaccatatcatactttatttgtttcatttcaagtgataagaacagctttgtgtaatgggaaaattataacctggcaccagtgttgtattagtcttctgggtttgctctcagccacacgtgcatgcttttgctttatatgtggttctattttagtgcaatagtggttttgtaaaccgggtctgtagccagccttaagttgttttgtggatgcttatcactatttctcactgttttaagatcgcactgtaggactttcatctgagtgctatctgtttccactgggggaccttctctgtcaaaattgaggatttcattctttttgaatgttattagtgctgttgccatttgagcttattgctagaatactgaagctgttttctacatcaaaattagggtttgcaaccgagagacaatacttctcgtaaatgtttgcagtcttctaacatttcgtaccccaaactggaaagttgttagtattacgcatttgaaacaaatccattttgtttctggagttgttaaaactcagtaagagggcaatataaatgacccgttgttgtcaagtgaaatattgaattaagtctgtatcttttgagttgttttgttctcaatggagtgtttagttgaaacaagtaattgttaaaagtgttagagaagacagtgtccagggacactaatttcaccatcagatctggagctaacaactaagacaaatctagaaagctgggacagacagtctgaggctccttgatgctatcctgtttaacattgtttatcagagccttggaggcagatgtagaaagcatgctcatcagatttgcagacaacacaaaactaggtaagatggctattaccacaattgaatgacaatgtcagagttgtagaatggagtgatgcacaaaagcatgagatgggatttaggaaggataaatggagagtcctggatttaattcagaaaaccatctactttcttacaaagtggagagatgactcagtggcagtggtgtacaaaagccgtatgggatttcaggctcgcagaagctgagaatggaccagcaccctgtctgcactgttgagaagagaatgtggttaagggcagtagcccgttgaattctaaacagctgccaggatggttgaagggcctgtaaaccttttagtagcaggaattacagggagcaaagcatactttgcctgttgcctggagaagtgaagacttagaacatgacagctcttttcaaataatcagctttcctgtgcaaaagctaagatcttttttcttttcttttcttttcttttcttttcttttcttttctttctctccttccttcctctcttccttccttcctcccttcgttctttcttttctttctttctttctctttctttctttctttctttctttctttctttctttctttctttctttctttctttctttcttttctttctttctcccttccccttccccttccccttccttccttccttccttccttccttccttccttccttccttccttccttccttccttcttttttttctattttttcacaggctagagcaaagataaatgggtatacatttcaagaagcagagtttggccctttttaaggggggatgttctacatagtcaggatgctttacaaaattctgagtgcctcatctattcagaggctggctggctggctgggaagttgtacagttgacctaagcatttggatagaagttggaccaggtgacctctaacatctgtttttgctctgaggttggacaatggctgttttacttatcttcttgccaacaggacacacattgtggacataatgtaaaaatattcttaaattcatgttttcttgaatgagaacacttaattgtcatcagtggcaaacaattataattttttgaattaatatgattaatagcattatatggatagtagaattttcataataattaataagatcaatttaattaatcactttccccatgtgaaacatggagaaaagatcttatactataaaaagtaacaggaggcattcaagaggatatgagatgggacaaaatcatcaacgtgctgaatgctattgatgctgaaacagctgaattactatgtatattttgcattttctattattctttgttttttttttaagtagtttcatttctagtaccagaattcagcagatgtttaccacatgcttagtctcgaatttatttttccctttaaaacttgtgtggactgtaagtgaatttatcatctcttttgattttgagacctcatatctccaaagtattaaagtaaaacctgtttctttgttagatttagaataattctttggaaaatattttgcaagctgtaccatggtttgtactgcattttgtcctctattattgtgccaggattgaggtgaaagcatttcttttttcattttttggacaaattataaatgtttcttctttattgaaaacatgttgaacatttaagtcagttctcttaaaatttttaatgcaagagcaatttttcaaattcctatacatctggaaactatgaattttaaatttgcttaggtcttactttcttttttttcttttctttgttttttttttttttttttgtttgtttgttttttgagacagattttcgccctgtcgcccaggctggagtgcaatggcatgatctcggctcactgcaacctccgcctcttgggttcaagcgattctctcagcctcctgagtagctgggattacaggtgcctgccatcatgcccagctaatttttgtatttttgtagagatagggtttcaccatgttggccaggctggcctcgaactcctgacctcaggcgatctggccgcctcagcctcccaaagtgctggtattacaggcatgagccaccatgcccggccagatcttaccttcagctggcttctaccaacattagattgcttttggagagctgcgtaatacagtgatgtgggtgaggcatggttaatactcagcagcactcagcaagggatcactaagtgttggatgcacagctcctgagtggaaagacctaatcagatttagtttggcatcaaacttggcatcaagtctaaggcttcctgcaatcatcatagcttattctagaggtctggttggtatttacattactttttattcttttacattttaggtggctgcctctttgatgagccgtatagcacatgtggatatagtcaatctgaaggtgatgacttcaattgggagcaagtgaacaccttgactaaaccgacttctgatccatggatgccatcaggtttgcttttagttttaagttttgttttaaagaggaacacaagagtctcaatcatactatgtgttcactggatattggttaaatgagtgacggtgttggtctttggatgtggcagtcaaagttggattagctagtgagagtggtgcaattaacaggataggttataaaagttttatctctctccccttaaagtctaaattatacttcttttatttgcaagtacatcttagctagattagtgggcattacccagttgatcttttcccaagcagcaaatatgagaaaaagattgagatctcttctggtaaatgtgtctaagtgttagaactccagttggggaatccaaataacagtctccataggaggccttggtgggggacttttcttagcctcaggggctcccttggcacctgggagatctaggagaatgcccagtgatcttgaaagttttctgaagacaaaatggcaatgcaaaaatgtgggtattttttccactgaagaaatgtttagtgaatttctgatgagtgaaagatgtgttccactgaacaccaaaaagaattttacttcttgttgggagggaaaagtaggaagatggtgactagtgagctctaatcagcttggagcttgattattgcaatggaccctttttcaggctatgacattggacatccctttaggactttaggtctgcagatttggtgataagtttgctccactcaggattcaaactgtgaaacatgttgttctgatttggatttcagatacaacacaatttttacactttttaatgaatgcagagtttttcattaatgctccaaagcgtaggaataattacacttagtaagtaatcttgtaaaggtagcttttaaacgtgaagtagagtttaatgttgtcactaaggtttaacagtatgatgctcactgtgttcctgccctctccttcctacatttaactacttataacttcaaagaagggagcattgagctctttatcactgtggcttcactggacctcaaaacctttttagctgttggttatttccttgcagctgcagctcacaccctccttttctgtgtctcttgttttctttgtatgtgtgtgtgctgttgaatatgactgtttaaatcaggtttagttgcttttccaaattccagttcctgcttctgttcttgtcagcgataaagagaggggaagaggagaacacagctgtgctcctcctgtggggccgtcgtttcccaaacaggtgtcttcccctgatggccttttggtctttcctgccctctcaagaggatccagcctgtgtccagagaggctgggctagctgaggctgtgagagtggggagggtccttagatttagtcctggtagattgccccagaagagtgcacttactcttgctttgtctattaactcctcatttgataaaaaatttgaaatatttcacattaggtagttgacttcattatttttgttcttaaattgaaacttgacttgaaaaaatcagcttttaaaaataagcccaagtatttcagaatcttttctagcctctcctgactctgtttctggcacaagataactcacctcccttgataaatgaggccaaataaataatttcttgtcaccatcttgtccttttctttttttcaatggcccaccttagactaagttgtcaactttaaaatattaaaatcataggtttctagcacaggccgttaaaaaaatggtagtaaagttcaaagcccaggtgtatcctggcacagccagttaggtaattgaaagaacaaaggtgaatgaagaggaagtgatgctgcacatatatggcctttgaaggctcttctgacttgagaagaatgacatggaggcatttatatgttttcttatgatttattcttctattgattaatagaatacttgataattaatattaggcctttgtagcataagatctgtgagtgttacatcttgtaacgcttttgtcaagtctgacttatttctgatagttacagaaggtgtgttttggaccctcacccccaaacagattgcaactcattgtttggacctgagagtggtttaggtgtcagcatttgagtgaggaaagggaaggactggcagttcccccacctctctggctgtgcttatgtgcatgggtgcagctcagatttctgaaaactattgttgctccatcagattaaatatttttgccataatatagaactgaaaatacagtttttctttttctttctttttttttttactactcattaaacaaactttagtcattagaaattgtttttgagccccaatgtatgctaaacatgatggtaattattgtaggagaggaaggattataagaaatgactttttctctttaggaacttatctacttggggaaaaaaagttacaaaaatacaattagtgaacaatctaaaatgatatataattaagtgtgctatagactggaagtgttctaaaagcagtttctcaatatcaacccaatattttataaaagaatgtggagctgtgcccagctgacccatcgaccaaagtgaggagttacattctcaaagcaccgttgttagaagtgaggaaacagcatcttataaacatgcatgtactatcctaaagtctagatttttaaactgagtttccaatatgtatatacagccataagttttaaatgcttcttagtttccagggttttcaccttctttttcttctcctcttccattaatgtgtgcaaatgatttattcctttcaaaaactgattccaaggctggttttcccatgctaaaacagaaatgactcttatgaatttctcagggcaaatgggtgggaaaatcagatagaaccatagctttctgagggcaaattttctaaacctttatgtaaaatactattggatttattctttcatgggtatgtgtatttgtcttatgtatataggttggttccgtaacactttagagaccaagagttggcaaactgccctgctggtcaaatccagctcgctgctagtttttgtgtggcttgtgagctaagagtggttgttacatgttttaatagttaaaaaaaaagcaaaaagaataataaaattttgtgatgtgaaattcaaaatgcagcgtttacaagttttactgacacacagccatgcccatttgtttaaatggtgtcagtggttggtttcaagctacagtgagagtttagtagtggcaacagagactggtccacaaagcgtaagatatttatgccctggccctttatggaaaaatgttgctgatgcccgtcttagaccattttggcatcagcatgtaattgttattttggacccatggtttatattgttgttgttttctatattcatataattattaatatacaaacatttcacattttctctcactttcagaagatgtgttttctaaacattgggctatcaaaatcagtaagaaaaagaaaaaacatgattagagatttcctctatcattgccttaaatttgctatctcttgaaaagcatcgtgatgtgattttctttattttttagtacctaaatctttgtcacagtcctgtaattctaataagtgaataattcatcaagggctgggtgcggtggctcatgcctgtcatgctagcactttgggaggctgaggtgagaggattgcttgagttcagcagttcgagaccaccctggacaacgtgggaagaccccatctttataaatgaagaataataattcatcaagatgaatttaaaagttatgacagtgagagactaacatttcattctaatttttagctttttactttttctgtgtctttttaaaagttagtgctccagtgtatagatttgtttccccatatccttatgtgtgaggttatttttaaccacattttaaaaaattaaaatgcagtttggagttttgtgcaagctggcttgataactactctggagcagtgacgttagctctggaaatacatatttagggggaataaatactaaatgccgtttaaatttttgtatttcaagtgaacattcatgtcatagtagattaaacttttgctgctagctctgagtcatcacggttttcttggtggtgaaaccatgccaaacctaatttctctgttatcagtgagtgagtgattcgtttcatatcagttgatcttctctagtagcaatggggaaatttctttcttttttctttttatttttttgaggcagagtttcgctctttcacccaggctggagtgaagtggcacgatttcagatcactgcaacctctgcagcctcccactaccttcccgccctggttcaagcgattctcctgcctcagcctcccgagtagctgggactacaggcacccaccaccacacccagctagtttttgtatttttagtagagacgaggtttcacggtgttggccaggctggtctcgacctcttgacctcaggtgatccacgtgcctcagcctaccaaagttctaggattacaggcatgagccactgcacccagcccacagtggggaaatttcttgaactttatcataaggattactatttgaacacaaaaatcttgatatagtaacctggtattttttgttagcactgttacatcctatcactttatatactgcagcacattctataattatcacatagattaagaagcattaagaagggttttatgatataaaaacacctacctggtttgataatgtggtattttgtgtacttgtacctcagtgttccagttctatataattgatacttagtagattctatgtgcttaaaaatgtaaccctgtcttataaaaaaattatcaaattcatctacaatattaaaaatgtgaaggtaacttataatcatagctataaccgtagctatttgatactcatgacatgtatttatagtctatgttgtccccttaagttttcttacctctagaaaggctgtaattaagtgaaagtggatatcagtgttgggaaaacataattctcttagtatttttccaggtagtatagcatgggactacataaagctcatttagctttccatgtcttagttatatctgtggggaattgggaatgatgctgctgctaattttcatggaaatgtgactaagaattgaatcacgtctgtgggtgcccgtatgaaagacagagaggaaagtgtcaggatggagcagcgtgtgcactctgtgtgatgacccagaaaatagaaaaatgactacatatatttgtttagagtcaatttcacatttgggaaggaagatggattgacagacaaagtaattgaagttttctctttggatgcacttatcaggcacattttccttgtgctaaggaagacttccctatttattcacacttcaggacttattcaggtcttagagagtaacaaagagaagatgacggtgggcttgaagacttttcccctctaaaatttcagcatgtctccagtgagaaatgtttttggcacagaatattcagacagttctctaattatcctattcattctttcaaatcagtcaacattcaacaaatgtttattaaacacctgctatgtgctatgcattgttttagatgcctgagatttttcaccgagtgaaacaaataaagatcctcttctcagcctaccttaaattcttcgtctgataagatcgttcctggatgggcttacgattatatgctagaaaaccacattttcccacatttattaatgactttctagtggcgagtatttaagaggtaatccaaaatatagttcatcagacccagcacattaaagcatcaaatctagctttccatatagctttcttctctaaaaaaagtaagataaaaagtctaaatcttaggcaagtggcagcacagtattttcagatcagtctgccttagaaaacaaagtaatcttgtacatataaatgacactaagcagtcaacaacatttgcttttttgttctgtatcatttggttctcgtgatgggcctggtagattgggtggcattatcctcattttacaacataggaaactgaagttcagaaaaggaatactttacccaggcatccatggcacaacgacagccttcacttttgttctttggagtacccttatgtattctcttcacgtgagaacatgcatctggggaagaggctagtctttcatttcaggtgcatgcatttggatcttcttgaaatgaatgtgaaggctgttgaccatgggtctacatgccctgcccaggtcagctgctggctctatcaatgtgcagctgttgaccttggtcaagttctgaagctccctgttttagtcctattatctgtaaaatattagtaatagctgttcgtggaacgactactatgggcctggctataggtgctagagctgtagcaatggagtttctagcctcttgatgattaaatcccatggaggaggcaggcagtccacaggtaagggtagaaaatagactgtcatggtgggaagtgccaagagtgctgaagaggaatcaggataagggcttagagagcaatgggggttgcagacagggacagcttttctgaggatgcatctttcagtaaagacctaaatcctgtcaagaccaagaggccatggaggctgagtgatccagcgtagggaagagcaggagtgtgctctgctggagctaggggtgggagtcagaccacataggaccctgaaagccatgggaagacgtttaaaacctacctcaaagagttattgaccaggtgagacccaataacacacaccaggagcttagcctctaacccggcccagtgcaatgttcaacagatttatttcctttattagtattattaaataatttagaggcaatttggtatgaattcatctcttagcttaattttgactcagctaaatgggcagcttttgctaaattcttattttctcttctgaatgacgccaggtaagaaatagaagatataaatcttcatctaatttttgattggattaaaaagccccaagctgaaataagtctattaaaatacaataattaaaaaaagtctttaatcagtatatttgtttcaaaaccctattaatatctcaaatgaaattttcagatatttagatgcagcagtgcctatttttttgagtcaagattttttaagttgtaaaaaattaatgttgaatctgcaaacaatcaaatacactgattttttttctccttcttttattttaggttcgggggtacatgtgtagatttgttaaatgggtaaattacgtgttgctgaggcttggtatacaaatgatcccatcacccaggtagtgagcatagtccccataggtggccttccagcccatacccctgtcccaccattccccccaagcagtccccattgtctatcattcgttcccatgtttgtgtccatctaacagtgttttttatctggatggtaggatttgaggttatggccccagcatttccatctgacacatttcctttataaccaagtctaactttatcataaaaattaacacttaaatgtttgggaggtgggcattgaatttgacatttttttttagttgattctgaataattccagtcactgaacccaagaaatgaaaattgagttactctccttccttgaatatctcattcagttgtccacactgaggctcccacctgagttctagctgtaatataatcactagtgagcattcgtcctccctaggtcttactcagaccaccttggtgaggcttagaatgagtttacagtcagcttttatatggtgaatgatgagacaaagcaaaataaattggactggagttgtagtctctcagcagtttcaaaattacaaaatttagaaaaataactttagatgattatgaaaaaacaaaccatttcatgtcagtgacctgtggggagcacttagtgaaacaccacaggctctgtgtagcctcttttccatgtgcgtggacaccatgtgccccttcagtggcccttactggttgtgtgggtaatgggtgtgtgagggagggttcttcccatgagggagatgctgggtgatggagccaaaggctgggattacgtttcatgttaattaggaaggaaggaaggaaagaaggaaggaaggatggattttagttcttgaattacacatctgatttggtgttttcctccttttaaaaaatgtagtagaatatacatagcgtcaaatttactatgtgaaccatttttaagtgtacagttcagtgcattataaatgcattcacattgtacaaccatcaccattgtccttctccagaacttctgtgtcttcccccaactgaaactctgtacctattaaactctaactcctccttcctcctcccccagccctggcaaccactgttccactttctgtctctatgaatttggccactctaggtagcttatgtaagtggagtcatacagtgctgtccttttgtgtctggcttatttcatgcagcataatgttttcaatgattcagtttttctatacaaaaactttcagagattaaagcagtcattctttaaaaaatattttgatttttaatatcacactgtttcaagggggccaatgtcagccactatattatgtatgaccacttatttcagtagtttatatttaacattcaacaaatgttttcctttaaatttgttccaaattcctgtcttggcagattggaagcttacaaaaagtaagaatagtggctagctgtgttttaaatatttgctaaaaagtatacaaattagcctgtgtttataaataatgtgttttaatagttttatttcctgcttaaatttcccataaaattgtacaagatgacatcataagagttatgtggagccaagtaatggaataaacaggctgatcatgacagatgttgtacatcttttagttagcatctggtagtggagtgggtgagaggtgggagaggtgaggactaagggtgatcagcaaggggatggttatgctacctttcctgaaaatatccaccgaggattcactcagctctcacagcctgtgtgttccacctgtcgggctccatagtgtgagggactcatgctgggcagggccaatttactgggacagagaaacccaccttggcaatatgagtcaagaaagggacaatgagttttgaggtgacactcatggacattcccttagtcccagagtcagaggggttagtgggtagagatggagctgatttttgaaaacattttctctaaagaccagaaagtccaacgcctgaggaagacttcccacttggattcagggcagcagaacagtgccctctctttttattattattttatttatttatttgtttttagagatggggtcttgctttgttgcctgtgttggagtgcagtggcgtgatcatagctcactgcagcatcaaacttgtgggctcaagggatcctcctgcttgggcctctggagtatctgggactataggtgcatgccaccatgcctggctaatttttaattttgtgtgtgtgtgtgtgtgtgtgtgtatgtgtgtgtgtgtgtagagacagggccttgctatcttgcccaggctggtcttgaactcctggactcaagcaatccttctgccttggcctcccaaagcactggaattacaggtggaagccactgtgcccagcccagtggcctctctttactggggtggatccatggagtcacaggggtttggagtgggccatcactgtgctaaccggcacagcccactggccagtggatggtgacgttagaagatccctcacattgacaccaagatggggaaggccttgaaagttctgtgtgacctagggcactgcttcactgtattctccttctgcctgtgggggatcattacagggtcccccataaaaaagtagctgtccagactttccatagtccaagaagtcaaagagccgaatacatttaaataaataattggtaggcctagattatccttttcactttaagaccaggaacaaatagaagttccttcccactgtgaaaggtgatcccaggaattgggtcattcttgtcatacctaactaaaacagagtcaagaggccggaggggaaaagcaccctggacacacaccattgctccaagtatgtcgctctctgccagcccagctgctgaagctgcctgctgtaacctgaaaccagttttatgtaatagttcctggaatacctgctgtgactcctaaaactccttttatcccaccaccttacccaccatcgtcactcaacaatcagagcttgcccagcttctccaaacttttctagtgccaatgaactatggcactagaaattatgtttcagctttttataaaactatgtttcagctttttataaaacctccaaccttctatattcttcagatctaccaagaccacccagtctgcatgtgtgcccaaattgcagctcttttctcctgaataaaacagtaaattcagagattagtctctacatttttattttgacattgacactgctttttgagcactgctgtgtgcaaggtgctgttccagtcaccagggattcagggagacatcagcctgcagtcttccaggccatgtagaagtggtgttgcaagtgaatgctctgggggaagctccatttgtctgctctgagcccaaggaggctgccacccagttggaggccatggggtgagggcaaggggaaggcttccaggaggtgggagcacccaagaggggcaagagaaggtgagtagtgatgctggaacaggtagaaacgccagacagaaggacatcctgtgtaaaggcagtgaggggtgggaagggagcacaggtgttcacaaggctgcctgggaaactgcatgtagttctagggactgccaagtacatggaatgggaagaggaagaggtccagacataggcgatgagctggtgaaggatatgaaggaagagggtgatttgagtgttgatttctggcaaagtgagaagaaaagaaaatatttaactgagtatgtgtagaggaaaattcaaaatttctgataagagtgtctccagaaaagatgtaataaggaaatttggttagtaaatgagtaccaaaaagcatatgaatatgttggagaataccctcgttcttaggagattcatgctgaagtgttaaaagatataagtgttaggatatctttgcagaaaaaagtgtgtgtgtatgttgagagagagagagagcgcgcatgtgtgcagatatggtaagatgttaacaaatgttgagtctaagggaagtgtgcgtttattacttaatttttctgtacttttgaagctaagcaaaatttgcagtataaatgtggggctacaagagacattaattgaggtacaccgacttcgtgtcatgccaacacagtttttctccattggtacattttaggcaaaatgctattccatcaaattgcattgaaagtgtttatttacaaaacccaggttgagccacgtctgcactttctgagcatatcgtgatgatcattggtcattactggagaggtttagtagagctgatggacttatgtaataccgatttggagccactaacttaaagtgtgtaattttaggactttcttaaataggacaaatgcttcacatggttttatgcctcagtgggtgtctcaaatataaagattcttatcctattggtagatattttggtggttaactttgttggaaaatgcataaggaattattacattttatttttggatacatgcttgcattcatttgtatcctatccataatatgggactgaatacagaaaaaatcatacagaatttcttggcagactccactagatgattgtgcagatcattattttaaataagtggactttaatgcatagttaactgatactttattctaggagattgtgatgaattatatcttaaagcaatatgtaaaagcttaagtggtcgaaagagaaataaatatagctatttaattaattgtctgccggacaattgtaatgcctctgtctggtgggtggacaaattgaaacaactgattatgcagcattagtaagtgtctaattggatatgtggggtagcatattaatatagtggcacttttagagagggtgtcactggaaatttgtttttcaaatgaccagtccttatttgtatgctttgagtcctctaatatgtggttgtttcttaattgtatatttccttgctttgtatctttccttgaaagaggtatcttttatatttattctgttacccatagaaaatgcataaaaaattgaaatccttggcataaaacttgaaggtgcagactaggtttgatccagtgcttttcaaagtaagtataaataaatgaggtttctggtagtcatcttgggaaattatgaaaaccatcatatgccttctcatgacacatcttttttctctgttgaagacgcatcctattacacaccttgtgaaaatggtgtcacctccctaattgtactctgtaaacaaaacatcccttagttcctgattgtcctggcttactgtggagtgacaggctgcaatttgccagtaggtcaaccactgaactgatgacaagtgacctttctaacactgcaatcaatgcttgttatttggaaaacaaaatgatacagtttgtattttttagcagatgggtcattgggtcaacccaccactgacatgtgaatttgttacttgggctggatgagtcagttcagacagaaatgttaatttatttgaattgatctgagtcttgctcttataaaaaggtgttggacatttgttgatggcacaaattattacaaataattggttttatacatcagtcaaacaaagacttttagagggcccacttgatacaatagcattatatactagctttgggaagcattcaccataatgtattttctccacacttgatatttctcaatggttttgagaaaacccaatttacataagtgatcttgcatgtgtcatatttaaatagtatctctccccatgttgcctgaaatgtgtttggtgttagaccccatgaagagtcaggaggatgattaagttctggaaaaaatgctgggaagagatgaactgtcataagagatagcccctgtggttgtcagcgttgttgaatgactgcttccagctttcacctgctagaaacatgggaacattgggcatctctgttgcatttgacttagatgttactgcacatgctttggctggtgagtgtgagtgaaagtgacatgtgctattttcaggcagaagctgctagaaccaggatgagagtcaaggtgttctctccccttcttcctgtcatggtgactgtggcagcattgagacgcttttagcccagatgcctgagtgaggaagatgtagaaatgccttcccttgcccctcacacattcacacacactcagatgactgcagtgggtgtgtgcctgaatgagaaataagctgtgttgtatatgccactgagattttggagttgttgaatggttctctaactctttggtcttaggactcctttatactctgtaaatgttttgaaaaatccgcagagcttttgttcaagtgggtaatatctacttctattttctgaattagaaattaaaactgagaaagtttgaaaacacaagagtccataaacatctcttccattgggcatgagagcagtggtgtagacctgtgagagttgagcgtgaactgagaataataaagtcaaataatgtcttcttatgatcatgaaaatagttttgaccttgtggcctccctgaaagggtctcagggatttcaggggtctctggcagatactttgaaaacgactgacctaggccatgctaagtgatgagcatacctcgataagttacagttacaggctcagagaagttgagaaggaaaagaaagaagggaaaaagattttggaagcattgcaaaagactatccctgagtgttagggttttctttttctttttgaataaagtcaatataaataattcattcctgtttttgagaagtagtccctctttatactaataaatgcctattttactaggctatcaaatgaaataatgcacataaaattatattgtatgaagccacataactgtaaatattaattctatgaaggttgagattatgaaatattttgctttggaaaaatatgaaagtatgagtagtattcatatacttagaattaggtgtaggctttctggatggtagagggttggagaaagtgaaatattaaaacatatatgagtgagcttatctaagttccatcagtagtgctgcttctgggagttttaacggtgaaattgtcatatatattgtaatgatgaaataattccaaccccttttatgaagtgtgtagtgacaaaatgatacaaaggtggctaaacatgttttgaaagacttgaaaattgtgcttaatggaaatttcatgtgcatggatagcaaatcccataggtgaatagtcacatgcctatcaatagcccaattctgtaaggcaacatatttatttcctaagaaatgagtcctaacagaatttgctaatatttgaaaggcatcatagacaaacattttctgagctttttgttaatatagccatgggaaaggttaccaagggaatctgatgatctttatagatttgtccagctgttatagatagttaatatttaagcttcaggaaggagacctaagtgggtgacctccctagctttttggttctccttttttttcagtaaatacttatgaagtatgtactgtggaatagctgttattgtatcctaccagataaagaatatcttgggctgggcacagtggctcacacctgtaatcccagcattttggaaagccaaggcaggaggattgcttgagcccagaagttcagtacctgtctgggcaacatagcaagacctgtctctacaaaaataaaaatacaaaattagtcaggcatgttggcacatgtctgtagttccagctgcttgggaggctgaggcaggaggattgcttgagccaaggaggttgaggctgcagcaagccgtgattgtgccactgcactccagcctgggtgatggagtgagaccctgtctttaaatgatgatgatgatgattattattaatattgtcttggaggatctatgtacaaggtttctgaggtcacagatttctgaggttagcaaagttgatcaatgctttacttgacagaaaaatcaagcattagaataatgcactgaatggaagaaaagaaaattaaattcatgaagtggcatagacttgctgaagattaatttcctctactaattggctacccattatggtggtttttgaagcctgggactcacttaagaaagggcttgttatctggagtccctagcaggctgaaaacgctaagatttgatagatgtaatcaagacagccagaagtcgctatctgcccatttgctctggctggcatctttaggaagctgaatacatatcattctcctttctcaagtatagttgtgcttgtgcagggaagggttgccttcgctgagagaccgcttatcttcataaaatgcctatattttgttcatatacggttaccctggcactgaaaagagaaatggttgtgtgttgtttcattgcaacctttaagtaataaaagtctgtagttgtgattagtatgagcattcacattttcttacccctgaaatgaggcagtagcttcttttctcatttaatttatctttaataagattgttgataagctttaagccatgccacactttaaaatttcagtaattccttaaatcccccagcagatggagacgtggaattctttgctccttcactggggcctctgctgttgccccaggtgactttgcttgacttctagttaagatgcagtgtcaggttttgcaaatgagctaatgaatatgctcttttgcatttcttttcctcctcttgttggcctgcttaagagttcttacttacttttgcatctcataaggtcattatcattactgaccttccccagtagatacgaacaatattttctttagagacatattctcagcaaagcacagaagagagaatcctctgagctccaggggagcacgtttaaatcccatgtgagcctttcacaggcagcatcctgcccatgttttgattcagagtaaatcccagaggtcagatgctttttcagccagcagggtaaagtttggtcacggttttctgggatcagcatagcggctagagagcctctcctctgtggcttgtggctctgcatacccactgacacaaagaggaagggattattaacagtcttattttgaaagggtcttctgattcaagtgattatttttctttcctccctgattcacttatatctattttacgagtattaaagaggagatctctctaagacttatctttgacaaatgcaataaaacctttcaaaagtattaattggtgtgaagccctttagaaagtcatgccatttgttgcatttcctgcctttattgctatttctactaatcacctgggaaaaattactggtttttaaattcttaagtccagttctttctaagctgataaactttctcccagtaaattaaaaagaaaaggaaggtaaccttccgaggtagctcatgggagtggttgctaactcttaataattgaaaatgaaagttggttttaaaaaaaaaaacacatatgcaaaataactcaccaaacatgaatcaataaaaaacaaattgtgataaaaggcatgctctttaaaggagctggtagtttgtcatgtttatttattttttattataaggctttcttcattatttgaagactcatcttacaaatgtgttcttttccaagctaaataatgaattacattcatgtaagacatttttacttaccttttatgccattataagagcaaatgacatggttatttcatatatgtctatcgacttactgagatctgagaataggacacatctgaattcagtaggccctgtggtctagatccctttttttttcagattaaagaactttccaaagaaaaggaaactctttgttttttgctaagaatttacataatagaaaaaacgtatgtcttggtgtaacactagatgctgtgacaaataaatctcacaatgtcagtaacactgtggacctttatttcccattcacattatagtctattgtggtcccagcttggaggtggttgggttgggagcttgttacacatagacatcctggttgaaaaggactctgcatcttcaacatgtattttccaagattctagatgtcaagtggacatccagatggcacaggaaaagtccctggaggatctgtgtggaggtttctgtgggctaagtctggaagtggagagaaaggcagctgggagtatggtttagttggatgcacagaagaagaagaaaaggacatttgatgagtagctggcaacttctgccccacttggccttagaggttattacttaataaaatggtcctggtaaattattacaggagaacattatttaaattgaatataatgattacttttttgttctataaaggagtgctatctttaaaaatccaattaattgactaaaataatgttttgagaattaactttatgatgttttgatataaaagtcaagaattaatccataacaactagatcttacacaagtagattttttcctaagctttatattattaaaccataccctaatattttcataaaatattctcttcccttaactctgataatttcccagatagagcaaagatatatgagcatatattgctacttaattcagtaaagcaaatatcattgaataaatgtcagcttttccagggaaaccactgcatataacctctctggataatatatttatcaaaaaatcaatactaaaagtaaacggatttttaatacatctgaaggagcttcttaataaaccaaaatgctaacccataatttaaagctgttggtaccagtaggtacttagagatgacatcataatttttgtagattattcttcatagtggtctgtatgctacatttaattcagtttttactttgtgctggggagatgtgatttattttagaggcatgtaaagactattctggcttctctttccacagaggaaaaccccagaaggtgcatgaagagcctgtggctcttctgatctcttcccttatgttttgctctattcagtgccgggtggttttgcctgttttctcctgtctatcatccctctgaaaacatctgcttaacttccccgggctcataccccttgttatttgggcctgcatttctcaaactcttgctatccattgattatatgactgacacataatacattttttaaaaggtcaatcacaaattttaaaataatttttgaaaaattgtattttaaattaacaaaagtgtttttttgtttgtttgtttttgctttttattttgagatagggtctcattctgtcgccagctggagtgcagtggtgcgatcacggcttactgcagccttcacctccccaggctttggggatcctaccacctcagcctcccaagcagctgggactacacaacacaacactacacctggctaatttttttgttttttgtagagatggggtctttctgtgttgcccatgttgttctcaaactcttgggctcaagtaattcaaccaccttggcctcccagatattaataaaagtagccttttactagtgaaataatttttttaaattttattaccaagttacctacatagatggcccttgagatttctttctgcagactctgcaaggaccaaatcaaggaatgtcccacaattaaaagctggacatttggatatttcaacttggagataataataaatatattcccagaacacagtttgatggcatttggcttgtacattttattgaagtgttagggtgtggtttctagttatgttctgtcatatgcccaataggaaggcagctgttagcgtagttgttaagagcaccctgacttcacctcctcactacgtgacctcattcaggttactgacttctctgagcctcggtttattcgtctgtaaaatggggaagtttatgactcacaccgtgatgttcttataagaagtaaatgagagaatgtgtacagagcttaggacaatgtctgatgcagaatccaattaatcattttcttttcttatgggtactacttttaatattgtatctcacaatgaggagcactttctcttatgttttctcttaaatttttttcacttaccttccttctaaatgacaatgttccactgtagcaaagcagttctccttctccatgcacagtgtacttgaaatgtggttatttggaaatttggctaaaagttggttattttccccattcttccttattcaacagtggctcaagatggggaggattattgatatggaagggaagtggtgggaagggaagggtgtggtcactggagagagcttcatgcccggcctgtgctcagggacctaggtgaggacaggcactcctgcctttgtgcccaaatgttgcatttcctaagaccatcctggcccaccacacccccatcttgtccctatgaaaaccccgagacctttgcaggcagacacacaagcagctggacatcgaggggaaaacattagtggaggaagacataaggggctggaggtcaagaggacatcgaggggaacatagcggcagaagagcacaccaccagacactggcacgccttcggcctacggaacgatgcggaggttagcctggggcagttggaggagagcctgggccactaagtggtccgactccaggggaaaatcatctcccttctggcttccccatctgctgagagctacttccactcaataaaacctcgcactcattctccaatctcacgtgtgatctgattcttccggtacactaaggaaagaactctgggatacagaaatccctctgtccttgtgatagggcagggggtctaattgagctgacttaacacaagccgcctatggatggctaaactaaaagagcacctgtaacacatgcccactggggcttcagctgtaaacattcacccctagacactgctctggggtcggagcccctcacactgcctgtctgtatgctcccctagagattggagcagtggggcactgaagaagtgaactactccccctgtcatataccctgggagggggacaagggaaccattcccgtttcattatgatgttgagttccacctgggtatgtcgtggtgtgagggtgaggacaagaggaccatagggcccaagtctcatcattagactttccacattatcttccaaaaaggatatactataagggatagagacttatgagtaagattaaaagtagaatatgttcatcatatcgccaaacctgctcaatcacactgctgacagtgtaccaagaattagtatttttagtgtactttttagattgtgagtagcgtaactatattacattataattgttattgtttgaagtgttaatatgttaaacatttaaagtaataccacttaaaaattaaatcttggcatctatttaatatgccagggacctcacaatagaattgaaatggactcttggacctcaagttgccctgtaccaactgttccctggggataaatcaggtatggagtggtagttgtggctgtcagctccctccacagatacctggccagtgctccagtagcaccaacctcagaggactgttcccagtctacatcctggcttacaaaagcgaagctcacatatatttaaaagatgctcttctctcgtcaaaagatcaaagttgtagagcactttttccttgtgatcaccagatgtactaagagctgattcacgggcttcactcaggcgtttggctgctggcaggtattgtggatcgtcgttgttctccatcgagtgcctctgattttctgttgccattgtattttggcattagactggtggccagtggtgtcatttgatgtaggaattctgtcagtaagctcttctatcttctctctgaccgtagcctggttcatcagcctttcagctgtttttaggagcgtctcagagtgggatctgttttttaaaactctgaggagatttttaaacctctaaggagaacaattttgaatggtgcctgtgtaactcagggttcttctctttctttcctgacaacattcttaggtttatagaagaaattaattgtgcttgttctggaaaaaaaaaaaaaaagctatattggagtacccagagaagccactttgagactttcgtaaactctttgttatgtctttgtttgtgagagtgttatgatggtcagtttacagaggagttgaggtagatgcattgcaggtcaagttacatctgacctttagctattcatcttctgccttcctattggtactttctctattttggcaaaatctatgaaaccatccctctttgaggtatttttgaatgaacacatactagtttacattgtatatttgtatcacacaaagttttgttcaccaagatattaccactatttttatcgcattttttctttctttctttctttttttttttttttttttagagagacagggtcttgttctgtcacccaggctgaaattcagtggcaagattatagctcactgaaccttgaattcctggcctcaagcaatcctcctgtttcagcctcccaagtagctaggactacaggcatgcaccactacagctaatttttaaattttttatagagacagagtttcactattttgcccaggttggtctcgaactcttgggctcaagtgatcctcctgccttggcctcccaaaatgctaggaataaaccacttttgaaacaggatttgtttttttgaatttggactcaaacaccacacagcaataacaaagatggtagatttaacagatgtgattagtaacaagcagatgatgtaaatacacattaacggatgttcactggtgattggctgaacctgcagagatcagtgcctgtggatggcaggtgccccttatgctcacacaagtcacaggccaggctgcagatcacagtacagatcccctaactttgaattttgaggaaaagaaacacacacatgcgtaacctataagagtaaacaaaaatcacttgcattaccatgcaaacttagaccacatggttcaaaaagtgtgggcaggagggcatgggtacactttttaccctgcctttgctggagccaattcattctgggagagcagcgtgagagctcacctcactccacagcaggtctgagcagggtacagcagtgtcacccaagggggtgtccctgataccgtgggccattcccagtggtaggggagcaggccaaatgccacagtcctctgaggctcaatggctcttcaagtccaccagacttagagcagtggagtccaagcagctctggatgctgttgtcaacctccagtcacatcactgggttcagattcacccccacacccgtatcgccataacacaatgctttacaatctgaggcctaatttagccagtcatctggtgaccatctcaagggacctttgtccagtggtgcactgagcctgagcatgccagcctaaaggggaattttcttgtcatttccctctggatgcgtgtatatagcacacatgtaacttttagggaccaaacaattattaccaaggtgactgtgaacatcatgacttttcttatatttcacatctgtgacacgtatgcagtggctgcatcaccattgggggtcaccagatagaggtcagtgcttcatgatgccacgtgtccatgacagactcagctccactcatgtacctgtcctttttcaccctgagcactggtttctaggttctctaaaatgaagatgaaacgcctacttgagtcgagtgtctagggctgggctttaatcagtgcacatggcctcatctcttgtgaccctgctctactgtcctgaagcacatgcaggtgcctggccttgcctgcctccctgctgtcactgctcatgacactggtctgtgaagcctcctgtcctgtcctgaggtccaccagacatttgctgtttgtcctttgtgctcctgttgctttgtgtggagattaacaaggtgctgcctttatttctctattgcatttgatgtgcccatatccaatgccagcctctcttctccttaagattagggtgttcctccactcagagtagcctcatctctgacccttcagtttgtttgtgtaacgttgcagtgatcttcaacattgcagttgaagatgacaatgttgaaaagagataattttgcagatcatctagatggcttaccagctagttagatgcatgtgaactcatgtgggcttttaggctgttgtctgaaaatactcaattgagcataatcctcacttcttctggccttcaaatgtgggaaagcagcacccaggagaatgtgctgtgatgacagcagcagcagaatccctggaacatcgagttcctagaagattgtctttttcatagcaagggcctggatgacacctgcagtgtttcaggcaatctagtgtgttctttagccacagtcttgagagctgctaatcttaaatttagggtctgcagctgctgctgccagcactggtggacattccttccagctgcagaatcccctctagccactgggatttaatttttaaccttgatatctgccttgacttcggatgtccctgtgctattttcattgaagcaggggaggactcttccattcaagttaggactctctaattagattaattaattaggtcttgtggtctgctggtgataggtaccctagggttagaggtctcccacttgagtgacagagatgagtgagcttgtgatatgctatctgtgcaagaaagagtaaataaaatacccacgagggttggtagttcaaaaatctcatggagattggtagcacaacaatgtgaacatacttaacatgattgaactgtacccttaaaaatggttaagatgggccgggcatggtggctcactcctgtaatcccagcactttgggaggccggggtgggcagatcacagggtcaggagttcgagaccaaccttgccaacatggtgaaaccctgtctctactaaaaatgcaaaaattagctgggcgtggtggcaggcgcctgtaattccagctactcaggaggctgaggcaggagaattgtttgaacctgggaggaggaggttgcagtgagtagagatcatgccattgcactctagcctgggcgacagggcaagaatccgtctcaaaaaaaaaaaaggttaagatggtaaattttgtgtgtattttatcacaattacaaacaaaacttcttaaaaaattacctcaacacctctcaatctctttcagttcagctctgatttttgttttttctttagaccatatttttgtgcatgatgtgaaataagggccaaattcattttccctcttcctttctccttctctctccttatgtcttcttaacactctttttgcttcctgctaacttccaatatggaaactcacattccccaacaccgtaatttaaaagacgattattctctgttctgtacctttgttaaataaatgtaaacacataaacatatacctatatgtatttatgtatctgggctcctcattctgttccattgcttaatttgtccatttttgcaccggtaattacacagacttgacaactatggttgtatgctgtgttttgatatctgctagaccaagtcccaccttgtcccttttcatgttaagagtatcttagatactgttttagtctgtttgtgttgctataacaaaatacccaagactgagtaatttataaataatagaaatttatttcccacagttctggaggctgggatatccaagaccaagttactgatggattttgtgtctggtgaaggctcactgcttccaagatagtgccttgctgctgcatcctcacatggcagaaggaggaagggcaaaagggcagatggagctctctgaagcttcttttataaggacatgaatcctctccatgaggacagagctttcagggcccaatcatctcccaagtgccccccttcttcatactatcaacttagaagttctaatatatgaattttggagagacatgcacattcaagtcatagccaatactactggcatttccatgtgaaccttaaagggaacttgtcaagtaaggctttggttatattaaatctatagatcagtttgggagaggttaatgtctgcaatatatcatgtcttttaatcagtggttttgatatccccatttatttagatcttcttttttcttgctaattgaggcatgaatatatataccttttaaagaatatatataatctacttacctgataattccttgaacacctttggttagatttattcttgttagttgatattttttgatgcaattataaatgttgtctttttaaaaaaaatgttgctgatacatagaaatgtattctacatttttatgttgaacatgtatcttcctgccttgttaacttcagttacaaattctttaaggttttctgtagattattctgtaatttttatatgcatatataacatccttattttgttcctgatcttaaaaggaaatatttccatgaaacatcattaatcattaaataatggtatttactaagatccctttatgctgtccttacctttaactggggtacaaggcatggcagtatctgtgaaagtgacaggatactaccctgccctaaatctagtaagtattgtgggatatttggatttgggcatcttacaaatatgaatctaggtgtatcctaagcaataaagttgtcccagctactgcaagcccacattaattgtacctattactagtatgaacattggaaacattaaatcccccccttcagttgatagcacttacgttaaatagccaggtgagcgccaaagcatacactaaatctattacagcgctgcccaatgtcatttttggtcatggtggaaatattaacagccatgcattgcttaaccacagggatatgttctgagaaatgactgaaaatatgtttatcagtcttttgtttataaattcatgtttttcctccaatgcaatggaaccttgtgcatgatactgggggcaatggtaagctcttactactctaaagggagtggctgagggcaaggtcagatgcatcagagaatatagtaaataagtttcaaagtgtatttgtagccatcacatgcaatacaaaataacagaaagcaagttgtcttattaatttaaggcacccagtttgacaggttggagtatcatgtaatggacaaatcaaataattgaataagaattttcaaagaagtaatccaaatcttagttatccaatttaaaggttacagttggtcatatagtcatgtgtcttttaatagcagggatacattctgagaaatgcattgttcaggcagttctatccttgtgcaaagatgataaagtgtacttacacaaacctagatagtagagcctataagacatgttggctgtatggtataccctattgctcctgggttacaaacctgtacagcatgttactgtactgaatactgtaggtaattgcaacacaatgataagtattaacgtatctaaacatatgatggcatagaagacttagaaaatatggcatgcaagataaaaacggcacagctgtatagggcacttacaatgaatggagcttgcaggattggaagttgctctggatgggtcagtgagtgagtggtgagtgaatgggaaggtctaggacattacttgacactactgtggattttataaacactgtgcacttaggctgcattaaatttatttaaaaatattttcttcaataataaattaaccttagcctactgtactgttattttataaatttataatttttaaaaaaactttgacttttgtaataacacttagcttaaaacacaaacatacagctgtataaaaatattttctttatatacttattctataagcctttttcaatttttaaaaatttattgatttttttctttactttttaaacatttttgttaaaaagtaagaccaaacatcttaccctaggcctagaattggtcactgatatatcactgtcttcaacctccacatcttgtcccactcactggaaggtcttcagaggcagtaacatgcatagagctgtcatctcctaggataacagtgccttcttctggacacctcccgatggacctacctgaggctgtttcactttttttttcatatgtagaaggagtacactctaaaataacaacaaaagtatagtatagcaaattcataaaccagtaacatagtcatttattacctttatcaagtattatgtactgtacatgatgcatgttctgtatttttacatgactcgcagcacggaaggctttttacactagcagcaacactaacacatgagcactgcgttgcactatgataggatgactgtagtgtcactaggcgataggaatttttcagctcccttaaagtcttatgggaccatccttgtacatgtagtccatcattggctgaaatgctgttgtgtggtgcatgattgtatatttgtgctgtccagtatggtagccactaggtgcatatgaccattgaacatgaaacctggctagcatcactgaggaactgaagttttaattaataaattttaaatttagataggcagatgtagctagtgcttactatattggagagtatagtggagaaagtacatttagaaatatcctatgtccttccttctcttagggatagcagcctttgggcagaagaactttctccttctcccctctcccttctctgaggttctcaccgaccttttccagtttgccgcagctgctaagcttcacttgccacttgtttcctgaggatcatcaccttgggcagtccactcagcctgtttcaccttctgactctgtttgctcagggtcccgctgctgcctcctgtgtccctaaagaaaggagtaaatgtgctctctctttccaaggggccactactgggtcagggaattgttttatttatttcacccagtaaatgatttcagagctttcaaagttaagggcagaggacggtaaagatgatgccacatcacctaggcaaggttgttggaactccagagggttggatggggtttgttcatggaggattaccactgagacatggggacagaggggagccctggtgacagaggacaccagatactcgttggcatcagcatttaagggaaatgtagtttatttctgccctgttttctgatactttaatatgacagcccactgccgttattacaaatgtgtagtatttaacgctgtattgcaatttggaaagactcctagataaatctgaacaagcgattatgtcactttggaatccgatttcctagtaaattgatttttttcctgcaataagaaagctagtatatttcatttctacagaaagtatgacatctttttattgattctttgattcagtcattgataacatcattcactcaacaaatgattattgaaaaactgttatgtttcatgcactctgctgtgtagaatatactcaaatgtaaaaaaactcagggaagttacagtttactggggatatagacaaataattctaattgtataatggcagttagaattatgggatgtcaatgctgggtaatacagagtgttacggaagcatggaagaggggaacctaacatgggtggtcatacaatgcttcagaaagggggtagtatccaatctgagaccaccagaactgtaagcatttatggtgggaggatggggaaaggaagaatgttctagataaatatattggcaggttattgctgttgtaacaagttaccacacactttgtagcttatattaagaaaaaacttcttatcttactgttctagagactagaaacccccaaatgcatctcactgggctaaactcaggaggttggcagggctgcattgcttctggaggctctcagggagagtcagtttccttactttttccagcttacaaaggctgcttgctgtccttgggttgtgcttctttatcttcaaagccaggagctggacatctttaaatccctaaccctagcctcttgccttgttcttccacttgtaaggactcttgtgattatgtggagcccacctggataatctccccatctccaggtcagctgctgagcaactttaattccctctttccatgtaatttaacatcctcatgcattctggggattaagacacggacatcattggggctgctattattctgcatactacagcagacaaaagaacaaagtatgtatgtagagctgaaataaatttagcatggctgaaggttagcccatggggaaggagatgagaagagaaggggctgaagaaggaagccaggtaaaaatgtgattgaatttcattctaaggaaaatgaggggctgttaaagaatgatattaatgtaattagatttgagttattgaaaacttcctctacctgcatttggaggctcttcacggacaacacatgcctacttcactgactataaattgaagctaattaacttagaattatcggagcttaacccgaaatctgagatagtaaagaaaaaaaagaatgtctgtatgtgtaggcagaagatcaaaaaagcaattctgaaaagaatttgattacaggctgttcaagatattgatcaatatttggatgaagactctttcatctggtgaatacccaggtgagcctaaacttacacaagaggatttactggtttatgtaagtgaaaattccaaaggtactcccttaggtatagcagagtccagaggctcaaatgatgccattgctgctctcctctgcattgacttcatcatcggttggggtggactcttcccttgtggagctaagatgtcagcaacagctgtgggctgttaccctcctggatcacacaccccaacactgaggggggtgggctggcagtagttcaagtagaagtcctggagttgagtctcactagaccaccttgagttgtgtgttcatttctgagccagtcactgtggccagggagatgtgatcttgggcaggccggagttaatagttgactaccctgctattcaggcaactccgaaagcttgcttctgtaaatagcagtatgttttgagagccgggctctgagctttgtaaccaaaattcaattaaaactgtttaaatggggccactgtgtaaatttctttgtcatatgttattagtatggatctaaaaacctatcatattattgctgttctctgattgttctctacagatgggcctggatttgaaatcttaagatgtacatgtctatgttctgtcaaattttcatttaaaatcagcacaaaggcttttggtaattgacatcatttgcctgacttcgaaagtggaaatatttaattaaactttatataataatgaaagaaaatcatgcttttattttagatcactttcttcccttgagcaactgactgtctctttcagtctttgtcagcagatttaatctcacttccagtaaatgcttttccatcacattatcttcattaaaatacagatgttcattagaatcatcccatgttctttagacattgagtacgtaatgacattctgctcccagcatttctgtcatttgtgccttaatgtttgtaaatggggcatctcttttcttttaagggtacaatttcagattgagccaatggaaaatatattcgagtgtggttatttccctgattggctttatttatgttaaaagtgacagaagcacttgaagtcactcttcgtctttatcctcttcttctcagaggtgctgctgtttactactcagccttcaccaacacatctctgcagatgacttgaagcacatctccaaacctgacacatttttctacttccatttccagctttgtttttcacataacagttttgtgaacttaacatctcttaaaccgccctcattatctctgatgtctctgctgtgctgacatcccacgttcacactctcaccacagctcatcatttcttctctagcagtttctacccatttctttccagaatgattgctaccaactatttagtgccttataagatttctgaacctcttcaataacctgctgtgcttctgtttatgagctctttcacttccatcttggtacaactgagataaaaaaactttctaaaacactattaaagcttgaagcgttttgagagttgagctttatattcccactccttcttttgacagtaggttgagaagcaatttttctcaagtattaacccttggtgattgtattatttactcaatacttacttgttctgtgtgcagctgtcttatcttttagtctggactgtaacttcttggagggcagaagacatggtttatactttcctgtacgaagtgtatacagaactgagtactaatctttataaaaggtaaatgcttagtaaatttactatgaagatgataaaagggagttttgaggttgaggaggctgtctttttttcagaatggcagaatcagttaaaatggatagcacccttcaatcctaaatcaaagactagaaaaacataccatatttgtaatgttaaaagtattttaagaatacgtactcaagcttaaaatcaagaaagggaattcttcaggtgtcagaaatgaagagggaggccacagcattgaatggcaaggggaataacttgagaagatctgtgtagtggggtctacagttttaagcagaggctgcaggctgccagcctagtggcataccagaagtgggctgagacttgggcagggcactcccactggacatactctgaactgaacccacagtggaaactgggccctagctttcccttttctgtttgatgagccaaattttcattgtgtggaagaaccaagctcaggaactaatgtcaaatttggtctgcaaattcagacaccccatatgacctcatcagggatgtctccacaacccaggttactcaagggacttccacgaggataaaggattctgaattattatgagctcacagacaaatattgcaagcatattagaaaatccactgggtgatagctagtcagcagacacagaaacaagattaatcaattacagataataaacactaaaggaccacaacctgcaaggaacaataagggcattaaaattaatcacagactaatttggggaaaggggagtctacaaattaaaatatagcaatgaaaaattttaaaaaatcaattgactgatttatgagcaaaaagggcatcattgtcttggaaagatggagccacaaccacattctgtattattttgtgcagtgcagtgctgggctgtggccagagactctggccgctctgtggagcgcaggcactgctggtggtaaggacattcttcatttattttccccctttctctttaaatttagatgaccttattttagttgcctttgtaatgtggaggtgaatttataatctttgtttacaaagaacagggtaatacaccagctggtaagatgatgcaaaagcctaaaattgtgctagtgatggaagggagaacctatgggaagaaggttgctttttggaagacaaaactttgttttctttttctttttcccattttccctgactgcattgtgttctgtgccagaggtttgtggccctctgcctttcccacctccctttggggtagctacaggtagtatctccttcatctgtggcacctgggcagtgctttttttgagagtcttgctttgggcagtggtgctcatcatgaaataagcaattttcattttgtatcctagatttttctcctatgctagacctgggtctgcttccaagtgttcacgctttttcacggatttcagttttcaaagttggaagtgttgaatgtgttttcttgtagtgctgatatagagtagatttgtgatgagatgtttactaccatgtctcttccaggaaagactcttcttacactgccatggaacatggtcagcaaatacagaaggcagaaacagtaaacttcctgtaagctaacttgactaaagtttattaaaatgcaggatattcagctgttctttgacactttagtggttgctttaaattaaaaacagctgatacgcataggtttttaagaagcttgttcttgccccatccacaagttcttctatttatccaacccccaccacctcccgcccatgttgtgtgtcccacaataagggatttctggatgtctaattaaagttacttaaatatcaaaaaggcagctagaaaagaaggtgtgtctgtgccactcatgtgattgcctgcatttctttttgttgttgttgtcatctaagtgatttttggaagcccccaagtgaaaaaacaagtgcaccactctgttgagaaatgaaagataaacatagcataattggctaagactaggatcatgacgtgatgtgtgcctgtgtcgtattgctgacgtttatgtggttgaagaattacatctaagtaatatttgaatatatgcgatttttgacttcataataattgacgcagtgtgggtagagtctatgtaatgttaccgttggttaaatgggtgtaggttttgccccccataatttaccctgcaggtacaaacataaccttttattttttactcctcggattcgtggctctttttttctcactccagagataaagtagcatatctttcctgctgtccaaggaagacgagtgttcctgtgtccctgcgtcttatgcatattcataacacactgaaccctggtggttgtgagcgatggatggagcttcagggattgtattataggcagtctccaaaccgtgtgtttgccaatatttctttgttcatctctatttcatcaaatctgtgaactagaaacaagattgacagcatggaattcaattttccctttccgtgttttctggcactcccttggataattagagccatgtgatgaagtggtgcagacggaggtggaggtggctgagggcacagaggagaagcagggtgggggtgctggtctaggaggcccccctccatccatgtagaggcgagttagatttggtcttaacagtggggaaaatagaacttatttactgtgagattccacccagtaatttctgggatgaaatctgtgtcttcttaatttaaatggatgaacctcactgcatgtggaaaacatagcctgcctttcttacagaaactctgcctttgtgaggattaaagcaaagagttgtcctaatttttaattcttcactggattcaagtcataggaaatgagcctgaatttggtgacatacttcagatttttttctgttgtgctcaatcttattgtttgacaaaggactgaggttgaactgttgaagttacatatgcaaaatcaaaagatctcagctaatcttgaggaaagtttttgatgggttggataggaagttaaactctaaatataagaaatgacaaatgtgttagaatagagaacattttattagcttattggtattataactgtctcctgagtttccttcaatgtgtgactctaatattctataatattcaacgtgaatttgcagtgagtataagatgttcacatctgatttgtagcacattcctcattggaagaaacataagcaatacagacttccagattttaacaacaacagtaataacagctgctgattatggagtacctgctctaagtcagacgccctgggaggttttccccatgaatttaattctcagcagtcattacccacatgtgacagttaaggaccctgagacttgaggaggctaaggattcaatctcagtccctggagctggtgggtgttcccatgaggcttctagcctggctttctctctcatcagcccccttcatcacctggtgttttccaggatgccggtaggaggcggcaggcaagagagtgaagctctctctccagggcttggccgaattgctctgcttctctgtgctctattttccatctgcaaataacagcacctagctcatgagtagggctccatgagttagttcaggaagcgagatttaaagggtcaccaggcacacaggaagccctcagcaagttcacggtcatgtaggtttccctttcctaccccttccatggtcagctgctgggaccgctcttctcccctagaccaccgcactcacaccccttcttctccagcccaggtgcactgtcatgtgttgccctttccaagacagggtgcaggggaggggataactctgcctctgtagctcctcggtcctccacgtggccactgcccctcctgtgttaccatgacctctcctcctggcctcagctcctggcctgagggcccagcgcctcctttctctgcatttcctaccgtaagctcatcctctgccccaacacccaccctgttgtgattaaatgctctggatacctgagcccctttcggtgttacagtgatgttttactagatcccttcctgtgatgtttatcttccctttgagtttaagatgataaggggagggtgatggtagactagggaggaaagaatgagaggattaaaaagggttgggaacagaagacacaagtgccttaagggataggaactataaaattctgaagaaaacctctaggtgtgttcctgtttcagggaatatctgcaatattacattctttgacaacagattgtccagagagagtgattattcctgagcttctgtgggacttggtgagtttggaataataggaggcaggtggaacctggaggtggggttgggggagaggcaatgagagagccagctggaatcagaaatacccagcttagggatctgcagtagccaaacacccctcgcacctacccgctgcctttgtcaccgcccccaccacctttctcgagctctagtccttgttcctctaggccctgggaactgccctttggcatgttgagcttgagatatgaatgaagataggacctcaaaatgcaagacaaactgaattttcccctggtagcgttttaatctggtagttggtttctgttgtgcatgtgttactgtgctaactgtgaggatacagtgtgttatgttgctcattatgaatagcctggggatgcaaattacttgaagtacatagttttccttaagaacatttattatgatttctatatagtctgcttacaaatgaatttcttgagcaaagcctgtttgtaagcagtggatgtatgcatttgtgcttgattcataaagcattagagttgcaatggaaataacctgagccttagtttcctgagagacacctacttagtagcttgtgtgtgttggggagagactggggtggggggaggagggacaaggatttaaacagagatttgaattgcactgtctgtgaagtttgcaggggggcattaaatctatggattaattcaaacaaaatgtctcatgtatgtaacctttataaactgtgttgtatttattaagcctattttatataaattcagcttcaactagagggttattctccatagcattattttttctattgaaacatacagattttaccaaaaccccttttcattacctttaattctttctgctaggtcataggcaggattttgaattatgctattaatttaacttcattttaaatgaataaaatcagcacatccacagtttggatatttttctgaacgattgaatacttgttttattttatcctttgcccagtaattttttttcaaccaatattgggccagtggccaccagtcatattgcagcataggcaagcagtgtgcctcatgaaataatcctataggaaataaaatatgcaaaaatcaataaggtttcatggaacagtttctgcaaggagcagaaaggcaagcgtggctcaataaagtggcaacagcctgtgacaacaagcctggaactggtttccatcagagacacccttttactgagcacagtgaatatttctgtgatatcctgtccccatgtagcaggagcattttgccctggttgcacagtcccagcaaggggctttgcataggctttgcacaggatgcttgggagactcaaactctctccccaccccgagatggagtcttcctctgctgcttagcatggagctcagtggtgcaatcatagctcactgcagccttgatctctggggctcaagtggtcctcccatctcagcctctcaagtatctgggaatactggcatgtaccaccaagccgagttcatttttttatttttttatttttagtagagataaagtcttgctatgttgcctaagctggtccaaactcccaagctcaagcatttctcccatctcagcctcctaacatgttgggtttacaggcgtgagctactgtgcccagctgaagacttgaagtcttgatgccaaagggagggaggatttgttgtctgctctttggtattcctgagagtgacacatggggctgggttctctgtggcactgttatataagtcaagcagatcccttggaactttatgtgggaagtgttgttgggcaattataatctatattctgaacacttgaaagggttaatataaccagtgtttgggcatttgggtggtgtttgcacatatatggcagcctcttcctgagagactggatagattaatacccagaattactttatgtaaagttttccaggatatgttattggagtgaatttgaactctggttctgaaaccttttatataatagttatgtccatcaaggctcttgtgcactgattcttaatcaagaaaaaatgaattaaatccccttaaatgaattaaacacattttcaatttgatgcgttattaccaactttatctctgtgataacaatattggatgaagtaggcattactgagtgactgacacttctcaaattcccagtttttctctgcccatcattcacttcctttaagtattacttttttccttatttcaggttttcaagtgacttctgacattttaaaaaaccggttttgatgaggccatagattctcttaggtgcattgtgcactgctgttgctcttccttttatctctctccttccataagcaggagcatattttataagctgcttttctctttctagtcgaggtacctggaggcagccccattcacatttgtgggactgatggtgaatggtattttgcagtggaaagtgagcctcttaggtcttaagctccatgggtttaagcacaggaggggcatgagctgctccaggaatctcctgcagctatttataaaaagatggactctttctcttccctaggggacagagtatgatggattgtcatggcagtgtgtgaaaataaaactctacaaagcagcacaggagagctgtgtaatcagtctggaatttaaaatatctacttgccaacttcaccagtgaatgttgaaaactgagacttggaaagtttttttttttttttctttgacagcaatacttgttcaaagtgcactggcttatgatggagaaattgggtctggatggtctagctctttgaagagtgaacattaagtgccactgcacagtgtatgaatgaggcatgaaatgatgccatcagagcagcagtggcgcagaggtgctgggtggatcttgtcagtttgaggttgaaccgaagcacagaagcacagaacagggtatgtctaaaacctgacatggcttctttgtgctattcatgtgcacctagcagtgccttagccacctagctctatgagacatcatgctgacgaattacccctgtgacttacctgtgtgcaggttatgcccactttggtgatgtttcctttctagagggtctctttctcttgttctgtaagagacaaacatatgccagtgccatgttcttccatagaaatgaaagtacgagggataaatgagtgaggggaatggcagagggaaagaaaatgtgaatgtaagggtacagtagatgtacattagtgtgttgtgatctcagtgcagtagattaacgttagtgtgttaggacctcaaggagaaatttaatagctgaatcattgctgagattgacaaagatcaagtgcttggaaccggtagccagtaagactatttctcaaagacagagtgcatcatttatttctgggctctccgtccatgctgcagttcagttattgaatatcctttaatgcaacattcttggtaaccacgtaagaaatactcaaatattgaagacagaggacctggctccagggcacttatcatccagatgtggacccccttcctattcatcctgcttggaacttcgtgggccttctggaccgagaggatatgtgccttcaactctgggtacttttcttctcttatctctttagttttgtctgttaatttctctatattcttttaagtatttcttcttaatttttttttcatattaggcatatgttaaaacttctaagttcttgcttgtcttaactttttttttcacattttttcatctttttttccccctatgggagatgagttgtcttgtgggataattctttggctctgtcttctagattactaatttattcttcagctgtatcctttctcctgtttagaccaaatgttgtttttcctcatttaaaaattgtctaaaaatttcagatcacctttaaaaaattattattaacatggtagtctatctattttcagaccccttttaaaatctcctcttcactttaatacttatttactaaagcattccttatactattggttatatttgctgcttctctttcttggtcttcattttcttcaaatatttaacactttgtggttgtgtacacatctccatgcttgacatctgatggtatacaacttgtgaggttatacttgttttcagctacttttctatagggattgtgggagatgggtgctgagaggggtgtttgcctgtgctgtggggatccccgttcttccagggtcttggcagcctcctgcaacaaacttgctggggcctgctgtgtgtacacactgtatcaggctgggtgtacctcgttaagcacataggtggtaaaataagtaccacggtaaaattatggcttagggctcagggtaaaattataaaaaaggaacagattacatcccactgtgggcaataagaaacactttctgcaggattctgagatgggcctggaagaatggatgatatttcaacagggggtaatgaggaaatgcagtttcggtgtgggcacctgaacggacaaaaggacaggtgtcatggaaaacaggttctgggaaacctgcatcacctaattcactggagagggataatagtgatgctataaatagcaaatgaagtcagttgggctcttatatgtgttgagcaccaccatccatctgaatagttgcttaagccagaaactggggagtggccccagctgcttcttccttcccttcatccagaaagttagcagttcctggattttcctcctctagaatgtccctcaaacctgtcctcttttgtcttttctcatgtctgccacacttgtcttagtcattagcgaaatatccacattttatacttctgttttgaaactgacggaattgtcccagaaaactgatgtttatggtttcttttaaataagtacagaaatttaccctcccagtcttaaatcttgagaaagttacatttatcttatctgagttcctttttcaggaaaccaatcatcagtcctcccagtcttaaatcttgagaaagttacatttatcttatctgagttcctttttcaggaaaccaaccatcagtcctcccagatagtatcaaggaactgaaactttccagatcacagcatcaggacagtgagacaccacacccctcacccaacatgattgcctagcccaccacctactgcctgttggctaactcctcttccttaccctttcctggtcttgttttcccacatgtcattacgtttctttcctgctgtgtaaatccttaattttagttggcttaggagatggatttgagactgatctcccattctcctctgccgcagtacccgaataaagcctggcaatactctttgtcctagtaattggcctcctgtgcggcagcagtgacacctatctgtaccatacctttgacgctttgggggcagttctgtgaaggtgggaaaattgattgtggaataaagtgatacatttggtttggggcatgtttctatcttattaatagtatatttttcctcatagagatgtctactacacagttagaaataaaggcctaagctgggcatcattgcccttgcctgcaatcccagctactaggtaggttgaggtggaaagatcgctcgaggccaggattttgagactgtagtgtgcaatgagcatgcctgtgaatagccactgcgctctagccgggcaataataatattaatatatagatgccctgtctttaaaaaaatatagaaaagaaaagaaatagaggcctagtatttgagggaaaggttattgataaagcagcacattttgaagagattgtagtttaaagtatgggaatagatttaatatatggacagcaaatcaataaagaaaggcaaaatgaggttctactacaaaatcagtggaactcctaaacataaggaaacggctgccctcatgtagtgaacacaagatccacattgtttgaaggacatcagcgtatgttctgtcctctccctttgaagagagtctaatttaacaggtgtgataagacatcagtaatggtgactaatgtatcactgagtgtcaagtgagtgatatgtgccttaggtcccagtttatattctggaaggtctaatagctttaccaaagccaaagaattctgtgataaaataagcttggcagttcctttactccaggacttggtaaagttaacacatctgattatatacaatattttccccaccaagtactggaaacttgtgttctgctggttaaggactatttctctgttgtggtaatccctagaagctagagtctcagagttcatatggcatagacagttggcatagagatcttccaattagtttcttccaacttttctcttgcatataacctagaagaatttttaaacaataatgtaaataatatacttccctcatatacttgtaaattgacatgcaaagcttttaagaattgtaagttgcaaaataggaataaaggatgtcatttctaataaattacaaatcttggcacttaaaaattaagtggtataattattcttctaaagatgtcatctagaatctacattcgttagtattgtgaggtcaatttttttaatattaaatcatgaacaagttcttctttaacatttagaaattttacgtcattcctttttcttggagtcatttcattctacatcctccattgaatttacttctaatatcatgtgtttgcttccttaacacttttatagctcaccctttcatgtttctctacatctaaaataaacatataaattaaaggaatactttacaaaagtctcattaccataaagttctgttgtaaaagcaaattcttctggattgagtcatcattacaatgatcagtaacacacagttgatctgaacaacatagatatactcagggcggataaataatagttaagcataataactgaaatttcatttgaaatgcatctctttgagaagaaaacgtcttttattttttctagttagttaattaatttttttttttttttttgagatggggtctcactctggcgcccaggctggagggcaggggcgtgatctcggctcactgcaacctctgcctcgtgggttcaagtgattctcttgcctcagcctcccgagtagctgggattacagacatgtgccactatgcctggctaatttttgtatttttactagaaacagggttttgccatgttggccaggctggtcttgaactcctgacctcaggtgatctgcccgcctcggcatcccaaagtgttgggattaaagacatgagctgctgcccccagcctttttctagttagtttatttacctatgagtgataatgatatattgctataacgggtatcagtagatcatattgataatccagtgtaaacctgacattaaggaaagatacagtggtacctcataaaatatttatgtattatgtgtaataagttgatagaaatgtaatattagataccatttggggttattattgtactactcctgctcttttctagtaattaacagttggccactacaaacttgcacttggataaaatataaaatgtgttttttataattacaaaagggttcctagctttatgaaagattttaaatgattcaatatgtgaagtgatttctatgctctttttctatcatattattccatgaaataaggcattcttgtacagggatgaactttggctgttctgttttgctgtaacagtatgatggatagcattatctctggtaggataattggggtcagattgtaaaactggagttgcgtttgcaccatgtgattctcagaagtcttgggatgtgcagatccaaggcagcctgtcgtgttcctgtgtgctgtcttagtctgactgctggtctccgcttggagtaagactcccggaagctggaagggaatgaggctacagacctctctatttgagctttgaaagaagaaaaaatgtttccgtccagaaaagaaagctccgcaaggcagatggtacacagggaaggtggtgtctgtccttaacctcacactccctgggtcagggcagcctagggattttgcaagttattcacttccctcctccagggcaaaattatttcccttttatcttagccaacaccctctttggaggaagctcttcattagagttgtgtgggaaaaatgtcacttaatttctagggaatatgattttatacaacagcagtctctcttctctactaatttagttttttttccgacgagtcttgtattggaaagtagcttaatagttaagaaactagtattaatttctttggttaggtctaggtattatggcctctccatgagagctttaaaatgtatctaaccattcagttcctttacttcgttcagtcattcacaaacagttttgactccatcctagggtaagattaattccttccttctttgtgcctcttcctaccaggtacagactaacatcctagctcctgcaacactcacttgctccctgcgtgcctggtgtcctcctactggactctgaggttgtattcatctatgtatctactctagaaggtgggatacacagtgaattctgagagaggataaagaaagaactgccctaagcacttggacagtatttaatcctctctttcttttagtagctatgatatcttggggcagcttttgctcccccaaaatggaagtaacaataagccctgctcacagagttgtggttgaaattaaacatcagtaaaacactctctctgcaggtgtgaaatgcttaattcatatgaagtgccactcttagtgttactggtggagcaaatgcacaaatgaatgagagaggatttattgattctgtgaggcttgtgaacacagctcctgctgtccatggaggattcatgttccagtagagctggatacatacaatgtgtcgtgagagtacagaagggtggagaggattatagacagagccctagaaacctcaggtgtgaaaagtgtaattctttttaaggttaggcttgaggaagcttcctgggagaggtaaggcctgagcagtgatttgaggaaagggtattattcttgtctagatggtcagtatggtaaagtacagatagtgggcctgagaaatgtccagtggtttcttacttctatggtgttattgatatggaagaggggcaggggagtcctgggaggagaaggtgggcccctggcttgggcttcacccccaggcctgtgcctgtggacataggtgaggacaggcactcctgcttttgtacccaaatgttgcatttcccaagaccaccctggcctgccatgcccccttcctgtgcctataaaaactatgagaccctagcaggtagatacacaagctgctggatgttgagaggaacacattggcggaagaagatagaagcggctggatgttgaggggagcacactggcagaagagcacaccgacaaaagagcacaccgacagttgtcatcaaccagtggaatgacgcagaatttggccagggcagaggagagcccaggccactaagtggctcaactctaggggaaaagcatctcccttctggctcccccatctgctgagagctacttccactcaataaaacctcgtcctcattctccaagcccacaggtgatctgattcttctagtacaccaaggcaagaaccctgggatacagaaagccctctgtccttgcagtaaggcagggctctaatggagctgactaacacaagctgcctatggacaggggcttcagctgtaaacattcatgcctagacactgctgtggagtcagaaccccacagcctgtctgtctgtatgctcccctagaggtttgagctgtggggcgctgaagaagcaagccataccaccatcgcatgtcctaagagggggacaagggatctcttcttgtttcattttgaaggggaaggggcctggagcgggaagcagacccctccatgaaggacttttccccaagaggcagccaggagccattgaagtgatacataaagtggatggtctcatgttaatttgtgaagtcaccaacccctgtttgtgaagtgcgttgctaataaatacttttgctttatcttaagcttgggtgaaactgtgcaggatcttctgggaaagacatggaggggtctcttacaagacctcttgttgtgcctgcctgtatccagcttccaattagctatatccactcttagccagatgccatactcaatggcagtgggaagctttgtccttggagctgcctgccacaggtacatctacagaggtacgttagttccttggctgtgagctgcaaggagggcctggccggggattggtgagggcctgctctgctcagagggtcaattaaataactaggttcaagctgccctagctcattccagtcaacaggcacctccaactgaataaaaggtcattatcctagaatgtggcctctgcaagtcttcagacaataacccccaaatccattcactttacacaaacttgctttacttttattttttgtgtgattcttgaggagagaacacttagaatctgttggcaagacactgattttgactgtagaggtaattatgacagacaccctagcagctttattgctggaaactggccccttcgaggcacccccagtcagagtgtgttccctgaagagcctcgcctcttcagttcagaaatgtttccctggaaggttccaggcctcttatgttgccaggctgatgatcctctgggcacagccacctcccgtgggtgacttccccggaaagcaccacggtggcctcgcctctctttggcttctctcatggcagctgggccctttccattgattcttcacagcacagagaccaaactgccatttgcagcctgcctttgccagaggcttagctgctgtggagggaagtgcggcatggaaatagagcagcaggtcaaggtctacacatgagctcttctgctggctcccacctgcctcccccagccctggtcagctgccccccaaggactgggagagttccacaagtcagcctgccttgtggagctactgattagagaaagaggaggaaattcttctgtaacctgaattcaaatcccacctcctcattccctcctaggaatggtctcagtgttagtggtggagagaaaacccatctggtagaactcactctcagccccaggacgttgttctggctctatggcttagcaaggcaatcccataatagtctaccatggacactctccatagtctgggttcctttgagttaaacaacaccttattgggtagtatgtgaacagtctcatccaaggtgggctgtgccatgcagggacagttgcttttcagtccctctccagttagaatctagagaaatatcactgtgaaacaaggaaaagacattcttgttgccgaatgtgataatgtgttctagatgcctatgtaaagtagccctttttttactcataagacaaatacttagaattatgatggaatatggtagtttcctcttatccacaagagatacgttccaagtcccctagtggatgcctgaaaccaccgaggcaagtaccgaatcctatatatactatgtttttttcctatgcatatatacctatgatgatgtttaatttataaattgggcacagaaagagttgaacaacaacaataataaaatagaacaattataataatttgccagtatcactagtcttgtgctttggggtcattatgaagtaaaataagagttccttgaacacaaacactgcaataccccaacagttggcctcataactgagctggctactaagtgatttgtgggcagggcaggtggtatctacagcatggatctactggtcaaagggatggttcctatcctgggcaggacagagtaacatagaatgagatttcatcacactgcttagaacaatgcacagcttgaaacttaggaattgtttatttctgaaatttgccccatgatatttttggaccatatttaatcatgggtaactgacaccatggaaaacaaagcagcagatgagggaggactactatattgccacattataaatatagctgcttaagatgtaactccaaatatagttctacttccttccttcgtcaaatattattttacatttatatttattgacatcaccttgcccctgatgtgtacttttaaactatactttacctctctctgatgctcaatacttcttgtcccccatcaagtttcacaggaggtgtgtgtatatccagagctattgaagcaaactctaaactatctcatccacttcagaatgcctggcctgggctataatgtggaaatatacttacctccccttgtgatttatttgagtcaaaacaatttctagctataacatttccatttatagtgactgagaaaaaggggcaacattagtgatagaactcattcatttgcatttgacttgagagtttctgttctgattggtactttctatactatgaacttatggactgatatttacaatttcgccaatagatagagtcaccagagaatcttgcatataaaatgggcacagaatatttgtaggtttagtttcattgctcaggctctttgatgtgttctgtgggtgggagaggagtgttatctccagcttgttctgcattgtcattttttaaggcgagccaagcattctcaagttgcttttgctttcattacaacccttagaatgaattctctcaaggcctctgcggaccttgaactaaacccacctaaataaatggccaaattctactctgccttcttagtttttgtccctgtcacctgaaatgcttagcctctcatggcttccctggtgtcacacactcatgagcctattcttggccgtcctctcttgttttcacactgccttttgcacttcctttcctgccgcagctgtgtgctgtgggccaggcttgctctccggggaacatttgttgtatagtctccgtgacatcctgtgcagtgtaggatgttcagcagcattcctggcctctgcccactagatgtacacccctcttggcactcagaaatgtgtctagacattgccacctgtcctctgggagacaagagtctcccctggttgagaaccactgtcctaatgtttctcctatttgtagtatccgttctactcttgttgccctattcaggatttaatattccatagccccaggatgcttacaaagcttccccatgcagaaactctcttccctccactccctgcagagacacagaatagagcaagctgacactgtggtgtttccctgggtgaaaggttatttggagacttcacaagtacagactaagaaaacagaacgatggtattgtggggacatgggaaaggggaatgcctgcatttcacacgtttagttccacaaacagaaggatgcccatggacaggggtgcccagcaggcagatataaatttagccttggtgtgatcattaagtgtcaacttgattggattgaaggatgcaaagtattgttcctgggtgtgtctgtgagggtgctgccaaaggagattaacatttgagtcagtggactgggaaaggcagacccaccctcagtctgggtgggcaccatctaatcagctgccagcgctgcttgaataaagcaggcaaaagaagttggaaggagcagacttgctgagtcttccagtcttcatctttctcccgtgctggaagcttcctgtcctcgaacatcgaactccaagttctttggcttttgcactcttgaacttaaatcagtgatttgccaggggcccttgggtcggcttccctgcttttgaggttttgggacttggactggcttccttgctcctcagcttgcagatggcctattgtgggacttcaccttgtgatcgtgtgagtcagtacttcttaataaactccccttcatctgtacatctatcctactagttctgtccctctagagaaccctgactaatatacttggacaaaaggggccccaagccccaacctgctcactggatggatctgtctttattggccccttgcactggctgtacaagagccaaaggagtgagtgcccccttgtccttccctctctaacgtgcatatcttccatccccactcctaggccactttcactgtcatctcacagacaaatccctggtcttcatccgggcctcattgtggtctccctttctagtaccccgaaggtcagagcaccattgttcttgcctgagcattacctggactctgttatgagttagtcccactttcctgtgctgcatttgggacatcactgttcagagaaagcctctagaggaagtaggatctcccactgttctgcgggtgacatcagtcaggagagtgcgcaccagtcatggtggggacacatgaaacaactccgtggggtctcaggtgcaccaggcagcccaagagcaggtggacgtggtgatgtggttggattttcctgtgtgtgtgtgtgtgtgttttttcctcagtagcattttctttatttgtaagaagagatcttttagcattttataaaattacttttattgctcgttttttccccttgtaacttgaagggtttccttctctcttctttttctatttacttatttttcctattagtaactactagactatttctatcagcaaggtacatttttaatatagttgtattttctattttcctgtccagttactaagattaaaagctttgctttgcccttaataatggaacaaaacaccatccaaactgtggttaaaacatggttttcttctgggatgtggtaaaacgagaaagccctcatcatcccagcatgctttgcctaagctgacttacaacagaattgtgccctggatgtcagtgcatgaactctggccccagggaggctctctgggcaggcagcgctactcaacatggtgtcagctgcttgctggggctcccaggatgcatggaacctctattgtattttccagacttaagcttctcttcatggatttacaccaaatgcttaaacatgtctgtctgtttttaagatttggagatattggttttctcttagttcaactagcatcaaggcttgctgcgtttcatgtgcagggccatcagtgctactgggaccagcatttctgtccagcaattaaaggaggaaattccctaggaagaagtggccgggagccaggaggctgaactaaatagcattccaaattagttgcaattgtccgaaagaggaaattgctaaggccctggttcccaaactgtgggccaaggctccctggagtactggaacaactacaccatgttgtaagtgttcacgttttcaagggaaacacagctaggtaccatgcagaggactactatgagattgcttagacttcgctatttaataaatggaatggataggttgattttgcataggagtaccatgaaaaaaatcactgaaaggtaagagcactatgaactgagaaagtttggcaacttctgctctaacggtataatgaaggtttttgaaaagctgaggatatagccaggtgtttgtgagggatggaggataggtatataaaaggatgtgagggaggagaagacacaggtttggaaggtggataattgggccaaaatgactcttaatttacaaggaatagaggttggctgatccctgtgatgccatgggctggcagctcattatgttatccctgacatacaagccccgaggctcccatcccctagaagtaagcaccaccctaagcccctcagaccaagcgtttgcctctgtttttaccttggcatttattcattcatgaaatatattttcagtatcacctgcatgctaggagctagggagatggtagtaagcagaacagatggaaattcctgacgtcttgaagcttatgtttttctagaataatatcgaatgggacatagttggtgtttcctgtgtgcctggcattgttctagaagctttccatatattaactcatttaatcctcaccatatttattccataaggatagataggattgccatttacatgtgtctggtgttaacagtggctctcagagcaccttgttgcttgtcctcattggatggcatccccgtcaacctgatattggtcgagagctcaggtacaatagcagcgttcagaacctctctgtgtcactgagtgaggctctgttaggtggtgtgagcctgctctgtgttacctcgcagaaagctacacgctgcatattgactaagaaaacttctgtcctagcacatcttcatctccatatgtgagatttatatttcataaaacttatatatgatgaagtatttaaattcaacagaagctacattcacaaaatggtaagccttgctttgggaatgtcccctattaacatgcctttctagggcttgctcttcccgtacagcaagctgagtagtactggcactgccactcaaacaagtttctgatcataatgaagaatggctgacttattagttgtgctatcctgggatgtcaagcattgttaaatttgaaaatgtgaactggacatagaaaagtggtttatttcatttatcgtgtagctcagttgtttccttgaaaagcagaaagaaattaaagatgttgaatatttcatggttataacaaatgaaactcccatgaaataaaagagttcacactgttactttattttccaataatgaaagtaccatttgttcatcatggaaaataccgaaatttatcaaacaaaataaaagtaactcccatcatattatccaaagaaaacaactttttgttgtgtttccttttaccctttttctgggcatagataagcttccatttttttaaattaaaaacttactgtgggctagatgcagcggctcatgcctgtaatcccagcactttgggaggcccagacaggcagattggttgaggccaggagttagaggctagcctggacaacatggttatatcccgtctctacagaaattaaaaaaataaataaataagccagctgtggtgatattcacctataatcccaggtacttgggaggctgaggtgggaggattgcttgggtccaggaggtcgaggctgcagtgagctgtgatcatgccattgtaccccagcctgggtgacagcaaggccctgtcaaaaacaaaaacaaaaacaaaacatcttattgtgtatggactgtgttcagggcactaaggtttgctttggagcaaagtaaaataaacatatgttccctgttaatacaggtataaagaaaggcaaattactgtgtccctcatcttaaaaacaaacacagtactttccttcaatcatacatcactctcgactctcctgtctgccccttatttttcttctcatagctgtcgaatcgatttcattaaagatagctgaagccttgtagcccttctggattttctattaaaattcacctaatggtagaggtaaaataaaatgtgcatcttcaccccttcactgtagcactccccacagctgtactctggtttacaagactctcccattctcttgagagcaaattacttgaggttaaggacttagggcttatctgtctttttacctttggaaaatagtgaatgtttaataatgtttgcatctttctgtgagagccttcgctccagcacatcaatgatcttgggcaccaagcaccaagagtcacctagatttgtacatcagaagccaaaatggaatcaaaccatacactgaatgttcagggaatctgtcttatctttatcaaggctactcgtcatggttgaactggtagtgttctgatttcccatgtgagcacgtgtgcccatgtcaatacatttatatatccatagtggacatgtggtccatgattgtcaggaggcatggttttctcacaactgtgggcgtgattaattacttgctagaaagtccacccacatattccacttgtattgttacagggctatttaccagacacttcaggggctttagagaggcactggataatgcccatgaccacaggcggttcatcatctggagcagtgtgagagtggctgacatgatgatctgaatcagcaatggctgataatccgaatcatttgggaagtttaaaaaaaattgtgcttgtataggtgtataaatatgtgcaagtgtgtttaatgtttatatgtggtcctatctcataattagtaaagtcaaatgaggcaggattgtagaattacaaagctttcaggatggttcagatgagtaactagttttgggaactaatgagttagaattcttttttttttctttttttatttttattttttaattttattattattatactttaagttttagggtacatgtgcacaatgtgcaggtttgttacatatgtatacatgtgccatgttggtgtgctgcacccattaactcgtcatttaacattaggtatgtctcctaatgctatccctccccgcttccccccaccccacaacagtccccagagtgtgatgttccccagaattcttaatgccaaaaaacgtttgtcagagggcaaactgaaacctggcagtgacaagagggccacgtctcatgctccctcatggatgccacgttgccgtatgtcctgccactgctgaacccatacagggaggcgcttcatttatgagtgaggtgaaactgcgttgagagtggcggaagtgtgctgtgcagtacatctgtgtgaaaggattccgtgtttttctaggctgagatgaaaagtaggaaagaactacagtgaaagagattagtcaaatgcagaagcagtgtactagaagctgtctaaggaaagctggttttagaactagccctactggtcctacagctgatatagtacctgtgctgcatatatttagtgttcttgtaaaggtaaatgagggaataagtatgagcaaaaaaattttaaagataaaaacgtttacacaaatgaatgatggcattatataagtattgcaataaagaactccttttcttctctctctcttttttgttttttggtctggcctctagttagagttccaatagtttacattcagtgctgttaattcccacaatttcaaagatctgcatttcctgtaaatacctaattgtattttgaaattgaaatgatttttggataatctgccatttggactatctgcatcatttttatcttaaatgatggaaacctgaatatagatgatgataacagtgatataattgtgacatatttatatggttcaaagcacttctgttgagaggaataaacaaaacaacatacataaatgttagagacatttttgtgcacaatattttcaggaaacttgtatctatgtacataataattacatatttgctttccttagaattcaagatgacactcttcacattcaagataataatagatgcacatttgatatccaggaaaatactgttacattctatcctagctaatcaacgtatttgtatttcagagatgggtggccaaaactagattactaacttaaagtgacatttttacatgttgggtttgtagacaggtgagatatcctttcaaaaattatatatgtaaacaaacaaaacataagtttgtgttatattattgaaatattaaaagcatggctgtgagattgctcttaaagatatctcaagtcaaggggacctataaatctcacaatattataaaggatctgcaagaccatttgcaaggcttcttagtatatgtgaggcttatgaaatggaattctttcatttggccatataaaaactttcatgtggtacttccaaaacatttctattttagcagaaatgagattgctctttcttagaaaaggatttcctaaccagagtcctcctgtgttgggaattggaatctccctccctctctccctccctcctttgtttacttatgtatctatttactttccccccttttttgtgtgtgtcagacatttcaatgtttgagtattgattatcctcatttttttaatgttcaagtggtaattacattatttaacaaatattgtcctatagtttttggaaaggatgttctaattaacttagagccaaatggcatacctcctttctcacaactcttatgagttaaaatctcgttaacctaattcaatatacttcattgttttggtaaatttaatataacagaatgtagtaatgtagtatatttattctccatatccattccctttctttcacttcccaaacccacatttcctgtgggcccttcccctcttactgggcatgtgtttcaagtggagccccatctctggctggaggagtgggacactcctcagggctggccaatcagagcctcagtttcccccagccatgtgactggttcagaggtaagaatgtgacttagataccgcaagtccatgtaattccatctccctgtgtacacatttacagacatgcaccacttaacaagggggatatgttctgagaaatgcattgttagtcaattcctttgtgcaaacaccacaaaatgtacttgcacaaacctaaatggtatagcctactacacacctaggccatttggtatagcctattgctccaaccaccatcatatatatggtctgtcacatgcagtctgctgttgacaggaaagtcgttaggcagtacatgacttacctatgtagagattgagttcatccaatcagagtgaataatgagacatatgtcatagttgctaggaggagatatgttctatttcccaagggccttgaaataggtcgcataaagcccactgaagctgccaatcatcctgtctaaagagacagcagccagtggagggcaaagctgaaggatagagaggtaagtctgtgtccttcctccaacacacacccgaaagcatttttacctctgcacttgttatttacctggtccaatatatttcccttttggattaacgtagtttgatttttctgtagtcactgaacagaagagactctgcattttggttgtttttggtgtaggatatggagtttgtcttgaattgcttatctcactacttaaaaatgttgagggcagtgagaagatttgtaaaagaaggggttaaatatattttgtgatgttccagaattgtgttcaggcagagttatggtataggatggagatgatttaaggtttttgaaagttttgggcaatcacagtctttactgcacttattttttgaggaaaatatacactatttttattttcaataagggctagattgcagttcttaactaggagcaatggtcttaaatattgccaaagattatttatattttactttgaaataaatctcttggggagcaactctgcctttcttatcatgtcagtcttacatcaataaaaaatatatttattttctgaacattacagataggctcactgactggtagggaaagccttcctgagttatttttttaatgcagacatagaacatttatcaccttttattctagcaaatcttctgaagaaaatcatttttgttgttcataaccattttattttttccaaatctcttttaattttttaaaaattgttatggtacatagtaggtatgtatatttaaggagtgcatgaggtgttttgacagagatgaagtgcataacaaccacatcatgaaaaggggtatatatcccctcaagcatttgtcctttgtattacaaaccaattatactcttttagttatctttaaatgtacaattaagttactattgactgtagtcacactattgtgctatcaaatactaggtcttattcactctgtttttttggtatccattaaccatctccaccttcatctccacttccctcctaaccccgcattacccttcccagcctctagtaactatcattctaccctctgtctccatgagttcaattgttttgatttttagattccacaaataagtgagaacatgtaaggtttttctttctgtgcctgacttatttcacttagcataatgtcctccagttccatccatgttgttgcaggtgacaggatctcattctttttatggctgaatagtactccattgtgtataagtaccacgttttccttatccatccttctgttgatggacacttatgttgcttccaaattttggctgttgtcaggagtgctgcaacaaacatgggagtgcagctatctcttccatatgctgatttctttgcttttggatatatatgtgcagtgggattgctggatcctatggtagctgtaattttagtttttcgaggaaccttcaaactgttctccgaagtgctagtactaatttacatttccaccaactgtatatgaaggttcccttttctccatatccttgccagcatttgttattgcctgtcttttggatataagccgttttaactggggcgagatgatatctcattgtagttttgatttgcatatctctgatgaccagtgatattgaacaccttttcatatgcctgtttgccacttgtatgtcttcttttgagacgtgtctattaaaatattttgccattttacttattagatatttttcctatagagttgtttgcacttcttatatattctggttattagccccttgtgagatgggtagtttgcaaatatttccgattctgcaggttgtctcttcatatggttgattatttcctttgctgtgcagaagctttttaacttgatgtagtcccatttgtccattttggcttttggttgctggtacttgtgaggtattactccagaaatatttgcccagaccaatgtcctggcgagctcttctgatgttttattgtagtagttctattgtttgcagtcttagattgaagtctttaatccattttgatttgatttttgtatatggtgagagttaggggtctagttacattcttctacatatgaatatccacttttcccaacaccatttattgaagagattgtcttttacccattatatgttcttggcacctttgtcaaaaatgagtatactgtaggtctgtggatttgtttctgggttctctattctgttccattcatctctgtgtctttttttatgccagtaccatgttcttttggttactatagctctgtagtataatttgaagtcaggtaatgtgcttcctccagttttgttctttttgcttaggatagctttgactattctgggtcttttggggttccatatacattttaggatttttttttgttgctgtgaacaatgtcattggtgttttgataaggtttgcattgaatctgtagattacttgggtagtgtggacattttaacaatattgattcttctaatccatgaacatggaatattttttaattttttggtgtcctcttcaatttcttcaacagggttttatagttttcattgtagagatctttcactttttggttaggttaattcctaggtatttaatttcatttttggctattgtaaatggggttacttttttatttcttttacagattattcactcttggtgtataggaatgcatattgatttttggccaggtgcagtggcccatgcctgtaatcccagcactttgtgaggccaacgtgggcagatcacctgaggtcaggagtttgagaccagcatggccaatatggtgaaactctgtctctactaaaaatacaaaaattagccgggcatggtggcaggtgcctataatcccagctactcgggaggctgaggtaggagaatcacttgaacccaggaggtggaggttacagtgagccgagatctcaccatggcactccagcctggtccacaagagcgagactctgtctcagaaagaaaaacaacaacaacaacaacaacaacaacaacaacaacaacaaaagcaatgcatattgatttttgtaggttgattttgtgtcctgcaactttactgaatttatgagttctaataggttttggatagcatctttaggtttttctaaatatatctatcatctgcagaaggataatttgacttcttcctttccaatttggatgtgcttaatttcagttctcttgcctgattgttctagctaggacttccagtactatcatcaataacagtggggaaagagggagttcttgtcatgttctagatctttaatatgatactagctgtgggtctgttatatattgcttttactatgttaaggtatgttccttctgtactcagatttttctatgatttttatcatgaagggctgttaattttaccaaatactttttagcatcaattgaaatgatcgtatggtttttgtctttcattttgttgatatgatgtatcacatcgattttcatatgctgaaccatccttgcatcccatggataaagcccacttggtcatgatgaatgatctttttaatgtattgttgaattcagtttgctagtattttgttgaggattgttgcttcaatattcatcagaaatattggcctgtattttatatatacatatgtatatataaatataatatatgtatatgtaaatataagtatgtatatgtaaatataagtatgtatatataaaatacaggccaatatacaagtatacacacacacacacacacacacacacacacacacacacttccagactcattctttcaggtcagtatgaccctgttaccaaaaccagttcaaagatgtctggttttgatatcacagtcatactgacctgaaagaatgagtttggaagtactccatcctcctctgtttttcagagtagtttgagtaggattggtattagttcatatttaaatgttcgttagaattcagcagtgaagccatcatcaggtcctggcattttctttactataaggctttttattacaacttcaatcccattactcgttattggtctgttcaagttttgaatttcttcgtggttcaatcttggtagcttttatgtgtttagggatttgttcgtttcttctagattttccaatttattggcatatagttgctcataatagccactaatggttttttgaatttctgtagtatcagttgtaatgtctcctttttcatgtttgatgttatttatttggatcttttttttttttttttttttttagtctggctaaatgtttgtctgtttaacttttcaaaaaaacaactttttggttcagtgatctttgatattctttatttcagtgtcatttatttcttctctgatttttgttatttattctactaaacttgggtttggtttgttcttgcttttaaattattcgtttgacatttttctttttttttttttttgttgtaggcacttatagctctaaactttcctcttaatagtgcttttgctgtatcccataggttttaaatgttgtgttttcattgtcatttgtttcaataaattttttaatttccttcttaatttcttcattgacccactggtcattcagaaacattttgtttaatttccatgtatttgtatagcttccaaaattcctcttgttattgatttcttttttatcccattgtggtcagggaagatgcttggtattatttatatttgtttgaatgttttaggacttttgtgacctaacatatggtctctccttgagaatgatccatgtgctgaggaaaagaatgtgtattctgcagcctttggatgaaatgttctgtaaatatctaccaggttcatttggtctatggtgcagaataagttcaatgtttctttgttgattttctgtcaacaaatactgaaagtgggatgttgatatctccagctattcttgtattggggtctctatctctctttagcgctaataatattttctttatatatctgggtacttcaatgttgggcccatatatatttacaatcattatagcctcttgctaaattgacccgtttatcattatatagtgaccttctttgtctcttaaagttttttttgttttgttttgttttgttttgttttgttttttatcttgaaagctattgtgtctccatagagctcctcctgctctctttcagtttctatgtgcctggaatatctttttccatccctttatttttagtttacctgtgtctttatgcctgaagtatgtttcttgtaggcaacagattattgagtcttgttatttaaattaatgtcgtcactctttgtcttttgattggagagtttagtcctttacattcaatgttattgataagtaaggacttactcctgccattttgttatttgttttctggttgttttgtgatcttctcttatttcttttcttcctgtctttcttttagtgaagttgattttctgtggtgataccatttagtgtctggcttttttgtgtgtgtgtaaacattgtatgttttttgatttaaagttgccatcagggttgcaaatactattgtataactcattattttaagctgataacaacactgcataaacaaacaaaccagcaaaaagaaaacgaataatgctctgtgcctctttaatattttgtagtttctgtttatatcttcttgcactatgtcttgaaaagttgttatagtttttttattggttcattgttaattctttctaattaacataagttcattgtttattctttctactaaatataagagtagtttacacaccacagttatagtgttatattctgtgattttctgtgtacttactattacaagtgagcttcagatgatatattgctcattaacatccttttctttctaatcgaggtactccctttaacatttcttgtaggacaggtctgctgttgatgaaatccctcaatttttgtttgtctatgatagtctttattccccttcatgtttgaagaatatttttttccagacatattcttctaggataaaagttttttttccttcagcacttcaaatatgtcatgctacttgctgctggcctgtggggtttccactgaaaagtttgctgccagatgtattggaactccattgtatgttgtttgtttcttttttcttgctgcttttaggatcctttatcctcgacctttgggagtttgattattaaatgccttgaggtagtctttgggttaaatctgctttttgttctatagccttcttgttcttggatagtgatatctttctctaagtttgagaagttctctgttattttccctttgaataaactttctaccccggtctctttctctacctcttctttaaaggccagcaactcctttttaagtccaataactcttagatttgcctttttgaggctattttctagttcctataggtgtgcttcattttttaaaattcctttttcttttgtttcctctgactgtgtattttcaaatagctggtcttcaaactcattggttgtttcttctgcctgacctattctactatcaaatgactcatacattcttcagtatgctaattgagtttttcagctctagaaatactgattgatactttttaattatttcagtctttttgttaaatttgtctgatagaattctgaattccttctctgtgttatctttaatttctttgagtttcttcaaactcaaaacacattttttttttgagtcagagtctcactctgttgcccatgctggagtgcagtggtgtgatctcagctcactgcagcctccacctccgaggttcaagtgattctcttgcctcagcctcctgagtacctgggactacaggcgcatgccaccacacctggctaatttttgtatttttagtagagacagggtttcaccatttaggtgaactcctgacctcaggtgatccaccctcctcagcctcccaaagtgctaggattacaggcatgagccactgcacctggccaacacagctatttttaattctctgaaaggtcacatatttcagaattggtccctggtgacttatttagttcatttggtgaggtcatattttcctggatggtcttgatacttgtagacgctcatctgtatccgggcatggaagagttaggtttttactgtagtcttctcagtctgggcttgtttgtacactggcaaggttttccagatattctaaaggacttgggtgttatggtctaagctgtatctgcattagggggcacgctgatcccagtaactctgtggttcctgaagagaagactcatggagtgtattagtctcttctcaggctgctgtgaagaactgcccgagactgggtaatttataaagaggtttcattgactcacaggtacacatggctggggaggcctcaggaaacttacagttatggtggaaggggaagcaaacacatccttcttcacatggcagcaggagagagaagtgctgagcaaagggggaaaagtcctttatgaaaccatcagattttgggagaactcactcactatcatgagaaaagcaggatggggtaactgtcctgttttaattacctccccccaggaccctcccacgacatgtggggattatgggaactacgattcaagatgagatttgggtgaggacacagccaaatgatatcatagaggtaccactttagtggtcttggacaagatctggaagaattctctggattaccaggtagagagactcttgttctcttcccttaatttatctcccaaaaaacagagtctctgtctttgttctaagccacctggagctgagggtggagacacaagcacccctgtgcccactatctctagaattgctctgggtcaaacctgaagcctgtacagcactgggtctttcccagggcctgttgtaagaactccctggctatcacctaatttcactcaaggccttggggctctacagtcagcagatggcaaagccagtcaggcctgcctccttccctgcagggtggagagctcccctaggcccaggtagggccaaaggtgctgtcccaggtgcatggaatttgagtcaaaaaccttagaagtttacctggtgttctgttgtcctgtggctgagctggcactcaaaccacaagttgtggtcattcccactcttccctcccctttccaaaggcagaggtgcctcattccatcgccacagccaccatgggcccacagggagtactgccagactaccaccagagctcccttctggcccaaagggctcctaagtcagcctgtggtgaatgctgccttgactcttggatagcatttctggactcacccttcatagcagtatgctcccctctggcacaggacatgtccagaaatgccatccaagagtcaagtcctggaaccagggacccccaaatgcccacttggtgctctaccccactgtgcccgaggtggtacctagggtgcaagacaaagccctcttcattttttccctctgcttttctcaggtggaaggagtcttgcctcgtatagccaccacagctgggaatgtgctgagtctcaccagaagccagcaagtctcagaggctcaccaaggcccttgacatagcacctcagcatccctgctggctattcagaacccttggactctcagtcagcaggtgatgaattctgccaggactaggtccttcacttcaaggcagtaggttcccttctggcccagggtgtgtctagcaatgtcatctgggagctagaagctggaaagggggcctcatgattctgagcattgccctatcctgctgtggctgagctagtattatagatgtaagataaagtcctccccagacttcccccacctctgcccaagcagagagatggggtctctgttggagccacaagctgtggagcttgggcttagggtaggaatgatgccaatacttctttagctgcccttggggatgtctcagtgggttacatgccaccaagtccactggctctgggcccagttcagcactaggcctcacctacgagttccagtccttgtggcctagactgcctttcaagtttgggttccagagtactttaacttgcttgagaggcatgtgggagttcaagttcggactgttgggactggtgattcccctcttcctagggctggtttaaatgctcccttcatgggtgggcatcagttgagtttgctctggttttgttttctgctgtaacaaggcagcactgagtttagtgcctcatggctgctgtgctcccctctccccagcacacagaaatactctctgcaccatgttgctgatatgtgtgtatggggtggggtggggggtggggtggaggtggggggggagggcagggtgatgggggaggggtggtgtccttggcaattcaagactgtttttcccacctcttcagtgcctctttcagagataagttaaaaccagttactgtgtgtgctcacctgatttttggttcgtaagaaggtgcttttttagtgtagataggtgttaattggtgtccttgcaggaaagaccatccttctctgccccctgtctgagttttaaattttattctagatattttttcaagaaaaaaggtatatgtgtgattagttgagaactaaattacttattggaggacacatatagacataaggtgattaggcaaattcttcctctgaaggtatcgtattttgaagcacttgtttgctatcatacctgggtgctatgagaatcacttgatagatctgcctccaaaaactgacagtgtaactttcctgatctggatttcttagcattctggcagggtctgtgctataaaagccattggcagtgtgtctgttattttcaggcaagattcaacttcctgttcagactccagaacttgctgtagcaggaaattgacaaatgatcagaaatgtgccgtcagtgactagcctctgtgatgttgtgttttgttcaaaggatgaattggctttatgtagaataaaagccattggaaacatatggtacaacagttggctgtagaatttgttttgttataacttcagaagctgctactattttgctttgacatgcccttgaaaatccaagatgctttggtcaatgtgtttgttatattaaaactaacataaattttagtggaagtttggtagtgtaagacaggcttcacttattttttgtgtgtgttccaaattgacctgagatgaaaggacaagatgtaatttgtaaagtactacaatagaagtaactggagaagctatgtgcaaaaatcaggctcattattttatagtcacatagcatcattttaagttccttgaactgaaaagcagatctcatacaaggaatttctagccatgttgagcccatggtgaattgtaagtgatcataatatagccaaaaatgtgtaattcagaaaagatacaggggctgttctggagctttgcttttgcatattgcttccttataggaatagaatagttgtatttctaacttcaggtcagacaggtttggacatttttggctcaaatcatttcttttttttttttttttttttttttttttgagacggagtctcgctctgtcacccaggctagagtgcagtggcctgatctcagcttactgcaagctccgcctcctgggttcacgccattctcctgcctcagcctgctgagtagctgggactacaggcacctgccaccacgccaggctagtttttttgtatatttttagtagagacgggttttcaccatgtttgccaggatggtcttgatctcctgacttcgtgatccacccgcctcagcctcccaaagtgctgggattacaggcgtgagccaccacgcctggcccaaatcatttcttaatgtgaaaaatgattagcacttgattattcagagagtatgtacaggttatctggcaccacggttgcttaaatactctgacattagcataatcgtgaaactagtcagttaactagaaaatgaaatgccttacactactgaagctatgagtggccccttgtaggtgatttgagcattctgtacaatgccattacgatctgtaggttcagaaattttataggatgaaacttggcttggaagtggggtgtgtaaaagtgctagaacaaaacaacctacttatattttgaaatttttattcttcatagatataaatatgacaatttatgttattatttttttttctttgctgctctctttagcttttcttgttgactttggctttttcagaggcttacttagtatgaaggagtgtgactgtaggtccagttccttgagcaggtgagggcacctggagctgaagaagttgatgacttagatccatgttcccagaaacaccaagcatgtctgcttcctttttcttttagacccactttcacataaagataggaaaaatatgaggctaaatgaacctctggtttataaggttagtttgtaagtaataatgaagggacacgagggtgatatgaacaattatgtgagaacaataggtataagccagggctgttctgggcaaaatggttgtcaccccgataataactaacatgctttgatcattttttcattgcctggcattatgctaagcatctatgggcgttaactcaagccacccaactaaccaatgaagtgtaggtactattttcttatccttatgatggttaatttgtgtccacttggccaggtagtggtgcctagttgtttggtcaaacagaagtccagacgttgccgtgaagatatttttagatgagattaaccatttaaatcagtgggcttgagttgagattaacatttagataagtagactttgagtaaagcaaattacccaccataatatgggtgagcctcattcaatcaattgaaagcttttagaaaagagacagagttttcctaaggaagaaggaattttcaagattgtaacatagaaaccctgcctgagtttccagcctgcttaatttggacttgccagccccaccacttacatgagacagtttcttaaaatctcaatcaatctctctctctggctttctgtacatatgtttatgtgtgtgtgtgtgtatatatatatgtatatatatatatagagagagagagagagaaacatatatatatatatgtttctcgtgtgtatatatatatatgtttctcatatgtgtgtgtgtgtgtgtgtgtatatatatatatatatagagagagagagagagagagagagagagagagattatatgagccaggttcctctggagattcatgtagtgcctttatgtttctcatatatctactattgattctgttcctctggagaaacctggcttatacaatctccattttacagataaaagcacagagaggtcagttaactcagctaaagtcacacagcttataactggcaaacatgagatttgcaactagatttttggactccagggctcacatgttttactgttaagctttattgcctcttaaaaacagaaacaaaacaacatcaagagaaagcttttatgatttttcattcaactggccctgtctctcctgagagtctccattgttaagcagctggctgttttctttaacttaggaccctgaagcaaagttttgtgattattttgtatcactattacaggggaccacaggcatttctggtcaagattctgcattctttaattgcccttatagatagtttattcagggcatgtgaaggaatatttctgtgcagttttagaatttctgataggtgttttaggggaagacctactcccagactactaatatattatcattgtcatcatgagttagtgctaattcagatgtgatactctaggctagcatttcccaaacctgcttgaatgggctgttgcatgaacaacattgcaactttcattttcatgttacactggaatatggaatttttgtataacattagtattttgaggcactatataacatatgtatttgtcatctattgctgcatggctcaaaacaacaatcattgttatgcctctcagtttctgttgtctgacattcagataggacacaatgggaatggattatctctgttccatcatgtgtggggcttcagctagaggtctcaagtaccagggcctggaatcatctgaaggcttgttcactcacaagtctagaaattaatgttgactgtcaggtgtggaccacctggggctgctgctgggataacatacatatggcctcttcatgtggtctgggattcctcacaacatgatgacttgattccaatggcaagcaccctgagggggcaggtggtcactgctgcactgccgttcatgacccagccttggatatcatgcagcagcacttagcccaaagttgtaaagaccccaccaagttcatgtgaagggaatgtagaccccaccactcagtagaggagtgtctgtaactttttaagaagagcatgtgtaacaggatataagtgtggccatgattgcgaaatacaatgtcagtatcctcttaccataagaattcacatcatatgcttcctacatgtaaaatacactcacttcttccccttaagatctataaatcttatcctcattgggatgtcagatcaaagtctaggatctcagcccttaaatcaggttcaaatatggaagagatattttcattgtggatttgcacagcttctcaaatatagatcttagtctgaagacctgtgaactaaagagacaagttatctccctcccaccccctcaacatgcaatggtaggacgggcagaggagaactttcatgtagagcctcctgttcaggaagggtggaaacagaaggcatgcacgagtcactggttcatagaaactctgaaaaaccacctggaatgtgatgtaattacttgacaaggtctcagtcctactgcctaggaatgattctccataattcttgacttctgtctgagtcactcctcctcttccctaagaagtggccagtttcattgggtagctttccaagtctgatttctgcctgtagtacttttattttagcctcttggtagtccaaaggtctattttcattgtaagtgtctctgtccattttggtctgaactggcagtgtttctaatggcagtgtcagactaattctcttaaaaatcctatggatctcctgtgaatcttactgaggttcattttgttagacaaaattcacattcatcaatctctttgatgaatgagattctttgatgaatgagaatcccttgagattctgctgagggattaccctgttaaggtttttatagacagtactgttaatagacaggatctataaggtatgtccgtaagattcttagccttttatctgaatgaacagttctctgaggcactgacttaacacgtttctgagattttattaagggcttttatagtgtaccctcagcttttaagagttgttttctgggaggaattcatgatctatcataggtaagtattaaactagaaaaagtatgcattccaaaattactttttttctgaacaagaatgagaatatggctttaattgtgttcaaaattgttgcatttcatgagcttgcatttgctaagatggattaatttatgatatctttgagaagttcatgaaaacctgacaaatgtccacgtcaacttatgctttatataagttagcttgtgtgttcagtcactttttttgtgaagcagtgtaaccatactagtaataatttatgtgaaaagcatctcactctttcatgaccgcaaagttcctgcaggattttcttatgatcaaatattttacattgtaaaaatttttcgatacactgaaacctaaatatcctataggacaaatgaaacagtctgattagaaatgtttttctgttgctgttgatttctccttttcacatttatggacaacattccctgttattctaagtttgacagtgtctttttatttttgcccttcgtatttcaatggaggaaatttagaaataagacttccttatctttctttccagagtctctgtggtggtcctccgtgtccatacataatagtgcagttttgcaggtgggattccctgggaagccaactccaaggtgcagattagcatacaggatgactcttaagggttgctcttggggtcagtgtctagtggagggaagggaaggaagcagccttacttccccctctgcccaatcctgtaatacaggctcagcaaaggcctctgctgaccctatttgaaacagctgaagcttggctgttctttcagagttgtcctgagtcagggcaaggagattgagtctttagaccccagtgttcatcagtcatttgatgcggattacctcgggcaaaaacactctcttcattcaaggcaattctagaggatgacagctgatggccagtagtgtttgctgcagctgggaccataagctttttagtcttaaagcagaggagggatgtacatcagagtgtccactcacacgcctgaaatagaatgaggtggaagaaggcaagacaaattatttgtatgtgatggtgctagatcccccattacatacagcagtggtgtttttggttgatttgtttttgtttctaaataaaggaaaatgtttatattactgtacagtgaataaaacaatgaattctgttccaaaagaatcataggtaacttcaaactcttttgactgttttcctgtatttgctataacgagtaagaactgtttttctctaggatgttagggtgttgctgtggcaactggtgtcctatgctgtacttgttattgcctcatccttcatctgggcctggtggccctctcccgtgcttctgtagccgggaattatgcacagcatggttgttatccttacaggattgttattggtttgtgttcctgggttccccaatgaattggagggctaggccatgttttattaatttcacctgatttgcctagggaagcgcacagccctggagggcactcactaaatgcttagtgaactgactcttgcctgctttcctgtcctaaggcactgttttgcctacctgcttgtcttcggagctctgctcagctattctgagtagttactgctggctactaattctgatacctaatcagaccagggtttctgatgtctcttcctcttcagtgttcttgcccaccttcttattctactgtattttatcttatctctgagacttcttggatgatctaccctttatttgatttctctccctatttcagactatcactgtattttgaaggatatagcaacttatattcaaggaagtagtttaaactaggaatctttgcaaggtcccttagaatttcatctgcagttagttatctagtagttgcctcttcactgacaaagagcagagtgtagtgttggatttagaggggtattctagtctagctgcttggttgtagtttctgaaatacaaatctggcttttttttttttttgacagagtatcactttgacacccagcctggagtgctgtggtgcagtcacagcacactgcagcctcagccacccaagctcaatcgattctcccacctcagcctcctgcgtagccgtgactacaggcatgtgccaccacacctggctaatttttgtatttttggtagagacaggttttaaccatgttgcccaggctggtctcaaactcctgggcttaagcaatccacccgcctcagcctcctaaagtattgggattacaggtgtgagcccccatgcctgtccacaaatctagcttaatcataaatggggatttattggcttgtgtagttgggagtggaggaatagagtttggtttcaggcatagctggatccagcagctcaatgacaactgggctctgtctccctttccagagctcagctcacttctcactgtgctgtggcttcattctgaggcagagtttctcctataacataagagatgacaggctcaagcttatccccctacaactaaagattaaaaaggaaggaccttcccactctctctcagcatctatattacacatcttatagagagggtcacccatccaaacccaaatgatgtattcactgttaccaagggtggagaattctcctttgccagctggtggcatctgcttgtcttgattgatgagctgacccaggcgctatgccatcagagaggccccctcaagggagtggacactaagcacacagccggtattttctgtcacagaagaggaagaatgagtactactgtgtagagagctgtttcaggggagaaatgggcaaagcaaaactagaggaaatcttcctatcaaacttaatgagtctgaattcgcacccaaatgtatttacatttcaaaatatgtggacatagacctgcccatagtcacattgcatttacctccttttatctgggttggtctcccccttcactgtcctccccaccagactgtgtatccttgctgcctatgggaggtattgcctaatagtctgctggactgaaatcataatgttaaggcttttatttgtatacttacttaaataagttgaacattttggagttgagattggccaggcagctgtaagagattttgtctttctgtagtcaaataaaacagtatgaaaattgcttgctcagccatgctggttgtcatgttgctaataaaacttatgcaagaataggccaaccccaatatttcatgaaaaaaatgtgctttgctgtcatttagtgtcttcattttcattaagttctgaattacaaggaattgcttaaaaataaattttgtggctgaggctggtggctcaagcctgtaatcccaattttgggaggctgaggcaggaggaccacttgagcccaggaatttgagaccagactgtgcaacacggtgaaaccctgtctctacttaaaaaaaaaaaaattagccaggaatgcctgtagtcccagctactcaggaagctgggacaggaggattgcttgagtccgagagtttaaggctgtagtaaactagtgtcacaccactgtactccagcctgtgtgacagaccaaaatactgccttgaaagacaaaaattttaaaaataaaataaaatttgctttgggaaatttctactttacacagtgagagtaagccactgtttctaaaatgaagttttttttaaattttcatttaaaatgttggtaatttaatgtataaagttggacattaactttggaaagttaaatagctttcactgaaaatgtggtaaattttcatataaacaaaatactagatatctctgagctttgattctgatttaggaatttgaaagttcttggttcttttcctctcccctgccacaggggaacgcatagcaaatttggcttgatctgagatggcatctgcctcgttaattttttttggtagaatatattgcacccagaatgattttggctttcccctcacctatcaaatggattttcatgcagcggccaaactgtgatgttttgctcatttcactttgggttaaattcctatgtctatgactgcaggtaaaatgtctcaagtttcattggggattcagaatgtttcaggttatcaagaaagtgtttttctcctggagaaggctggtgtgtggcttaatgacttctccacatggctccttcctataccctgtgctcattccctgccctggcaatctttagcaaagagaatgaatcctagatgggtctcttttagagttgtagagataaagtatagctggaaaattcagatgaaagtggatctctaaaaaatagatgttaactctagctccaattcttaagtggggaatgaggagtaaatgtctttttctggggatgccagtactaacagtgaggcactttttaaacatatgtctttcagtttaaatgaaatgattggaattgggctgtctgttaatatgtttctttgcagctatgatatgtatactttttggaaatactttaaaataataaggagctgttgaaaactatgcagaaataacttaaaagaatggaccagttgtgctgcagaaattagcagtgagatgtgtctttacttagcaaaggttgagaacaacatatgagagggggaggcagtcaccagaagtgagcaactccagaaaaaccaccagtataagacacataactatcttccaaacagcatggtatgtaagatgctacttacgttgacatttattttaatactagtaatcataatagtttgctaacatgtatttgtaacatgttaactttcctaaacacattcatgtgttttatttatttcctcaaagacacctatgacattggtagtaaaactatccctgttttacaatcatgaaatggatgcacagattgagtaacttgtccagagtctaacagccaagatttgaacttaggtgatcttcagatgtgggtgattcatgtaccaatatgtcagtcttgaataagaacttatattgtatatgcatgtttacaacaattttgtcccaaggtgtatttgaagatatatgttatttgggagaaaatgaaatagtgccttaagattctgggctttgttcttgagcttttaaataacagtctagtaattctgttttcagtaatggttaatgtgcttgtttcagaccattctccatttagaacaaatagaaaatctggaagtggggagggatatcaatttgaaagtattgagatctacaagatagcaagaatttgtggggccaatattccagggagaaggtaacccagaaaaggagcaacttttcccattcaggcatttgctgaattaaaagtctcatctgggaagctgaaaagctgagtggagtttttggaaaactcaaagagctgtgaaattcatattttgctaaggaggaggagctctggaaaatagctcaagcttttattgggacctcaaagggtttcactgtaggaataagagtgaatctgagaagtgatttctcacagtgactgaagccaagcttctgatcatgcaagcactagaaagaagtaatctgttcccagcctgtgcctctgctagctgcaaaagtgaatccactctggatgaaagtaacattaactgtagcctcagattttctctacaagtttttatttccagtgttattcaattaaaaataaccaggtaccccaaaacatagcacttaactgaaaatcagtagcacaaaaagtatacaaataggaactcttaggagatccagatactagagttatttaacttcaatataacatgggttgaaggagtttaatataacaatgattaaaatatttagagaattgaatgacaaatggaataatttcatagagaactaattctgttaaaaagtgaaaagagattctagaatgaaaatctatgttaaaacctagtgagttggtttaagagaagattttacacagctgagagctaataaattaaccaaaatttctacagaaaaaagtatttaactggatatacagagaagaacaaaagaacggaaaacaccagaaagaatgtacaagctgtatgacatggcaggtctagcatacataattggagtatcttcaggaaagtcaaaaggcagaggaattgaagcaatattttagtagatagtcactggaggttttccaaaactgacatcaagccacagatgtaaagaagagttatggacccaaatgtgataaacacaaagaaaacttatatatgctgtcatcaaactgctgggaaccaaagacaagagaaagtcttaaaagcagccagagaagaaagacattccaccttcaaaggagcaatataagactgaaagcagcctctcagcagaaataatggaagctacaagacagtggattgacatctgcaaggtacagaaaggaaatatccaccaacccagaattctacttctaatgaaggagaaataaaattatttttataccaacaacaaacaaaaaaacaaaaaaaaaaactgaggcaattaattaccagcagaattgcaccaaaggaaacactaaaaggagttcttttggcaaaagaaaatgatcctaggtaaagcatgatcgtgcagggaataaggagcggtggcaaggagtattgctggaggtaaatctgaataaaaattgactgtaaaaattctaagtaataatggttttttgggtctcacatagagatttaaaatatgtgacagcaatagcttgttaactcaagaaaaagagaatggggttagtgttttaagtttcttgagattttcaggatatggcatatgtacaaactgatattgaacttcagtaatttagggagccatattgtaatctctacagcaatcacaaaaagaatagagaagggatatgtaaagaacaagctactggcatggaaattataataataaaaacaccaatctagaagagagcagtaaaggggagataaacaaagaacacagctcaatagagagctcaaacccaaatatatgaattatagtaaatatgcataaaattatttcaaaggcaaagattgttagatcagataaaaaaggataggaaaatgtctgtttgctgcttgcaagagacataaatatgaagatatagaaaggatgcaataaaaggttatatcagctgggcatggtagctcatacttgtaattccagtgttttaggaggccgaggtgggaggatcgctagaggccaggagttcaagaccatcctgggcaacaaagctggatcctgtctctacaaaaaaattttttttagaaaagaaacaactttgggaggccgagactggcagatcatgaggtcagaagatcgagaccatcctggctaacacggtgaaaccacatctctactaaaaatacaaaaaaattagctgggcatagtggcgggcgcctgtagttctagctgcttggaaggctgaggcaggagaatgtgaacctgggagacggagcttgcagtgagccaagatcgtgccactgcactccagcctgggcgacagagcgagactccctctcaaaaataaaaaaaagaaaagaaacaactgtggatggtggcatgcacttgtattttcagctactcagaatgcagaggtgggaggattgcttgagcccataagcctgggagttcgaggctgcactgaactatgatcacaccactgtactccagccagagagagaccctgtcaatcaaccaaccaatcaaaaaataaaaaataaataatacatagttacatagcctaaacaaaagaaaagctgacatagctgaactaaactgttaaaaagttgactttaggcaagaaacttaatatccaaaaataggaaactttacactgataagaggttcaatataaacggaaaataccacccttttaaatgttttctaccttacagcataatctcaaatatgtaaaagacatcatgttgcctaatattttagtggtttgacttcaaagaatagaatgttctaaagtcagaaagaacagataatgttctaatgttctgtatggacattggaaaaatattgatactgattccttctttttgcagatttcaaattcagaccatgtcatttctttccacaatccctttcaaaggaggttggtgttttctgttatccttatgtgagttacttagttgaggaagtgtaaatgtagggctcagcttgaagtaggagagaagagacttggtctcccttttgcaggtggagttggtgctaggtgtcctcccttgggagcttcaggtaaagtctggaatgggtagtaaggctgtttgtttctctgctgttagcagaagtcttaccccagagtacagtggcttcagaagtacctggaaaaatgaaagcataccaggaagagtaagaatctcaccttgccttgttctttggtatttcactcatgcatcaaaaatgtgagcatcaggaaaattgcactggatttctgaatcttctcttcttctcaaacagttatttgttggctattaagagcatctccattgattagaagtggtagagacatacttgtgcctttggaaagggggaatagaatgtgaacacaacctattcttgaaagagcttgaaataatattctataccaagctgattctctttggaactgctgttgtccaccaagataaacagcttcaatcagggagcagttttttctaatcaggtttacagctttgaacttcaatgaaaactgattttctaaattgttagtcagtggaattatattttcagtctggttgtcttttcattcaaagaagctgagctaatgagagcaggtgttggagagaaaatgagccataaaattctctgtatctgttggacctagactgctgaattgagagttgcagaattggccatttgttagaatgcatttcaggatttccccctgaagtttcacaaaacagaaaatttaaacagcaatattagtttttatgtaccataagagaatgaaggaaaataattccttcagctaaaggaaatgatggacatagttgcttttgaagaagtggttgtctaccattttccagtaattgtctttcttctatcatgttacctctgattcttattgctgaaatgtagaagaaataagagcctacaagggaaagagttctctgaacttggaattctgacctcatacttcttacctctcttagctaaagcagaaataatgaggatctagtatattacccctttacacttctgcaaaggttcttaacttatgtaagaatcaagtcaattttctatgtaaaatcttgacagggattgtcagaaaaatttagtgtggaatgaaatggagcctaatttcattttacttgaaactccattacagatggaaagtttgtagtataagatactggcaggtacttgaaaatgcaggtagcagaacagaaattctttggcttgctccctaaccttaaaatactatttaaagatggatcttgtatctgaaagtgcacacacaagattgttagcagttgatcacctctgaggcatgaaattaaagggttgagagagtggaagacttaatttttactttttaaacttttgaaatgttaggagttttttttttttttttttacaactgatatatgtttttaaaaatggatttttaatgacctagaagttttctgtgtaaatgcattgttatataaagggtatggaagagaagcttcactgcttattgcttcatccagccgacctagacttttgatctttgacagatttgtttccaagcaaataattataaataagttatcattttactgcatatccttgaaggttaggtagcatctcctaccctcagaaatgagaatgccaagcaaccgccccaggcagataaacattttatatttaaaggcttccaggggagaatttaccgctctatttactatgaggatattcttgaatatatctattttgagtgactcatgctataatgtaggtgttttcttctccttctcccctggtggaggagaacagctgcttgctaaccttctgtgtacctacactcttacattgttattattagaatgctgtgcaggggggtatccacttaaagctgggtgtgactgagaagtattccagacattatgtgacatactggcatgtagtgattaaggagacatggtctcacataaagacaccagcatgggcctgtggctcagggggccttgtggcttgggaagtgcctcattcccatctccacttagcactcctctatctgatgggattgttccccaccacaaagctgcttttggctccttctctttgtgacttccatggaacatgccacctacacaaagaaggaagaagaaagaaggctgtggtaccatcctatttgcaaagactcagaaactgaccttcctttgaattccatttccaccctctactaaatcttaattcttcatttgttaaatggaactaatagcactgaactcaccttgcagtttgtgagaactaagtaagctttttgtcagtacaaggagtgtggatgagcttcttggtaactaagctcccaaaagacttagatgaaatgaaattccagtttattatttggcaatggaaaaatagagccctccatctgagaagacactgtttcctctggctagcacatgaactacatggagagacatttgtgtatctttgtgaacacagattcagagtaaggagaattaatggcataattcagatgtttgacgttgtcaggaatgtggctgaaaatagtatcccacagcaagtaggtcacagtagaaaaagcagaaggtgcctgggaatcaaacagtcatctgggacaagttgctttttctcagcttctggaaaatgggtatgataacacttgctcatcagcttggtttaattatgagataattcaatgtgaaaaaggcccaacaaggactagactttttcatctccttcctataaaacattgagccatatctgatttgtaattagtgaagttaatgatccagcattctagattcccttctattttccatgggaatggaagaggcttctgaagcctgttttgttcttatctttgcttgcttatatcatgctgtccttgaaaaccatagttacctgtcttgattgcaaagatttataaacaaggcatagtcacactttatacatacatattcatagacatggaatgcaactatgatagcagtttgaacagaggaaattaaaaaatgttttgagtaatgcccatgtctgcataaattttacctagtcacccgtctctacttttgtttattgatacccacattagaccagttgaaaaggacagcaggccgggtgccatggctcatgcctataatcccagcacggagggctgagacaggaggattgcttgagcccaggagttcaagaccaatgttggcaacatagtgagaccctgtctttgcagaaaaaaaaaaaagaaaactacctggatgtggtggcacatgtctatggtcccacctactctggaggctgaggcaagagtatcacttgagcccaggaggtctaggctgtggtgagccatgatcatgccactgcactccagcctgggcaacagagcaagaccctgtctcaaaaaaaaaaaaagtcatcaagagtgtgcctgctttgaatgacactactgttatctccatatctaagctgtagacagatggtgtatatgcagacaataagaggcagtatcagtattccctgtgctgatgcagaggcggtactcacctcaaaaacatctgacttataaatgactcacagataagagcaaaatgggagcattatctcctggctgatgtctcttgccctcgctcctgaaactagttttcagaggacctgtggcttcagaatgctttcctgctccctctccttttatttccctatcattgctcaatctcacatgccatctcttctgggaaacacttcttgaatcctgcagaatgagtttctggcttttctctgctgtgggaaatcagtagatggtctctgagctgagaagtggtgcagaggggcacatgacgggcaggttgacagatggtcacattcagtaggtaggctgagctcagttcgaagggtcctgtgtggcatgctgaggatgttgagctttatctgataagcaacttggaaactagattgttaaaccttgaaatagagtaacagattaaaattttaaaacttgttttaaaatatgtagcctgcaggctgattgccctgtagtctaataaagtgctaacaggtaacctttcgatacagctgggatgctggcttcagggattctgcatgaaagaaatcttcatgcaaaggctgaaaattatagaagaaatattattgcaacaaatgcatgatgatttgctgaaagacgtatgagaatacacctgtgtttacatttcactttgagatttctgtggctcatgggcctgtgacaggacagttctgtcttctccatttgcccttcctgcaaatggagcatggtacaggtatcctcactcctcagggccattcatccatcctgcatccagggactcagtcagtttctttcagccattacctttccagtaataagtgtgttatttggcttgtttgtggctgtttgtacagccaactttttcgacatcagtagaggactagaacaaagcccttgaatacagaaatttgaggtgtgggtggaaatcaagctaagattacatcataatgttcatttcttagagctgctgacaaagataaagaagcaaatgatggaaccctgaaaaagtaaagcaaagtagagaaagagcttactttaatggctttcttcttaagtgctattagaagagagagagggcagatctttcatttgaatctttctaatttcttgggttataaggctcttgcttggccctaagtatttccagcaattaaatcaaagcccattaagcttaggttcatcatagatcttattaaggatttaaatctttatgcagattttatttttcttattgaataggataaataaaggtgacgtacaaggaagttcacattttgaaagagtacaagattacttcaccaatgcttccttgaaatgtggcactgagaaactgcaaagttatgtttttgtttattaaaaagtaagttctgggctgggtaaggtggctcatgcctgtaattccagcactttgggaggccgaggtgggaggatcacttgaggctgggagttcaagaccagcctgggcaacatggcaagactccgtctcttattaaaaaaaaaattaaataagccaggcatcatggcttgccttcagtcctagctattctggaggctgaggtgggaagattgatcgcttgcgcccaggagttgacattacaatgagctgtgattgtgccactgcactctaccctgggcgagtgagaccctgtcttttagaaaacaaaaaataagtaagttcagagggaaacttctagttttattgttgtgatgagaattaccaatataatttaatatattttaatacaagtgttaatatatgtagaatacttaacgcagtgcgtggaaatgttttggagagaagtcttgaaataataagagctagagctatcataatggagactcacactatccttgtaggctatatccttgttccatctactaaataatgtgcctttatttacggagcacctattaagtgccagttagtatgttgataccaaggatatctataaacaagtcctcccagagctgatatcccagtggacgattagctagtcttcaataaagagaacaattcatgatttgatttacttgttactgtaattatatgagtgtctaaaaaatagtgcatccttgaattttagaacagagttcctgaggcagtcagtgcattctggggttttgccccaaagtgcaggaaatatgaaatccaaatttatataaatgagatttgagcagcttcacttataacctaatttctactgatattcccagttttgtgtaaacgtctacaaaatgagttctatctaaagctgacgccaactgtttaatatgtgtattagatatacatatatgtatagatatatatgataaatatgtattatgtatattaatgtatatgttgtgctggacccagtttattcatctcccaggatcttcttggccattcttttctgctgtgcttccctgatccccctctagggaaattccctgatgcccactgcattctttagacacagagctcagatttctaccctgatccttgctggtggcagccaggtagtcaggacacctctgctgggccagccaggcccattattactcccgtctcccaactctgatgtcacttgtgatcaagaactggcattactgcctggcacctggggcttccatgagccttctgaacttcagtgctcctattctgacccccaggcacctctggcccaagtatgcccactggagttcccataaccctggcctgcatagcagatgtcactcctgttggggaactcaggcttccaggatggctgccagagggaccagggaaccagtcagaaatgggggttgaggagtcggtaccctgtggtgcaaacattgatggttgaagaccagagctagtagaaattctgctcccatggtggactgtgtgcagattcaggggtttttacagatactctgatctgctgtgcctgtgaaaaccgtggccaggtcagtaaccaacctgccccatatacctccctcccctgcctcaaagccctgcctccctcacaaccatttacatggaagccaggaagtgttttcccaggctccattttccagagaacccaggcaaaagtacaagtggagggctagtagattggaggtttatatttgagaaaatttatggagaattttctgatcctttttgaattgtgagtatttctgccagttttattttttaaatgtttttattttatttttttttttgagacagagtctcgctgtgtctcccaggctggagtgcagtggtgcagtctcagctcactgcaacttcggcctcccaggttcaggcgattctcctgtctcagcctcccaagtagttgggattacagttgtgtgccaccaaacccagctaatttttgtatttttagtagagacggggtttcaccatgttggctaggctggccttgaacttctgacctcaagtgatctgctggccttggcttcccaaagagctgggattacaggtatgagccactgtgcccattctgccagttttttaagtttttcttttagtttgggagagataaaatggattcagataaacagatggatctatgtgctcagtgagggaagagtgcagggggcgggggtctgtcttgttcaatctcagatcccaggcaaagcacctgctggtatatgcaacttgggaaacccacctgctgaagtcacagaactaattagcctttccaagctcaggaatcatctggcctctttcaccaccttttcctctcgtttatcttgttcctctggattatttgcatttaacagaaatgctgaatacttctatttagcagaaacattaaaaacaaggtttgtccagtatgcagggaaataatcttagatgtatgttacaggagaacttaacaggtaaagatccatgatttgcaccatatttgcatggggattgtgatgctcttgagcaaggtagaggcccactccctactctgtctcagctttcctgtctttgtagaccatcccttgctttctggtttctgctcctaccatttcaaatgaattatgctgactagtgctgtcaagtactttccttctggatccttatcccaattattttctggcacagatagcaaatgcattcttaaaagttcttccactgagaaagaagccatttctgatctgacttcctactctgttcctcctaggtccctccctttttacactgtatgtccctctgttggatgagcccatgatctccctgaagccctagtccatgtcctcttcatttttgcatcctgtatcctaggctcttcgctctgtttctagacctttaataaatgagttctacatggctgaatgtatgatgtttcaacctttcttgccttccctacaatttttttttaactggaggtttgcagctctgtaaatcccctaaaaaaattatggtttgtgcttttaagtttctgcttataaagtaaacagaataatgattaaaataaacacactcagtatttatagtaatatgaaaactaagtgagactaacaattactcactgaggattttcatgtctttaatatttgaatgcaatctggcttattgcagcaggactttgcaggtgacagcataatatttaaaaatatttatacttgtacataatcagcattttctacaacttattttgggtaaattgaaatgaccctaaaagttctataaaatatacctaaaacaagtctaaaaacaatcagactttgaaagcttctgttaggaggtttctattgcttgtctttctgaggatctggttcgttttggtggggtcaaggcacaactcggcacacaggtcttccaccttttactcaaaatcttgtgcacctttcttgggataggtagtggaatgaagactgtttgatattggggtgtgtgtgtgtgagagagagagagagagagagagaatctgcacataaacaggaagccaaaatgctaatatagacaagcagtaaacctactctcttacccccaccctgcaaagtagacatggatatgtaggctgtatatttgattgaatattggggaaaaaccctctccttaagatttctgtcttacctaggtgcctgaaattctgtgctttttgaaaaccactttataatgcacatggtcataagggacgaggaatcacagaaagacatgagcatttagaacatgaattcttgattgttttcatgccgtgtacacctttggcagcctggtggagtctacagacctcttttcaaaatgatatgcataaatgcataacataaaatttataagattatagtgaaatcagttaagttcaaaataaaggtatccaaatattaaaacaaaatttgctgtataatagtaggtgtctttatttatcagtgccctaataatgatatctagcaataagtctattcactcaggtaattttaaagtagtgaatgtaacatgttgatgtgaagtgaatatcttctcattttttagtgatgacaacgtcacaaatactgctaataaaattgtgctttgtcaactacatcatatttgaaggaagtgccacattcaaatatgaataccacattcaggtgttttcaatactttcagttagaaggtattgaaaattaagatgtaattttgttatcattgacgtttctggaccctttgaattttatccatggacacctcccagggatttctctgattccattgaagaaagttttaagcaagtgaatggaggcacaaggagatggagggtaagaaaagtaaaatgggaaagaggaaggtggaaaacaaacttgataactttgctgtggctagttctgctaagactgtgaatggtgctcctatgatattgaataggctaaatgcagttgctcaataaatgtaacaaactcgcagaatcattttaccttcatttgaatctaaagaggacatgattcttctctgattaatacagaattctgatatccccatcaacaggtctcggtatgcagcctgcctgggcaagttacctggggatgtctacaactctctaagttgcttaggttatcagaagtcacagcagagtctttggtgagaaaaaatgaaatacggacaaacttgtaaagggagatttcttgggaaactctgtattgcttccaatagtcatacttagctttcttctattaggtttggggtagagaaaagctgggaataagattcgttctcacaatttcaccatcagtttgctaaaaggcttgtctttttaagtatagaaatggactgtaaactatgggtttgacttaattggtctgagatttggcagtttcatgtgcgtaggtgaatggtgaggcttttacattttttagattaaaaaaattttttcattatactttaagttctgagatacatgtgcagaatatgcaggtttgttacataggtatacacatgccatggtggtttgctgcccatcaagccatcatctacattagatatttctcctaatgctatccctcccccagcccctcacccccgacaggccctggagtgtgatgttcccctccctgtgtccatgtgttctcatcgttcgactccctcttatgtgggagaacatgcagtgtttggttttctgttcctgtgttagtttgctgagaatgatggtttccagcttcatccatgtccctgcaaaggacatgaactcatccttttttatggctgcctagtatttcatggtgcatatgtgtcacattttctttatcctgtctatcactgatgggcatttgggttggttccaagtctttgctattgtgaatagtgcctcaataaacatacgtgtgcatgtgtctttatagtagaatgatttataatcctttgagtatatacccagtaatgtgattgctgggtcaaatggtatttctagttctagatccttgaggaatcgccacactgtcttccacaatggttgaactaatttatgctcccaccaacagtgtaaaagcattcctatttctccacatcctctccagcatctattgtttcctgagtttttaatggtcaccattgtaactggcgtgagatggtatctcattgtggttttgatttgcatttctctaatgaccagtggtgatgagccttttttcatttgtctgttggctgcataaatgtcttcttttgagaagtgtctgttcaaatcctttgcccactttttgatgaggttgtttttttcttgtaaatttgtttaaattctttgtgtattctggatattagccctttgtgagatggacagattacaaatattttcttccattctgtaggttgcctgttcactctgatgatagttgattttgctgcgcagaagctctttagtttaattagatcccatttgtcaattttggctgttgttgcaattgcttttggtgttttagtcatgaagtctttgcccatgcatatgtcctgaatggtattgactaggttttcttctaggatttttatggttttaggtcttatgtttaagtttttaatccattttgagttaatttttgtgtaaggtgtaaggaaggtgtccagtttcagttttctgcatatggctggccagtttccccaacaccatttattaaatagggaatcctttccccattgcttgtttttcttgggtttgtcaaagatcagatggttgtacatgtgtggtgttatttctgagacctctattctgttccattagtctatatatctgttttggtaccagtaccatgctgttttggttactgtagccttgtagtatagttggaagtcaggtagcgtgatgtctccagctttgttctttttgcttaggattggcttggatatgcaggctcttttttggttccatatgatatttaaagtagttttttctaattctgtgaagaaagtcaatggtagcttgatggggatagcattgaatctataaattcctttgggcagtatggccattttcatgatattgattcttcttatccatgagtatggaatgtttgttcatttggctgtgtcctcacttatttccttcagcagtggtttgtagttctcttggaagaggtccttcacatcccttctaagttgtattcctaggtattttattttccttgtagcaattgtgaatgggagttcactcatgatttggctctctgtttgtctattattggtgcataggaatgcttgtgatttttgcacattgattatgtatcctgagactttgctgaagttgcttgtcagcttatggagattttgggctgagaggatgggtttttctaaatatacaatcatgtcatctgcaaacagagacaatttgacttcctcttttcctagttgaataccctttatttctttctcttgcctgattgccctggccagaacttccaatactgtgttgaatgggagtggtgagagagggcatctttgtcttgtgccagaatgcttccagtttttgcccttcagtatgatattggctgtgggtttgtcataaatagctcttagtattttgagatacgtcccattgatacctagtttattgagagtttttagcataaagggtgttgaattttgtcgaaggcctttactgcatctattgaaataatcatgtgctttttgtcattggttgtgtttatgttatggattatatttattgatttgtgtatgttgaaccagccttgcatcccagggatgaagctgacttgatcatggtggataagctttttgatgtgctgctggattcactttgccagtattttattgaggattttcacatcaatgttcatcagggatattggcctgaaattttctttttttgttgtgtctctgcgaggttttggtatcaggatgatgccggcctcataaaatgagttacggaggattccttctttttctcttgtttggaattattttcagaaagaataccagctccttttggtacttctgatagaattcggctgtgaatccgtctggtcctggagttttttttggttggtaggctattaattactgcctcagtttcagaacttgttgttgatctattcagggatttgacttcttcgtggtttagacttgggagggtgtatgagtccagtaatttatccatttcttctagattttctagtttatttttgtagaggtgtttatagtattctctgatggtagtttgtatttttgtgggatcagttgtgatatcccgtttattattttttattgcttccatttgattcttctctcttttctccttcattaatctggctaagggtctatctgttttgatgatcttttcaaaaaaccacctcctggattcattgatttttttgaaggttttttcttgtctcttgtctttttcagttctgctctgatcgtagttatttcttgacttctgctagcttttgattttgtttgttcttgcttctctagttcttttaattgtgacgttagagtgtccactttggatctttcctgctttctcttgtgggcatttagtgctgtaaatttccctctaaacactgctttatctgtgtcccagagattctggtatgttgtgtctgtgttctcattggtttcaaagaagttacttatttctgctttaattttgttatttacccagtagccattcaggcgcagattgttcagtttacacgtagttttgtgattttgagtgagtttcttaatcctaagttctaatttgtctgcactgtggtctgagagactgtttgttatgatttccgttcttttgcatatgctgaggagtgttttacttccaattatgtggtcaattttagaataagtgtgatgtgctgctgagaaaaattcatattctgttgatttggggtggagagttctgtaaatgtctattaggtccacttggtccctgtctgagttcaagtcctgaatatccttgttaattttctttctagttgatctgtctaatattgacagtggggtgttaaagtctcccactattactgtgtaggagtctaagtctctttataggtctctgtgaacttgctttatgaatctgggtgcttctgtatcgggtgcatatatttttaggatagttagctcttcttgttgcattgatccctttatcattatgtaatgcccttctttgtctcttttgatctttgttggtttgaagtctgctttatcagagactaggattgcaacccctgctttttgtttttgttttttgctttccttttacttggaaaatattcctccatccctttattttgagcctatgtgtgtctttgcatgtgagatgggtctcctgaatacagcacactgatgggtctcgactctttgtccagtttatcagtctgtgccttttaattggggcatttagcccatttacatttaaggttaatattgttatgtgtgaatttgatcctgtcattatgatgctagctggttattttgcctgttagttaatgcaatttcttcatagtgtcgatgttctttacaatttgccatgtttttgcagtggctggtactggttgttcctttccatgtttagtgcttccttgaggagttcttgtattgcaggcctggtggtaacaaaatctctcagcatttgcttgtctgtaatgtattttatttctccttcacttatgaagcttaatttgggtggatatgaaattctgggttgaaaattcttttctttaaaaatgttgaatattgactcccactctcttctggcttgtagggtttctgctgagagatctgctgttagtctgatgggcttccctttgtgggtaacccgacctttctctctggcttcccttaatattttatccttcatttcaaccttgttgaatctgatgattatgtgtcttaaggttgctcttcccgaggactatctttgtggtgttctctgtatttcctgaatttcaatgttggcctgtctttctaggttggggaagttctggataatatcctgaagagtgttttccaagttggttccattctccctgtcactttcaggtacaccaatcaagcataggtttcttcttttcacatagtcctatatttcttggaggctttgtttgttccttttcattgctttttctctaattttgtcttcatgctttatttcattaagttgatcttcaatgcctgatatcctctcttccgcttgattgatttggctattgatacttgtgtatgcttcacgaagttctcgtgctgtgtttttcagctccatcaggtcatttatgttcttctctaaactggttattctagttatcaattcatctaaccttttttcaaagtacttagcttccttgacttgcattaggacatgctcctttagctcggaggagttcgttattacccaccttctgaagcctactgtcaatttgtcaaactcattgtctgtcgaagttttgttccccactggtgaggagttgtgatcctttggaggagaaaaggcattctggtttttgcaatttcagcctctttgctctggtttctccccatcttcgttggtttatctacctttggtctttgatgttggttggcctttgtatgggtttttggtgtggatgtcctttttgttgatgtttatactattcctttctgtttgttagttttccttctaacattcggacccctctgctgcaggtctgctggagtttactggaggtccactttggactctgtttgcctgggtgtcaccagtggaggctgcagaacagcaaagattgctgcctcttccttcctctggaagcttcatcccagaggggcacctaccagataccagctggagctctcctatgtgaggtgtctgtcaacccctgctgggaggtgtctccccatcatgaggcacaggggtcagggacccacttgaagaggtagtctgtcccttagcagagcttgagctctgtgctgggagatccactgctctcttcagagctgacaggcagaaacgtttaagtctgctgaagctgcgcccacagccaccccttcctccaggtgctctgtcccagggagatgggagttttacctataagcccctgcctgggaccgctgcctttctttcagagatgtcctgcccagagaggaggaagctagagaggcagtctggctacagcagctttgcagagctgtggtgggcttcaccccgttcgaacttcccagtgtctttgtttatgttgtgaggggaaaactgcctactcaagtccagtaatggcagacacccctcgcccagcaagctggagcatcccaggttgacttcagactgctgtgctggcagtgagaatttgaagccagtggatcttagcttgctgggctccgtggaggtgggatctgctgagctagactacttggcttcctggcttcagccccctttccaggggagtgaacagttctgtcttactgtctttccaggtgccactggggtatgaaacaaaactcctgcagctagctcagtgtctgcccaaacagctgcccaattttgtgcttgaaacccagggccctggtggcacaggcaccggggggaatctcctagtctgtgggttgcaaagactgtgggaaaagcgtaatatctgagctggagtgcaccattccttatggcacagtgcctcatggcttcccttggctaggggagagaagttccttgaccccttgcgcttcccgggaggcaatgccccaccctgcttctgctctccctccatgggctgcacccactgtctaaccagtcccaatgtgatgagctgggtacctcagttggaaatgcagaaatcacccgccttctgtgttgatctcgctggaagctgcagaccggagttgttcctgttcggccatcttgccagccatcgatcagttttttagatttttaagcttcccaaggaaagcaatgatcttttcttcctgaagtggccagtaagtggccattatttaactgatggctttttgaagagtgctgatttttctgaggatattctaatgcaagtaattattagatgctttctgtggggcgtggatatcagctcacttgatgtctgaccacatgatgttgctcttctgtagctcctaactggcatatgcatcaggagtatcctcaaggctaagagccccagtgtcttcccttaggctagagattgggccatatgcaagttaatctttgtaatcttatgaaagctcatggttctgaaatgaaaagtaaaactgaagttgaaattgcacagtggcatggtggactttgtcttcaggagatgaagtcggtttagagagctgaattttcaagatggctgacaactggctgcactatggtatcaggaaattttactgcttttaggtgaatatcactctaagctttatcaggcacctttttgccttactcaacataaattaacatgtttgtggtaagttaaggccatgttgaaaaacataaatgtttttctgcagatttgctaaagagtagtggcttacttatgctcctaactacccctggctgctgtgctgcaacttggcatgactgtattttatattttattatgtcttcccttttggcaactcagttttctcattgttgcttgggtgtctgctttagcagtctttctttcctgtgaatttctgaaggtgtagataccagataacataatttttgtgcatatggttgagtacaggctgtgagtcaactgaataaatgcatggatttgacgacatctgttttggctgctcagaggttttgttttggtatatgtactctctagtacttaattttctgtgtaactgaaagataccttaactctaaattgatggtaccccatcccctcctctcttcattacactgcctaccaatcaataaaaaatctgatagacaattttaaatattaaatcacctgaatattttttatttgaaatataaaatcactgaagattttttttcctcaacgatttaaaaatattctttgcctttagttcagctttctcctctgggcctggctgtagactctatggaagtaattctgcctaataaaaaggtttagagatgttgtctaaaacactttagaaaagaaccgtctctctggcagttaactctcatggggataaagtagctttcaaactccaacaataatggttagttttgacgtatctgacctgtttgtgtgcaaagtgggagttcgcctccctggaatgccacttaaggcagcaatgcagctcttgaaagaagttttataaaagcaaaacaccaagctgtaaaggacaaggcattttaatgtgaactgctattactttcgcaagagcccagttgctttcctagaaagccataatgtgattcccaacaataactgtggacatgctgttcctcctgtggttaaatcacatcttgatttcagctgtggagcactgattaatccttctaaagtttggacaatgaatgaagtgaatgaagtttggacagtgaataaagtatcttcctctaccctccaaggtattgatggtcactatttgcatttgtgtgtgctctacagtttctcagtgacagtccagttcagttcttaatttaccctgatgatgatcctaaacttgcgttagccattgttttctgcggtgccattctgtcactttggcatttgaatatgtctgacatagcaattacaacttcgtgttttaattacttaattacacagttgcttactctgttagactggaagcttctgaggggccgtggacatgtctttttcatgcccaatgtcagtgtctgttcactgtaacaggctcacaaatgtttgtggaatgaacaaatgttgaatccccagcctgttctccatctgtggcctgtcttaatgcctcatcctggaggactcagctcagagttccctttctctaaagagctgtcactagcaccccacctccctgagctagcttcagtgccacttttgtgtgtgccctcagtgaatgttgaacgagggaggtgttcacaccattgcaacatcactgtcttcctgccacacctgacttaagaatggggcttgagttattatactcaactttgaatcagtggtgcttacgacagtgcctgggcagtgattactcaatacatatacacagtacattttaaagtttgctgtttctttttagaataattgtgtaaatgataaagaagaaaaaattaaagaaaaagtgtttctgccaatgagatacataaaaggatttaaaatgcctctgttgttattttttgttcatagtgcattgtggtagttaattcaactaattgagtgccaggcatatctcagattatccgtcattggtgatatagatgtatcaaattactgtttctgcttttttgtcagataaaattcagttgtcagcataaactggaatcatgtaagtggtgtaaaagaaccaccgttctttcacatattttaggctaagaatcattttggacaccatcagctccccagcctctcagtatccattcagacaaacaatcctttgattgtaactcaagatatcccatttatccttcccacttcctcatatcactgccttagattaccattggtctactattcccacctaatattttctcttcatgttattataaaattatattattgtgcagttattattcatattattttgctattctacccagtgtgtttatgggtacctggtttgttttttttacccggattgaaaacgattacttgaaagagttatttacaaaaatactggttaaatgaaagaaaaattagccttgaataaaaatacccaagataatcagtggtattacttcttgtacatttcttcccatttccttgtcggcaacaataaaagtgccatttatacaggagtgaatgttggaagtgattcacgtggcatctcttgacagacctgtggagggcactctgtggaggcagaagatgaagagcacttagtatcgagtgcctctgtgagtcatcacagatatgcttctgaccttcagaccattttggcacttaatagataatgtttgtcttctcttgggttgtgtaagctcagagaattggtcatctgttttgaataatttgatcttaaataacatttttaagtaaagccacatgagtgttattatatcattttattgcattaggaagcaacaagaataaaaatatcctctgggcttctgaagagatccaggggtttatttaattgtttatattatattaaatgtcttacttaaaattcatgtttttcaatgaatgttggtagtttttaaatgatagattttattttcatctccttatcttgcattctgtcactaattcttttgtttccttgagaagaaataatagaattagttttggttccatactgtcatcataagcatagtgagttttaacttttatttttaaataagagaatagctcatgtaatttgagaatcgattaattttactttttaagacttataattcaaagctgaagatgaccctaatagcttctaatgcacttttttttgttctctttttaattttctccagagagcatatgccaccaatatttggttatctgactctgagatgtgctatgaaaccttgattatatgttagactaaatcatcagctccagaatctgactgactggattacaatctgcttttctgtgtgaccttagggaagtttttttaaaccctcctggttataaaatgacaatacttctctcaatggttaccgaagggaccaaatgacataaagtgcttagcagagtggctggcacatagctagcactcagtacaggttcggtaacaacaagagcaacagtaacaccaccaccaccaaaaggagggagtgggggaagtcaagatgattgcttgtgcttagaacagaggatgccaagagacttcttttcttttgggctggaagctgctttcacattagccagtcttcttttctttgaagtaacagggccactttatataactttatataactttatataaaccactgaccatgatcattaataaattaaaaaatactattttcatgtctggagcagttgcttagtatttatattcaataaatcaaaaccctggaagattaaaaatacatataccttttggctagaaatctgacttgtaggactctcttctgtagaaatgaagaccattcacatggctctttattggatgttctttgtcgtagcaggtgtcgaaagtgtaaatttgggtctctgtgtccttattggcctgaagagttgtcaacattatattattggtaaaggatcagaacaagctgcagaggaatgtgtcagcttattattctttgaataaagtaggaaaagttttaaaaaaaaaaatcccttcgtatatgtgtctgtatgtttatttgtatataaagaagtatcctgagggaaacatactattgtctaaatgggataagtttgtggtcagttaagtgaaagttaggaagaaatgtttaatttttcctttgaaatctattttttgacattttataaaggcatatgcaatttttgttaatgtttttaatgaaaagttaaaatggggaaagaacgaactgggtctctatgtaaacaaaacagtttgcaaggatatctagaatttagctatcttgtttttatattctgagagctgatataaagaattttccctaatatacagttatttccctggaaagctgatcgatcattcatcatcaagtgaggacatttcaaatgaagcttttaaaaaatgaaatttttaaagtggttatgctagaggcaaaaaaaaaagagagagagaaacacctctttagacctctatgaaaaacgagttttaaaacctaaggttttaatagaaatgtaataagttatactgggttctgaattaacaacaacaaaacctgaaaacgaaatagtgtactcagtaaaaataactttccacccagccaagcttagagatacagtgatagaaatatatgtgtataaatctgtttctagaccacctacctaagggaataaatcaagatgcactgagttcagttattttaattatcctatagctcccacagaaaggagctgaggagctgaaaacactaggagaaacagaaaaccaaaagcttccttcagaaattcttcacaaatggcctggcgcagtggctcatgcctgtaatcccagcactttgggagtccgcggcgggcggatcacttgaggccaggagttcgagatcagcctggccaacatggtgaaaccccgtctctactaaaaataaaaaataagttagctgggcttggtggcaggtgcctgtaatcccagctattggagaggctgaagcaggagaatcacctgaacccaggaggcagaggttgcagtgaactgagatcgtgccactgcactccagcctgggtgacagaacgggtctgtctcaagaaaaagaaaaaaaaagaaattctttacaaatgataagtgacatatcccacagtgggtaaattgttcactgtattatggtgtatcctaggatactatgcgtatcagtgaaacattcttggtaacgtgcaccattttttttttttttgagaaggagtctccctctattgcccaggctggagtgcagtagcacagtctcagctcactgcaacctctgtctcctgggttcaagcgattctcctgcctcagcctcccgagtagctggaactacaggcgtgcaccaccatgcctggctagtttttttgtatttttagcagagacggggtttcaccatattggccaggctggtctcaaactcctgacctcgtgatctgcctgcctcgacttcccaaagtgctgggattaccggcgtgagcctctgtgcccggccaacatgcaccattcttgccaaagacctgaactttaccatctttactcttttttcagcaaatttgtttgtaaaaaccatttcctccctgcctcttcctttctctctatcccggtcactctccctgtatatttgtatgtgtgtatatacctgtaataaagtcatgcattgcttgatgacaaggatgcattctgagaaatgtatcgtcaggcgattttttttcattatgcgaacatgatagagtgcacttacacaaatcgagatggtagagcctacagcacacctaggctatgtggtatggcctattgctcctagactacaaactgtatagcatgtgactgtattgaataactgtaggcaactggaatactatggtaagtatttgtgtgtctaaacatggcaaaggtgcagtaaaattagagtattacaatcttatgggactgcagttgtgtatatggtccatctttcgccaaaatgtccttaagtgatgcatgactgtgtgtgtgtgtgtgtgtgtgcatgtgtgtgtgtgagaaattcaaaacgtctgtattgatataaactcattaggtgatttaaaaaaattggtttagtcaaattaaattttcaaattggttatccttttttaaatcacatgtccaatcaagtacccaagaaagacatattaattttctgtaatgcattctcaatgatataacatgatccaaaattcaggtcatttagatattgtttgctcttttaaaaactttaaaaaaaaacatttaaaacttttattataaaaatgctcaaaatacacatgagtaagaatccaccctcaagcttgtcttaaaacaacactcatagctgataattctatgggtcagcagttggggctgggctcagctgaatggttcagctgatctgagccatgcatggctgatcttggctgggttcacttttgcatctgcagtcagctgtcaggtcagctggtcctaactgggaaggctgaatcctgctccacattgtctcctgtcctccagcagtctagcctggacctgcccccgtggtagtgagcatgttcacatgttgttcctttctctgctatcttaggtttatttagctctgctatcttaggtttatgaataaaattagatattatttatatatatacttacaaggatataatgttcctcctgaagttatctaactaatgtgctgccccttaaactgagaggcagcttagtatcatgcttaagagcacaaagtccagagcacatttccctgaggttcatattctgtctccaccacttacaacctacatgatcttgagcaagctacttaacccctctatgcctgagttctgtccttgtctgtaatgagtaaaagagttaatatatgtaaaacatttggaagagtgctcagcacgtattaaatatcatgtaagtgttagctattatcaattcccatattaattgttaatatagatatatatttaatgatttgaaagtttttaataattggttttataagtataattagcagctttcataatcaccattaattattgtatccttttgctcttataattaaatatatgtatttataatttaacagacttggtagcatctaagcatttaaatcacactaggagatttttcactccacgttgcacctagaatgattatttatatttgaaaattcatgtttagatattgaagataaattcaagtgccatgcctagtttgtattactgaccttgttatgctgatttaaagatggatgttggtaacctgtgtaatcgcatgatcattgatacacataaattttatgggtgtaagaaatttccttgaagtaagaactctgttatcttgtcttctaggctaagttcaaatacatttggataaaaactgggaccaaggttgaattttgacatatatctattctatgccagtcacccttttaagaagtattttacgtgatttaccttatttaatttattcaaccacctctttgattaggaaacttgcaaaagagagttagttcacttactcaaggacatacaaggtgtgactgagtcaagatcctaattcaggttgtttggctacagagcttagcttttcctaccaagctcagggagccctcctcaggtcctgcccagcacagtccagagtactttgcttgctttagtccaattctttcacagtaggcactgtttgtttttgagtttatggacgaactgactcagattgagagtgattttcataaggtcacagaactagcaagttttgtaaggtgagatttatctaccagcctgctcttggcaaggagtgtgactctctctgtggcctctgctgttgggatgctgtgtgtgataaaatcccctgcttctttctttcctgaacccttgcaggagcttcaccagaacctcacaagcatatagtgttgaaatgtttatgtaattaagaaatttatccatgttaaaattatacccagcatttgctttaatttaaatttcttggtttagtggtaagataactattttcccagacatctccattctaattgtatttctgctaatgcagattgctttttcatattatttgctaattatttattggtattttgatgctttttctggttaattaatccaacagattacttaaattccagacttttgataatttataaacttgatactgtgttgttagtttaatgtggacaccgtttcattttctccactgactcaccttgttaaattttgaccattccttctttctgccttctgatcaagcagtgaaaattcctgcatgactctggtttctgaccctagttgggctaatgaaacatcctttggcttcttcttcaggaatgtggggagctgtcaatcagggatgtcaacagaacccttggagtcttttgaactgttttttaggacaaaggatgatttagcaagcttcttctgagtaccactagcaagtgtttgaatgtgtcaaagacagacctttaaaatatttaagtttggcctgcattttatgtaaaagctaactgcacaatttcttcttaaggcaagtcatagtttagctggtagactatcaccagatagctctgatctgcagaccatactgagtagcataggcttttttttcacatgtggaaaaaaaaggtttctgaatcaacactaatttaggggaaaaataaatggaagcttatattgtgatggcttatgtcattctgagatttacaacagaaactaacccgtttctaaagatgtcaatcaatgaaaaacttgacgtatgggaaattaaacagtctctttagaacgttctaaatagtcaacctgtcactactcaattgttgtatgtgtggctcatttcctgagatacagtcattagcgtcatcagatagttaaaaggttgtgtttgctttactcagtgtttgttttttacttataaattacaaagctcacacctagtattttctacctaagtcactgaagcagtttgtctaaatgacacactgtaatacaatttagttctcattaaagcttcccttttcttataaaaggagagcacattgcttgttactacagaacccaccgggtttcctctctgcagtgagcctcttccaatactgctttgtctcttatgataactgtgtttcacaagtcccttttaagattgatggtcctaaatccataaagtttacagccacttctggttgttacttatgtaactgttggtgaacttaatgatctgatttgctaattctgtgaatctctttttattctttctgtgctcagtgaaaacaacttaaaatatgatatacaactaaactgtgaagttcttgctgcaggaataggtccaagtttgtctcgtttgtagttctcaaagtgccccaatacataatgggtgctcagatgaatcctgccatggctaaaagtgactagttaaggtgaaataatatatttttcttcagctcaatatttttatgaataataaaaatggccgttcagttgtgctgtgaatcactaaattgacaattgaatatctttttggtatttaatataaatgtcttaaagcaaaggttataagcacatctgaggtatatgagctgtgcttattaattttgtagcacctagattcatgtggaattctctcaagtagaacagagtaacgtgaactaaatggcatgatttgtagaatgatccatgccaggatgatcccatcagctgctgtccctggtgagggagtgtattagtccattctcacactgctatgaagaaacacctgaggctcggtatttaaaggaaagaggtttaattgactcactgttccgcgtgactgggaaggactcaggaaacttagaatcctggcagaaggtggagcaaacacatccttcttcacatggtggcaggagagagaagtgccaagcagaggggggaaagccccttataaaaccatcagatttcatgagaactcactcactatcatgaggacaacatgagggtaaccacccccatgattcaattaactcccactgggaccctcccacgacatgtggggattataggaactacaattcaagatgtaatttgggtggggacacagccaagccatatcagagagtaaagggatgtgcagttggttagagagttttacttcagcttccctgtgatacagtattacttctttttgctatcttactgtgttttcaccagcatgtcatgaatggggcaaaaattaatacaactaacaaatggtctttttcagtagttgttgggaatccacaaggaaggcaagaagagacagggcaaacggaaagaaaatgtgtcatttgggagaagagagaatttttgttattcatgtcttattccctagtggctgagaaataagtattttatgtttgtaggaagggcatagaagaggcagtagcttaggagggatatatgatatctggtctgcagaatgtgaatgcagcttggagactgtggtttcatcagactgaaatgggtgctaataaacatttttagggcgatggtggcacctccctgcagaggctttgttccctttgagctttgctcccgtagttcatttatttctccacaggccttcctcttccctatttcaggaaatttctggagacatattctttaggagctgtgtcagtactgactgagggagttggaggaggggtgtaacctggtattatgataatcaggggatgagatcaaagtgtaaaggacaaattaaaaatgaaaagctttcttaggaagcagagcacagtggttttgattattgggaggagttgcattatggtcttaaagcatttgtgggctctgatgtcagttgtaggttgcagccagaattgatttgattttgcaaaatgcaattgagttagaatagaaaatgtacatgcagtacatatatacacatggttagaagcgtagtggtacacttttttttaatgaaagcctgggtatgtgtgtgtgtaggtaaatgtatatagagacatgtcgctttacacatgtatgctgaaatgtaaagaacaatatattggcgtggcacagtggctcacatctgtaatcacagcacttgggaggctgaggcaagtggatcacctgaggtcaggagtttgagaccagcctggccaacatggtgaaaccccgtctctactaaaaatacaaaaattagctggacacagtggtgcgtgcttgtaaacccagctactcaggaggctgaggcatgagaatcacttgaacccaggaggcagaggttgcagtgagccgagtttgtgccattgcattcccacctgggcaacaagagcaaaactccgtcttggagtagggcagcgggggaagtacaacctattatttcgtactgagttagtcaaaatgtttgaaaaatattagtcttaggagcactgcctttgcagtttgaaggtaaaaactttgcattccccttggccctatccgatgctttcacttgtcctctagtgggttcaccctgctctctctttcttcagagcttcattgttgtgaggatttaattagatcaagttcatggagcacctggcttaggcactggtggcccattttgttcccgtaccctcttcccttctccttaagacatgcagatgtacgtggtgattccatgtgccgtggcctattggcaccctttattttctcctttccttgaagccgggtcttttctatattcagagcctgggtgcagcctttccattcaccatgaccatgtgtgtccacttgcttcccactttccctcttcattttcttctgcaacgttctttcgtagtcaaaggggttggcttttataacttacctttgggttaagaaagcagatttttctttttttcattcttttctttcaattttcctcatctgctgttgaggaaaaatgtatatttgggtaccaaggatgctatattgtttactctttgctataactttaagcctatgctactcagtatggtcggcagatcagagctggcccactcattgtttctggtccctgaccagtacagaaactgagagcaagtctttagaaaatttttataggaattggacagaataattttatttcatcgaataataacaaatctggggctaccatgttgtgtgactaaacaatttcatttttctagcaattcatgtttattgtattttatataaattggtctgagatgcactggacttttttttttaaaaaaacaacaacaactggtttttcattacaggttgtttgagaagtgctgctctagtgaactgaattgttctaactggttgtatctgcataggtcagatgaagcacaaataaccccataaactagagtcaggagatatgcctgcagtgatggaacttgttaacattttgtttgcctctcgtattctaaatccacaaatttaaaggcatggtcatacaagaaaaaggcaaaacagccaaagggaggcaaagaccaataatctgtggcttttgctaaaattaagaagtttaaaaagtgaattttataatagctttaaagttcataaaatgctgcttctctgtaagccaaagtattgaagaagccatgtaactctttcttcctgctggataatggaaaatattcttttgttgttgttgtttgcaaagtttctcaaatacacttggaagagaattcatgtagttttctcagccttgacaaatctagagctccaaacacaccaatgcaaattttaatgatgggttagaaaggaataattctgtgcagttattactgctgtcacaaacaatgatggaagatagtttaatcaaaagcctttgccagtggatatgattggctaaatttaattcacccagagatttgagaatgtgaacattgcatgttcttatcaaagagttttcctttttggggaaaccaaaataattattcttaagaagcttctaagtctgcatctaaaggctgtccctttttgaagctgactccatcatgcagagctcatttcatttgcctgcaatggtatattttctacttatatactagtgacttaagggtgttttgttatctgaacacaaacggaatttctatgctaatttgaattatgattttttaaaaatttaccgagctggaatgctttttgtaggaggaaagaattgtaaggaagtaactacagagggagacccaattactctttgaaaatgcattacctcgcagtcaaaacatttaagtagaaggtgaaaattaaacattcagccatatagggatagtttaaaaaacagacttaatagtctaaaattgaatataaatgctttgaattctgtaattctctaaacattggttggtgagttgactttataccttcatagcagataggtgataaaaacgaactaagaagcaacacttctctccctcctgccaactgtaactttactgcaggttgctagactttcatatttgcttctgtaaactcattggcacataatagtacaccactgtcaggaaacacgagtgtggatagaaacgtcaccttttgtactttaaagctgtgagttaagtcctgatggccacacactgaaataaagataccctttccccaaaaacgtaaggggaagattaattgagttgaaggttttgtgttatctcagtactaatgttcttctctcgtaaagaaaggaaacttaaaaattaccacttaggtgaattatagtaggaccaggagagttgtgaggtgaacagggggaaatagagataaatggtaaagaattccagctgggcacagtggctcacacctgtaatcctaacatttgggagggtgaggcaggaagattgctttaatcttggagttagagaccagcctgggcaacatagtaagaccctctctctacaaaataaaaaataaaaaaaattagcagggtgtggtgatgcacacctatgatcccagctactcgggaggctgaaatgggaggatcacttgagcccaggaggtcgaggctgctatgagccgtgactctgccactgcactccagcctgggggacagagtgagaccctgtctctaaaaaagagccacataattttaaaaagccatacatttaggagggttgtggagctaaagtcatcataatgaaagtcaggagcatttgctgggcttgtgttttgtggcaggctttgtcccgcttgccttgtatgcattcgtggttaattatgaggctgcatagatacaccaattgggagactgtagaggaagggaaaaagggaatctcacagaggagtgtaccgcaggggaaggtgcttggcagagacttttcctctaaaagatcatgagtgttgaaatctgagtgctgcttaattgatttccagatcagttgggagagactagctgtgctagtgaccatgggggcagtccagacagaattgcctcccaaggacctgaacccctgccagaggaagactgtgcatagagtctgcatttccaccaaagccctgcccctgcacttgagaagcctctcatgaatttcacaaaatcacatgctgaaaatagcagatcttaggccaggtgcggtggctcttgcctgtaatcccagcactttgggaggccgaggtgggtggattacctgaggtcaggagttcaagaccagcctgaccaacatggtgaaaccttgtctctactaaaaatacaaaaaattagccagggatggtggcaggcacctgtaatcccagctactcaggaggctgaggcaggagaatcgcttgaacccaggaggcagaggttgcagtgagctgagatcacgccattgcactccagcctgggcgacgagagcaaagctccatctcaaaaaaaaaaaaaaaaaaaaaaaaaaaggagagagagaaaatagcagatcttgtgagaagaacagggttggggctgacccttccaaatctatgcagctttgtagctggcaagtgaacaaaaacattgacaaaactaataaaagtgctggctctctgaactccactctggcacagaccccatgagaccatccttggccctgaaccccagaccctgaacccaaggcctccacttcttcccactctccatagaagtcctcgaagtcattctcttctaatagagactacttgctgtgaacgtaaaaatatcatctgaggtttgtcttcttcatcagtccttttcttttttttgtcctttttaaacacagaggaagggggcagaggcttcacagttcttcacccgttcttacagtttcagagacagcttaggagtggaaagaggaatgaaaccaccaaaccccccttcttgccactccttgcattgaggaaagatccacttctgtaggatcttcagctttgtttaaaagacatcatgcactgataaagctttccctttatttgagaggacagttgcccctcatcacttcacaacatgaatgtcctgcaaaaaattgcacataaaccaagaggacttgtgtgtaatagggatgtcactcccctgtctagtaatcctctatgagttaatctgcactacagaagcatgcctcaaagcaaaatagactattcttagtcaaacagggaaaaaaggaggagaaaagactataaaagctaggatcacttgagtaacttagattatacctgaatttcacctggatctcaacataaaaattcttgtgtactttagacacaagagtgtaagagcatttcatgctggaatggagcagagtggatttagcattggaggcaggctgtgtagctagtaaaataacagttttggaaaactgggtgatttccttaacagtaatggtagaaaggtacccagtttatgtaaatatgtgaaaggaggcccctctgagtgcttcacaggatgtgggcaacacttattttgccgtcctgtgtatattgccgtgctttccacccatgcttgcccaagcttaagtgatgggaacaatgagagatacaatattcttggcaatatggccatactccaggttttgttcattcagacgtgacctcaagaacatgtcatgcctcagctccaccagtaaggatatatgtggtaactgttgtagataacagagcccccagtgatagaatctggcgtaaatcagcttctatttcactaagagcaggaaaacacaatctgtaactcatacacaggaacgtcctactctggatttatgatggggttcatcaaccctgcatgttttgaagattttttacatttgtaaacagtaactaacctgaattatttcaatgatactctcgtcacttgttctttctctgcccctctttcttaaatgacagttaaagttcttccttaatgctgaaatatatttcataggtaagttatatttcacagataggttcgcttgtgacttggcttttgtatttctaggtacataacattcattgcttgaaaaattgctctgttttaaaatagctactataatttcccttcactgctgtgaaagggtatttttttcatatgtgttcaaaaagcacatgaagaaacatggggttactggagtgtggcataatgagtaatgggctggaaactcagaagctcaaagttctggttttgccactaactcatcctaaaacctagataagctgcttctaatctctctgtgaccccattcctgtttatcataaatggtgttaaacctggctcacctcatagctgtaaaggtagcaaccataagaaagcatatgataatatagatcctttaacaacaacctcttaatcggtgaaggatatctacatctgtatttttcatttgatacttacagtcattctttgggaattactataaaaaagtggtcttcttgttttgctgtttaggcaatcacagcatgtaaacaagacagaaattccatacattttctagtaccgtgtatgtgtgtgtttactgataatgtgtgggtagacaataaacacatattaacatatatacacaccttgaacattgtgattcacaatgagggtacccatctgtgtagtatttttatttttttcatttttatactccaagttcaggtgtacttgctccttagaatttcaacgcattttttctctgtgctaaagccgacctatgatagcctattttcccttgtatcttagaacattttgcttttatcttttactgtgtgaaatataaaattcatatggggaaggctcaagtgcttggtatctggaaagcttgaatccatctggaagctcctcaacactcatgggtaggttagggccattggggtcaagatccaaagagctcgtgagacttcttagaatgatcgtccttcagttgggacaatgattgcctaagtcatcaccttgttgtgagaacacctccactgtcaaggagaagtcagttgttccagtgatggaggtggggtactggtgctgaagtgcaagaggatcgtattacattgacagcagggaacagatggggccaatatcatgaccctaagatgcacagcccacccaatcttttgtctttctctaggttatacagagtgattactgagtattgctaacatgatgggacagtgctgttcagtagaactttctgctggatggagatgctctgtatctgtgctgcccagtgtggtagctacttgtcacacgtggctattgagcacttgaaacacagttggtgtgaatgaggacacgcattttaaatatggaattttaatttttattttaaataatcacctgtgactcctgactgctagacctaaggcgagtctacaaacattatgctacatttctgttatttagaagtcaaattacagtaacatccagggaattttccattaatactatgtgcactcttgagaacatatagggggatgataggaggaggaggtggtgatatatgaaataggaatggaagaaatggcagtttaagcctaagtaagacatggaattgcagtgccaacccatgtaaatggtggtgggttttcagagataaccagaaagtagtgtttcagggtatgactctccttgattttgtttttgcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtatgtgctttctttttattacatattttgaagcatcctctaatttctaaaaatataaattattgttatatcattataatcagaaaaggttgttgtatttttgttggcaaggttgtggagaaaggggaactctcatcctatactgttggtgggattgtaaattagttcagcccctttgtaaagcagcttggatacttctcaaagaactgaacagagacttactgttcaacccagcaatcccattactgggtatataaccaaaggaaaatcaattacatgagttcaggtgtttttttggtagaatgtttatcacagcacaattcataatagcaaagacatggaatccacctaggtgtccatcagtggtggactggattaaaaaaaacatggtacatacacaccatggaatagtgtgcagccataaaaaagaatgaaatcatgtctttagcagcaactggaagccattatcccaagcgaattaatgcaaaaacagaaaaccaaatgctgcatgtttttacttataagtaggagctaagcactgggtgcacatggacataaagatgggaatagtagacactagagaatacaaaaaggaggggagcaagggtggaaaaactaacttttgggtgctgtgctcactacctgggtgacgggattaatcatacctccaaacctcagaatcatgcagtttacccaggtaacaaacctgcacctgttcctcctgaatctgcaatttaaataaatgaataaataaataaataaatttttataacagtgcaagaaaaacctatgctatttgataaggagtgtcttaaggctttgtcaaattagtaaaaaatacaattcaaaatttgtttatgcctggcatgtattgttttaagaaaataaaagcagtcacttgtaggagggcaagaaatgctatgtacggggtttgcaaatatattttcttttctttctttttttttttttttttttttgagactgggactcgttccatcacccgggctggagtacagtgttgtgatcacaattcactccagcctcaaactcctgggctcaagtgattctcccacctcagcctcccaagtagctggaactatagacatatgccacctgtcgggctaattttttatattttttttgtagagacagggccttgctatgttgcccaggctggtctcaaacttctggtcgcaggtgatcctgccaccctagcctcccagagtgctagaattacaggcatgagccattgtgcccagctggatattttagtttctatattaagtaggccatatgtgacgcagaaaggcatagcacctgagtctaaaagaagacaccctctgcaaatgggtctcaggagtaaatgagatgagccctgtggagacgagccagtgaggggcaggtccctgcttctacccatgtaagcaacaggaagaaagtaccagatgtagatggagtccttgtcacagaggcactgccacaagacctgtcctgttattttgggggctctgtggagacctgcagtaactgctttgagttcctgtttaaagtaactgaagggcggaggcccatggacattcagaagtggtaccaaagcagttctgacgtcacgtcctgtctgcccttctgtgggggattcctgtgacacaagagcatcctaacttaggatcaaagtgggaaattagtgacaatgggcatttggagagctttttcttttttgtccacagcatcttttaaaaataacagtattgaaaatactcaattaatggccaactacgaggaggaataaagaggattgcaatattttgcttttctctttctttaattcctttggctcagacaggagccagctggaacatgcatctaagatcatttttcatgtttaattgaggtgcttggctagacatagggaagggaaagctagggctttccagggctgcttgtcttcaaaatgggcgtgaacagcatccagtaatccattctgcagctttggtgtttatgagttaagatccatcaaccccaatttctctctccctggactgatgaataaatgggctgtaaatttcttgcttaatttatctttgtaggcatatacctacaacaatttctaggatttaatgagtgacaagtaaatgtgttgtttttttttaatggaaatgaagacatagggaaagctctgtgagtacacgtgtaaattgttaagatctttttagagtatgtactttggcagtaagttttaaaattgttaaaaaatttagatatgcttaaatctagcagtccactattaggaatttatcctaaagaagtaatgaagagtgattgcaaataattaactactgggatattcatagcagcttatttatagtaaagaaaaatcagaaacagtatttttccaacaatagaggatttgttaatttatgctacctcaatacaaaaatttattttgcagccattaagaataatgttatggaagaaaatttaatgatacatttaaggttatgttgttaaatggattaaacaggtataaagcaatacattaaattctatttttaagtttaaaaaatctaataaagactgaaatatatcctgaaataaatacttaagaaagtggtatcttggcagggcacagcggctcaagcctgtaatcccagcactttgggaggccgaggtgggaggatcacctgggtccaggagtttaagaccagcctgggcaacatggcgaaatccagtgtctccaaaaaaaaaaaaaaacaacaaaattagcaggacatggtggcgtgtgcctgtagttgcagctactcaggaggctgaggctggaagatcgcttgagcctgggaggtcgaggcttcagtgagccgtggtcatgccactgcactccagcctgggtgacagagtgagaccttgcctcaagaaaaaaaataaaaataaggaaaaaagaaagcagaatctctctagctagtgggataacaggtaaattttttttttttggccatctgttatattctcagttttccccaacgtacatgtactgtttttatttataaaacaaaaagtaaaaatttgtttttcctccagaaggaaaatatctttttaataaacacatgctttttatataaatgtactggtgaccaatcagtagtttaaagcatatggcctctgggacaaaacttaggaaatgcgtttcatagggttaaaaagcaagtgggtggccgggcgcaatggctcgtgcctttagtcctagcactttgggaggctgaggcaggtaggcaggtggattgcttgaggtcacgagttcaggaccagcctggtcaacatggtgaaaccccatctttactaaaaatacaaaaattagctgggcatggtggtgcgtgcccgtagtcccagccacttgggaggctgaggcacaagaatcccttcaaccagggaggcggagtttgcagtgagctgacattgtgccactgcactccagcctgggagacagaacgagaccctgtctcaaaaaaggaaaaaaaaagaaaggcaatcagtagaactgggtttggccaagctaggcctccagaggtttttgtatggtggcctaggctgagaagctgaatgtgattaaaaaccttcttttggaggagcctttcccaaagtagggaagacagggatctggaatgttcccactgcccctctgggacctattctaggttcttcctcagtctccagttgtctgctggattgaggccagtggacagcactcctagttgatatcagaaggtatgtcctgctcatgttttccctgagtttcttctcttgggccttagcagtgtccacacaaaacctctagaatgggctttcttgagaccatcacagcctccagagccacagtgtgctggtttagcgtggccttggctgcagtcagacgtggaatttctgttttgccttttatgtccctacctcagtcagctgcattaaaggaatgatgcggtttatgaacagtcttggaagaccagactttaaaaaggaactgttaaactacattgagagtaagatggtcccatatatttcaggccattgtcattttcagtgaattcttacttatcttgagcacctttggataacatatttcaccttcccaattgtgaacttttctgctcctaacctttaagccctctcacttttcactgtcatcactcacactttactgagcagtaaatgatttgccaaattaagttagaagttttttctcatagctttttggttcatttttgaatgtattgcttcattgatatcttagtctgctgtgctgcagtaacaaaataccacaggactgtacggcttaaacaacagacaatatttctcacatttctagtttgagaagtccaagatcagggtgccagcatcgtccgattctggtgaaagttctcttcctggtttgcagatggtcatcttctttctgtgtcctcacacagttagggggaggtcagggaagcaagagctctcacgcctctcttcttatgaaggtctactcccatcatgagggctgtcccctcgtcaccccatcgcctccccaaggcccacctcctaataccaccatttttgggattagggtttcagcgtgaacttggggagtacacaaacattcagttcatagcactgatagattcattaggaatagcttcatactttgaatttaaagatggatttgtagagattctttaatacagtgttgctaagtttttatttttttgttgttgggaaaatttttattttaaaatggaaatggaaatatacaggaaaagcttgtgctttccttttttttctttgcataaacaataataatgcaatccaggtcaaagcacaaggcagaaacttgagaaaagaacagttattacaagtacatggtcttcttttcaaatatccatgaaaacgtttaacgactggatggctaggtacctacagaaagctccaaagcagtaatctggccttttagtttcaacaggactattttgaatcttagatttatcagtcactcctttcccattctacttgttctaagaattaagtatataatgaaaataaaaagcccacatcctgactttaaatctccactctcctaaaaacctgtttgaggaaacaaaaatggggaagaagaagatcagagcaaaaatattgttaacactggccgccctcatgcaggtgggctactaccaactcctgatgaacatctgtaaagagtatagatctactgaaaacccacttgtttgtttaattcctgagcacttccagcaagcatcggccttggaacttttaaagacagagttaaggtagcacttccttattatttcccctttatctgctgggcagtaaacaaattgaaatcattgccctaatagcaatataaactattaggtaaatggcacattgtagatgcggcaagagaaatgtcagcaggaaacttcccagacactgaactgcaggccttaaaatcgctatgtaagacctgaatgaggtttcccagttgggttaagaaggacaggccgtattcacagatacaaagtaaaaggaagacacctaccaaatccaattttcacccctggcctgaggtgtcagcctaattagagatggtcagaagaaaagcctggacaaaaaacaaaacaaacaaacaaacaaaaaaacaataagctctgaagttgagccaggggaggggcttccttgggctgcagatccagtccctagtccatggggccagcacacgtgtaccgaggagatgcctgttgtagtctgatgctctcagaaatacaagtcatgcaagagcccgtctgcttttgatatgatttcccatatagatttctttataaggagttctgtactggcctgaaaatgtgactctggtttttgactattatatttctgattccaaaatataaaaaatatattttccaagccaggcatggtggctcacgcctgtaatcccagcactttgggaggctgaggcaggcggatcatgaggtcaggagatcgagaccagcctggctaacacggtgaaaccccgtctctactaaaaaacacaaaaaattagcgggcgtggtggcgggcacctgtagtcccagctactcgggaggctgaggcaggagaatggcgtgaacctggcaggcagagcttgcagtgagccgagattgcgccactgcactccagcctagggggcagagcaagactccgtctcaggaaaaatatatatatatatatattttttaatattttttttccagtattatgtgtgcatggatacatgtgtgtaacattttcttatgtgaacatggtgcataaaactcaatatccaagtgatgcattctcaggctgtttctaggcctgaaagctgaagacaagataataggatatgggcatctaaaggaggtgacacctttgagaagccctctctcaaggtacaggaagtcagcttcctctagacaccacctctacaattattacgtaggctgcaggatatattctagaattctaaaatattaatataagtttcatgtatacttgaaatatttatgtgttaaaatacttcatgcagtactttatttctataagcaaatttcacactagtaagtagttttgatatgagtgaaaattgattaatgaattcttttaaaggaatttcatattataaattgtttgcacatgggcagcatcagaggacagtaaaagaacatacactttgtgttacaaagaatgggatttgaatatcagccctgcttacttagaagcttgggcaactgatttaaactttatgagcctcactttcctaattacagcggggtggggggtagtgattaggggtaattaggggttggagatgaaaggaaaagcacattggggatatgctagcctcttaagaagcggtggcagtttgttgagccactgttaagatttgtggaagatggtaaaaagagggaaccagttaatagttgatgctttctccctgctaaggcgcttcctaaatgtgtttagtggaatgtcaaaaggtgttaaatgaaaaagggttccaggaacaaatccttttgtggaacactgcatgagacaaagtgaaccaagttcccttctgtcagaacattccagacctgctgtcatacagcactgcaaggtgaggttctgtgagggtccgtgcagttctcccttccctggacttgtttgactgcatctcaaggaccaggtgcccttgggttgtattcagggaccgctgtgttgggctcttcagttggctatttcccatgaccttctgtgccttcttccagaacgtccatttctcacttcgctttggctacaaaatactgagttaattttcatcttgatcagcatctgaactctgcaattgttggactaggcaaagttttcaggcaatctagacacaagtgtcctgtgtacttttgataaccataataggtcttttggggcatctcttactttcacagttttttcctctagctttaatattgacattgttagacatttatagaattttgaaaagtttcttagcagagtaaagtgttcttgccacagtagtcattttgtgtagtttttactatttatggtagaatagtatgctacaggtacacatcacaatggtaacctgcatggaatacagctaatcgcaggttaattactgttccttaaaacataaattgccaagtatttagtgattaacacatatttaattccttaattaatgtttttcctaattgcttctgtgttgacctgccctcctatggttgggaagcagtggggaagggcaggtacctgccatcctcagggcacctgcctcctttgatttagacattgattttttgccatttgaagaataatattttcctcatgtactcgcccttttgctttattgtgctgataaaaaaaaagaactctgctttgattctgcacccccgcctcctgtttcccacccctacaccctgaggcaaaggagctagccacagatttcgtcatattctaatcatgcatgcaccccagaagcctcagctcctacccagaatttcagccttcctctctgctttcagaagacagtgattttgagcccagtcagaggccagggaggcagtgatctttgatataaatggttgctttaaaaagagaaacaatgcataggtagctgaaaatctccttcccccatgggtctccataaagaagtggggctggggagggtgggcatggactatagggaatgggaggataaagttatcaaatatgagagccttgtgggttcacgagagcctccttgttaaaacaaatgccttagatatactgaagggtcctgggagaagattaggtgtggattcagcttgcgccctgcttggagttctttgtgcagcaaggactcaaaggaacttgtactggggagaggggcactaaaccaagattcacccttatcagtctgacatctttcctggtaaaagaggagttgagggaatagggatgacttgatcttacctatcttttcacattttgctgcaaactttattcccctgcacagctagctcggtgcctgtttctttgctgtatttgccttcagcccactgattttactacaaagccatgtaaagccacagctaagtgacagcaggcccgcatacatttgctgcctagagacagtgttttagagttgaattggtgagtcttttctagattgtgttccacaaatccagggaatgttaggaggcattaattgaccaaatggaaagaagcactgggttaaacaaagtagaactgcttcgttctgcaggccatttcggaggctaggagtgtttttgaatctccgggaaggacacatggtgagtgtgggtgcccagctggagccagaatttgggctttgctgagtatttcttgagtctagtgttccctgaagtacacttgggaatactgatatgtgccagttgaaaaatagaacatactttgactccataaattccttggctatggcccttattccaagtgcaagacaattgaattgcttcatgcctctagaggatgtggggaatttgctgtggcagtgaaatatcactctctctcaagcaggaaagctagtctagtaggtgccgcaatactctgcattttgtgcttaaaaaagacaatatgtctcaagaagccactggggacacagtaggttgtcagtttaatattgacttagaactgtatttaggaagtagaacaatttgcgtgattgttttcaccctcaaagatcttatttttgattattttttaaaacttgccacatctctaaatttcattcttaacttgtacttcttatgtgatgataaaggataagtacttctattgtttaccatcttaatctctgcgtggtctgccgctatatgcatatcaaccctgttctttatgacttctaagccatgtttttgtcctctaccttaatttctgtgcacggcctcttgaatgagtatatgacctatgattatatcatacttttctctaaagggaaggaggaaacaaagagaaaagtgaggaaggttgtgttattggtaggaaaaacaggtgaagacatttaaaaataacattgcaagcactaataattagctccattgcaaattttgctgtcttttgagtgcctttagctttctcaaagtagatttttattttattttctgataacatgtcaatacaaacacaaatgcttgaatattttgctcctgattcttaatgtgacatgttttgtggttttgcctggactctttaatattaaagaaactttactgtatatgttttatttttatgtaactcatttgacacaaacaagataaagtttttgtaaatgggtgtgacccacctttgcattttatttaaatcaaaaccagaaggatagactaggtaatgtgtgggagaaccaacgtttaatcccctttgttctagggaactgactaatgacttccaccagcacattttccttggtgagtatctgtgttggtaagcaaatccctttctttgcttacacatagcaaggaaaagtggcagcatggaaagctaattttgctcttcactgaagcggggaggatcagggaggctgtggtgttaaactgcttctgcatttctcctgtttggcagacatctgaaggatagcctgatgtcaaacctctcagaggccagtatccaggatggattttcatgagcaaatgagagcaatagtcagtttaaacaactggtttaaccagttgtttcctctctgaaagcaaatggcttttcccacagtctccaaaggctatagggatacaacatcttgtctcctgaaatgctattagttgagattgaatgaatattgattctctctattctacattttcttacatcccagggctgcaaatatctgggcgttatcagcaaaacagtgaaatggagactcagagtgaaccacatcacatgaatagagttgattctcgattatttgcagcagttatgttctgtaaaattacagagaacactgaattagtgaatactgaactacttctataggaaatatggggttaggttcctgtgagcctttggtcacaatgtttttgtaatgtttttgtctactgatcaataccggatgccgtatgtaatttatgttgttgattcattaactttgaacctatggcaaaggccagtaccactgtaactcatgctgactggagcgcttctaacatgtgtattttttccttaaggctcatcttagcgtccttgcactctcaggagcactagacagccctgaagcactatatttgggttcattttaaaaagcaacgttaccaaaaagaagcacaaaaatggaaaagcatggcactaactagaccacgataaggatactcttttatagtatcagagctgaaacaaggcgacagaacattgccctgcctgacttcagctaggaacatgtgtgttgagcaactcacattttttgctgctctgtgcatgtccgcagataccatgaaagctttgcaagtattgatttttgggggttacaaataaattttagggagtagcaaattcacaaatatgagccttgaataatgaggattgactgtattttctgtcaagccaagtcaaaaaaactaagttctgtgttgtgacaaaattatttcataataagataaggtgactctgtgattctgtcagacccacaacttttaaaataatcacaatttagattgggctaaagggcaaaaacatttttcctaaaaatgtttgtttcagtaaaaacaacaaacaaaaaccatttagtccaaatttagctaacaccaaagaagatggtataaaatgagatcttagggtaggttttaatattaaagtgttactaattctcagtagtttacagtgtctttatagaagatttttgacttctaaatgagttaggttttattttattttatttttaatttttctgatattttgaggcctatgaagtaattaatttttctggctttgttttggtatattgcaaatatgtattttaaaaatttgataatgatattacaaacttaagtgggtatttagaaaaccacacatgtgatataattgaaaacaagtcaagccagggacagggtcttcttctcattgctagaatgtgaggctcccccatggagcgcaaggcatattgtatttggctgtgataaagtattgcttttgacatgtgctttcttgttaatcagagtattgatggtgcattggtgagccaagcaggaaagttttctctaaaaacaggaggctagatagtaaatatttcaggctttacagtccaaacgctgtctgtggcagctactcaactctgctgctgttgtatgaaagcagccatagccaagatgtaaatgaataaacgtggctttgttccaataaaactttattcatggacattgaaatctgaatttcatataattctcttgtatcacaaaatattcttctttctgttttctcccaccagtgaaaactataaaaaccatctttagcttgtgagcgatataaaaacaggtggtgggacagatttggccgtgggctgtagtttgccaactcttgtattaaacttgatgctgtcaaaactatgccgtatcagtcttcccaattgctatatttcttataaatctggatgtaaaaattttagaacctgtgtatctatacattaaaaggtgtgtgtgtgtgtgtgtatatatatgtatgtaaaggtattctatatacatatagtgtctcatacttgctagttaggcagtttggcaacatgaaaagagtccagacttggaagcaaaatagatctaggattagacccaaatctgtaactacttgtgtgaactcagaaaaattacttaacctttctaagtcatcttatccctgaaagggagctaatatgacctacctcacataattgatgggggaaaattagataatatatgcaaaggatacctgggacatggaagtatacaaataaatagttttttttgaattactaaattattctttttgaagaaaaacttggtacatggctccataagaaattcaaaccttctaatatagaatattttcaatatattttgttccgtttcataaaaatgaacatggcacatccccagatcaatttcttacacgtttcttttttccttttccaatggtactgttggtattctcatgttactctttcctctgacctcaatctttttcgacccggatgctggcattttcaaacattcctatgattcccactgggttctgcacacacttggtatacttcactagagcaatacctgtacttttcattagagtagttccttatttgacaaaaagagaaaaaagattatttttgcttttgaagccttataagggcactggctagagaggtgtacataatggaaaatttgccagatagccagagttcacaacagtggaaccttgaacagaattccaaaatctgtttataagaaacttgtttaagatgaccctcatcctttgagctgcatgttttttttttcttttttgataacggagtcttactctgtcgccaggctgcagtgcagtggcacaatcttggctcactgcaacctctgcctcccgagttcaagtgattctcttgcctcaggctcccgagtagctgggactacaggcgcccgccaacacgcccggctaatttttgtatttttagtagagacgggtttcaccatgttggccaggatgggctcgatcccttgaccttgtgatccactcaccttggcctcccaaagtgctgggattacaggcatgaaccactgtgcctggcctgagctgcatgttttaatcctcttgtttgttagaaaaaaaacaaagggaaatctctcaatggttgggtgtttaaaataggtaatctcagactactgtatggcatctaaattcagataacttcatttagtcgtatttatttcacaataggaaactctccagtacagctcatacctactttataattgtggtatgtattgaaacagttgcatactaagttgtaaacttgatgaagcagctaataaaacttgtactcaagtcccttaacaagtttctaagaaagaactagaaaatggttttaataaacatagaagttgttgcttcaaacttgtgacacaaatgtatgacataagaaacttttgtttatatattatgtattaattttgtatgtatgtatgggtaggcatgcacacataaacgtatcaacaaagattgcttttctcctatcttgactctgcaattagctttaagtcagtgttggaacctgtcaagtttgagaagtttactttttaaagtttctaattaaactcagagggggcaggaaacatatttgtaatcagctgctgtccttctttgcctcttgatattctagttggaagactgaggggagcaaataaaattgcagatagaagcttgtctctaattcttttttgtggccttgctgacaagtcatcttgctgggaaatatggggcgaattggcttgtttctgagactctctttgcctctagtccacagggatgaaggcagatagttgctgggaaatccatgagttgatactagcaggctgaagctctgtgctgggggttgtgtggctgtggcacaggttccctggcttgtttggaggggaggagtcatggttctgcgtcaggaaaggatcccattgctatgagctgtgtttattgaatctgtcatttggccattgctatcttgttctattctttcatcattcatgtttcttgttttttccctaactaaagcttactttttataaaactgtctgcattgcttagatcttccaaagcatgcggtagatattttataaatatttggactaaaaggctcagaatttcttagcgtaaaacttctgagtcatccattctgtgacgcgatggatgaaaaaacagatctagagaagtctagatggctcttccaggtctcagatcttctctgcctttttttttttttttttgtactctcctttgctttggtaagggtatgaccctgtatagctttaaacaaaacattatggattaaatttacacatacagatcaacttaaaagtagattcacacgagcacgtctcacatgtacactatgttctaaaaggtaatgcattctcttcaaagaataaggataattccatttttagtagaagcttcagacattgtagttgataaagcaaaataaaatttcaatatgaaagatagttttgatgaggaaagatttcttcagctgttctatccatgatatattccaagtgcttatcacagtgcctggcagagaggtggcactcagtagagccttgagttcattgaatgaatgaatgcatggatgaataagagagaagaaggaagagaggatggcaggtgggatgaaggaaggtctgatgaacatttctgcgtttggttttcaaaacacatttttctaaccacagcacccatgctcttgggtagctggtagtggtagcatcagcagccacccctcagctgtccctgcagtagccattgtatcagagcagcttgcaggttcctgcagtgccaactgtagctgtttcctgggaggcaggatgtgactgttattgaggggacctgttttgagggcctcaggaatgctttttcctttacttgctctcaatattcattttccttttgtactctcagttgtcttcttatagactttagtagtagacagataaattagcagggtcccattgcaggaatatccgtgcatatcttcctttctcttgtattgtcagtggaaactatttattaaacttacgaacaggatgaagttttatttcatttctggttttctgttgtgcctttcctctccgctgtgttatatgttattgtaatagtgttgtggcacagtgtcatctagtctagcaagagtttctgggatgtcttctgtccctgtactcttgagcttttccactctgggctctgctgattgctttctccagtttcacatccatcccatacacaaaataatgcaggcctaggatcaaagtttttgtttgagcaatgtgtagaagtgaaaacatcatatttggaatcagaaaaattgagtttaaagattgcatctacgatagactcgttgcatttatggacaattactttgtatctaaagatttcattttttttgaaacatgaaattcttgatttttcgtatgaactaatgagataatggaatgatatcttcctagtgtgtgtaacatatctgcttactaaatgttaacttataattacttttataaattgaaatttttatggaaatcattgtagagtcacatgcagtagtaagaaaaaagatattcttgagtacatgttatgccatttcccagaatgctaacattttacaacactgtagtacaattgccttctgtacaattgtacaaatatgtacaatttgttgtgtacaactttgttacctgaataggcttgtgtatcttccaccacagtgacgatgctaaacaattccaccaacacaaggagtggtggtgatgtccttttgtaagcaaacccatctccctcctgtctcatcttcctccattcctacccctggcaaccactaatttgtcctccatttctagaatcttaacattacaaaatgttacataaatggaatcatagagtacatgatcttcggggagtggtgtttttcactcaccatagctatcgggaagttcacccaagttgttaggtacatcattaatttgctcctttttattgctgagtagtatttaatacagtggatggaccacagtgtattatttacaagttgaaggacatctgggctgtttctgttgtttggctattatgtataaagcttctgtaaatatgatgtgcacagatttttatatgaatgaaagtttacatttctgtgggatgaatctccaagagtgcaatggttaggttgtattttaagacttaccatcatgagtcatggttccccggtgagatagtttcattctgtgtgtaaatggaggtcaaaataacattcatgtggatcttttaaatgatagcctgacaactgacacttttagtcaattaatcagattaagaaaattgataacccttttactggttctttctttctttccttttttttatttttttttattttgttgagactgagttttgctcttgttgcccaggctggagtgcaatggcacaatctcggctcactgcaacctccgcctcccagattcaagcgattctcctgtgtcagcctcctgagtagctgggattacaggcgtatgccaccacgtccacctaatttttgtatttttagtagagttggggtttcaccatattggccagctagtctcaaactcccgacctcaggtgatctgcctgcctcggcctcccaaagtgctgggtttataggcctgagccaccgcgcccagccctggttctttcttttttgccttaatttctctgaagtggctccaccatcttaaaaaactccgccattcttagaacctccaggcatgtaggccttttcctcttctcttgcttctccaattatcaaggaagagctaacgccctcttgattttgccactgtggacatttttatattattttcctcttgattcatagctttattgtctgattttcagttagcatattctcttcactgcattattaataggctatctttcctggtgtctctgtcctgaagtggagtcttctgcagcctggccacagctgacctttgtggcggtaggtcccaattctccccttgaaggccatggtcatgaccacctcagggccttcacatgtgcccaggactgagcctggtcctcttcacactgttagctccttctcatcctgtagctattggcacagatttcacctcctcatgggaggtcctccatgtgtatattcttatagtacactgcactcttctttcattacacttactgtattttttttcacttgtgtaaatcttactaccccacatggtccagtgtggtcagagagttactttcagaaccttcagaaaaggtttagatcacctaaagcaatctgaatcttaacgttgtctcttgagggaaaacaaccacaatccaaatgtgtgtatggcagtgggtttaacatacagtgcaaccttaaaagtcttctttagactttgtttcatgttcaggatctctcacaagctcaaccctggctttgggtggggaatcctttctatctgctgaaactgttggagaggtaaccccaaagcctcttctatcttggtgtccccatcttccacccaagcagcttacccaccaacaagttgccgtctgtgccaactcactatcctgtgagcttccttgcttttcctacagtgtatgtgtcatcccccgcaaccccatgaagtatcctttcactatgggttttctaagttggggttctgtctaacgcattcactacctattgacctccctgaagactggggtggggtcttgcctatctttgtagtctagaacctggaacattgactagcagatgttacgtacatgaatgaatgaattggtgaaagaataaacgaaattatgtgtcttatatataggagatacttggtaaaagtaagacaaaatgaataaataatgtaaatctttcttaattttccaggtgatttttgaagtgataacttctggacatcaaggctatctcgctatcgatgaggtgaaggtgttaggacatccatgtagtaagttgtctttatttgtaaatattcgggtacatcattgggggcatgtttacattatgaatgaagagaagggatgaaaacctgtgaagaggtcatcttgccaagacagttccctgacaggcctgtattgttggtttgccagcccagaaatccaaaagcatgtactttgtgtaaatgccatggtttgtataagtcttttaaaatttggttcaggaatggggaatcaaggaattctttggcatgctcagacatctttgcaaagaacctgtttatttgttgccgtggtctttagaattcgcttttcagtagtagcacaaagttaaatattgagaatctgtgcgttttgtttataagtccagtatgtttttggcacagttccttagtatttatcacatggtttcaggtgatatagctgcaaacaggcctgggatctgtcaaataaaagacacctacctaaaccacctggggaccccagaaatggcctgctcttcatcttttaaaaattaatactttaaaaaagtacaataggtgataaacatacaatttttaaaatttctactatgaacaactaacagtttgtcatatttgtatgtgaacctttttccttaaataaaatagtacaaattgctagatctgtttctccccaaaccctgccccccaggggccaccacagtggtgagctggttgttgcacctgttatggtttctagtctgcacacagcaacagactgtagctgcttgaagcagaaaaggcatcctgttgatagagaattggagggcagtggtattcctgagaacactagtggtctagactcagatgatgagcaggcccccaaagtgaggctacgcaagcagccacagcaaccactatggcaggggagccagctgcgaggacaaggggagctggcgctgtgtctctgtgcaccttacccttggaagatgacccttgcctagacattctgcgctgatttgggccttggcatctttggccttaggtgcaaagccctgagggggatagtcagggtgagcgagctagatcatgcactcattcatgcctggcaattggtgtcactaggaaagtgagttgttggcttttcccactctgtcaagggagctgggcctcaacttttactgagaaacatatagtgctgagcaactgaacaccgcaaatgtgtgtgtgtgtgtgtgtatgcgcatgtgtgtgctctttcccataatccccaagggtttataaaagcaaaaaagtaaggattgccttttataaatgctaatgaatggtttccagccatacaaatttctctgtattctttttttttttttaacttaagtgttagatattttaggtcaatccatggtattctatcatatggatttactacattctatttttctagtattttatgaacatttagtgtttcccacagtttttctctattaaatattgctgcagtgagcattatggatgtgcctactggtgcagtgttgagagcctcagtggagtgtgttcttagaggctgaattgctgggatgtagtgcagagacgttcttagttttattgggtgctgccaaaatgctatgaagtgtctgaaccagtttatattcccaccagcagtgcatggtagctttattttccctgtatctttgttcaaaattgatatcaccagacttcaaatttttggccatctgagggatgataacctgctttatttttaggatctctggcattaaagagaaactggctagttcatatatttcatgggtctttcctgatgaccctatgcaaaattatgaaagaatgattatatctacaataataaaaatggaaatatttgcaggagtggctcagctttttattgcatggatttgaatagaccaccaggaccctctttgttaagctttatagagaagacctgtgtggttgttacctgatgaatgtatcatgacacaggtgttttaattccatctaaaggggttttgctctctctgatatctttatttggtgctttgaagcttgccaaacattgaagttaacataaagcaatcatttgttcattacaaaggcagatgttacttttgtgtcatgttacatttgtcttttcttctgttgtcagcaaaactggggagttcaagaagattccctgtcccctcccatttcatgaaaagactggaaaaccatcaaggctgtacctaattgaaacagcagggtaaatttaggaagcagaatgcaattacctgagctggaactcagccaaatcctcagagtaatagcctccagctagaaaagtgccatgagatcttctaatatgcacaaagttcatggactctgattcacttcttactaggaggttaaaaacataagagctgtaattgcatgcctactaagtgctgagcactctaatgacatagtctgcctccctgtttcttagagcagagctcacggcaaggcagatgtactgggtgcaggtgtggtggctgcagtcaaggttgcacatggctttctattacatatcctgggctccatcttccacatctggccactagccagcataagagctcctgaagtgtagtgccttctattttactggattttagtcattgtgtgcagcaaagacctaaagacttcatgcttatcagtgccttcctaaaacatgtctcaagcaattttgttcttcccataggagagagctttctgtagccatagaaatggtgtttatcttctctcctttggagaatacctgtgctaatacctaattggctttgggaactgctgtgagggcacagaattgcaaaacaggctctgtaccaaggtgatgtatggtacaacagcattgtgaactggaagccttaaatggttttgatgatagctcttccttagcttattttttcctgaatctctaagttaatgggggaagcatgcaaataaagattttaaagaaggcaatagtttgttcttaaaatgaaagctttacaggtaatattttatgagctttcttatcaggatttcataataatgaattattttgaaattttgatgttcattaaatttaaatcctaaaggagcattaatattttatatctaaaactatgctttccaaatggctgcaaaattgctgaatctcatttgctccactgtaaaggctcttgtttggattcatataggtttatgagtaagcattacaacattttttaatattagatattctgatacaagtatatagttgctcataaaattgactttagtgacaataagatgcaagatcagcctgaaatatggagatgactttgcaaaatcagcagctctctagcatatgaccacttctaataaacagataatttttgcatttgatatgcacactaaaaatatatttggaatttggttcaataatcctggtaagaaaagaagcattttattacaatagcttcctaatgttgcctcctgttcttaaatacattatgagctgtgcatatatgggtatttctcttattaccttctggtgctgataatgtatttttatgtcttaaaagccgtatgtaattttaatagatttattgacatatcactgacataatttatccatgtttaaagtgtacaattcagtagtttttagtttattcacagagtatgtacccgcgaccatagtcaaatttaaaatatcttcaacatcccccaaaagacccactacccattaatagtcattctttattttctcttgttactggtggagggtgtccaggttcttggtgtcttgaacaaagaattggacaaaacgcacaaacaaagcaaggaaagaatgaagcaacaaaagcagagatttattgaaaatgaaaaatacactccacagggtgggagctgcccgagcaagtggctcaagatccccatgactgaattttctggggtttaaaataccctctagaggtttcccattggttacttggtgtacaccctgtgtaagtgaagtagtggccgatggtcagtctgattggtcgtgggaggggaccattcagaggctgaagtgaagatacaaagttacaccctctgcaaacatctgattggttgcagaaagtgaccaatcagagactgaagtgaagttacaaagttatactcctataaaatgaaaacttagcccaagaccagcctgactggttgcaggaggggaccagtcagaggtactttcaatttttcatctgccacccagaaaaagttgggggaggcagtgtgcaaaggaagtagtctctggtccttttgtcacttgggtgtggaaagttgggattttccttttgatttagttctaggaagtcagcatgattcggcctcaggttccttgcctctagaccctattctcccgacttactctggccaccactcctagccctaggcaaccattaatttacttgttgttcctgtagatttgcttgttctccatattcatttaaatgcagttgcgctatatgtggccctttgtgtctggcttccttcacttagcgtgtttcaaagttcatccatgttatagtgtatatcaatatttcactccttcttaaaaccaaatagtattttattccatggatataccacattttatgtaagcatgcatcagttgatggacattcaggttgtttcacctttgggctattgggaataatgctgctgtgaacatttgttatcagttctcttgggtatcatgctctcagacatatacttaggagcagaattgctgggtagcatttgaagaactgtgaaattgttttttaaattggctgcaccattttccatttcaaacagcagtgtatgatttcaatttcttcatattcttgcaaatatttatgtctttaaaaaaatcatagccatccttgtgggtttcaggtggcacctgtttgtagtttggattacctaatgactaatgatgttgagcatctttccatgtgccatttatatgtatgtttgggagaaatgtctattcagatcctttccccatttttaattgagttgtttatctttttattattcagttataagaggttttatatatctacatacaaattccttatcagacatatgattcaaaaacatttacccccaatctgtgagttgttttctcattttcttgatggcatccttaacagcacaaagatttaaattttgataaagtccaattttctgttttttctttcatcacttagatacaaaactatttggagttgtagctaataattcttctaagatcacaaagcttttctgtgttttttccagagttttatggtttcaattttttttttttttttttttttttgagatggagtctctctttctcacccaggctggagtgcagtgctgtgatctcggctcactgcaacctccgcctcccacgtttaagtgattctcctgcctcagcctcctgagtagctgtgattacaggtgtctgccaccaagcccagctaattttgtatttttagtagagacgcggtttcaccaatttggccaggctggtctccaactcttgacctcaggtgttctgcctgcctcagcctcccaaagtgctgggattacaggcataagccactgtgcccgtcctatagtttcaattcttacttacaggtctatgagctatttgagttaatatttgtgtatgctgtaagaaagtggtgaaaattcattcttttgcatatggatatgcagttattccagcaccacttgttgacacactgttctttccccattaaattgccttggtacccttgttgaaaattaattaataaatataaagacatttctggaccctcagttctattcagttgatctacatgactattctgctacaagtatgatactattttgattactgtaactttttagtaaattttgaaatttggatcagtgggtcttccaagtttgttcttttctcattattgttttggctattctgaatcctttgtactttcttttctttttgagacagagtctcactctgttgcccaggctggagtgcagtggcactatctcggctcactgcaagctccgcctaccgggttcatgccattctcctgcctcagcctctcgagtagttgggactacaggcacccgccaccacgcccggctaattttttttttttttgtatttttagtagagatggcgtttcacagtgttagccaggatggtctcgatctcgtgacctcgtgatccgcccgcctcagcctcccaaagtgctgggattacaggcatgagccactgcgcccagccaatcccttgtactttcaaatgaatttgagaatcagcttatcaatttcagccaaaaaaattcagctgggatattgatagggattgtgttgaatctgtagactggtttgggtgaggggttattgctatcttaacattatcaggctttgtgatctgtgaatgtgggatgtctttccttttattgaagtcttttaaaatttcctttaatagtgtttgtggttttcagagtacaagttctgttcttcatttgttaaatttattcctaagtattttattttgaagttgttttaagtagaattgttttcttaattttatttttcgattgttcatttctcgcttgtagaaatgcagttgattttgtttattgatcttgtatcccgagatcttgatgaacttgcttattagctctaattggttttttggtggatccataggattttctgtatgcaaaattgtgtcatcttcaagtaggttttccagattcctctttttccaacccaggtgaattttattatttttcttgctagtttgccatggctaaaacctccagtacaatgttgaatagaagcaaaaagaacagaactgcttgtcttgttcctcatcttaggaggaaagctttcagtcttttagcatgatgttggctgtggtgttttgtaaatgcttgtttttaggaagaaagttcctttttcttcctagtttgttggatgtttttatcaagaaatgctgttgggttttagcaaatcctttttctctatcagattattatgtggtttccatcctatattctggcatattatattgattgattttgggatgttaaaacaacctagcagtcctggaacacatctcacttaggcatggtgtataatcttttttaatatgttggcatgtagtaatgaaacattatacgaagttactgggatatatgatgccttcaattctgaaatcttaaaattatacagaatcatgccccattattttgatgccaatttaaaaacaaaataatacagtaaaaaagagataaagcccttctaaacccatgtgctgtatattggataaattgaatacaaaatccaagactgtcctgtattattacttgggcaatagaaaataagtcagcaatttctttaaatattaaagtttataatatggcctcctaaattcaaaattattcttattttttaaaatagtattttccttattaatttgtgtagtcacacattgcttaccactcccaaatttagattttttaatgaagatttattaaatagtgtgattgaaataagaataacagtgacaaagcacaaattagaattgttttcggaattatgttctgctgaataaagacagattcatgtgctttggttgagagatgtgtgggactcagaattgacctttcattttaaacatgtgggaacacaatttggacttttctctaaaggaatatcattcttcttaagatagagtcgacttctaaaagttatttatatgtagtggctaccttagttttctctgataagaatgttgaatctgtttttccacttgaaaaattatttcattaaagcctattcttacctttcaaggaaaacaaaactgactttgacctgaaacatgttaagagaaattttctgcttctatcacaggaattacttggctttttttggacctataatctcatttgtataagaagaaaataataatgtttttctcactgagtaaatatagggattacattagttaatgtacatatagaatttatcacaatgcttaccacattctaagaatttaattaatgttaactattattattattaggcactacattgtgatagacttgctagaattagttagctgctaatggtaaacctctaaatagctaaaatgattgatatgctagatggggaagtttaattgtatgtccatcgttaaattccaaaaatgtttgcaaaatatattggttctcagcgttagagtaagcagtaccaggctgttctttttggcagcaatttgcttccttgtttgtgatgatatgttacacaaatagagagaaatattaactatttttattctggtggttgggcatgcatcccgtacatttcaacctatgccattacattaaaatgtaagttaaagcaaaagggggttaggacatagtcctcttgttccacttcagtttgcactttgatctcacaaattactcttctctgattttgttgctagtatttgtatgcagactctgaagaatcaataataatgaaacatctacaaaacgatttgtatcttggtcaatgataattcttggctttgggatcaaaggcttatttgagatcaattaatacacgaaaacctctattctttcttagtaagaagaaacagaatatggaagcgatgagaggataggagggttgtactaagaacatgtttgttattcatggaagatatttagtttttaaatctcctacaggttttagaagaaagctggcatagcattttgaaagggtatccaggagacaagtgggcctgtaaatttggagagagagagagaatgtttctttttgaatatgagatagattgaaatttctgttctaaaggtggtatacacctgatgttacaattaaagtagtatggcaagattcagagcatacagctcagcatgggatctacacttttctggccatagagctctttttcttgggctcttttccaggttccagtgatagatcagttattttaaatagtaaggaacatttttgtgggctaagtatgaggcacagagaacaccttggcttcatcaacttgtttattctttatatcaacactgcgaaataggtacttttaaaaaatctctattttacaaataaaaaaattttgtgaagatttaggtttaagaatttttgcatatattcggagataataaaggactgaaggaagtactgatgcttgaacacaaatgtgctgaaatccaaatcttaaaatagtatcagcctaagctgcttgccacctgaaaatggttgtaggatttatagcactaaacaaggggaatctaggcatcttaaaagcttggaagattatataagcctttaatatttactgaaaaaatttacaccattagcagaaagtttgactttcatgttcttggagaaatctgatctcacagtcattttgttaagtgaaataacttagaaacagaaaaacaaaaactacacgttttcacttacaagtgggagctaaacagtgtgtatatatggacataaaagaataatagacattggagaccctgaaaggtgggacggggaaagaggtgagtgatgagaaattacctatggtgaataatgtacacaattcaggtgatgggtacactaaaaatccagacttcattgctatgcagtatatccaaggaacaaaactgcacttggatcccttaaatccattaagatacaaaactttaaaagaaagtgatattccaaaactgggcgtaccatagatgaacacacctttagcagaaccagcgacaattctcatattcacattatttttttaactcttataacgtttgctgatagagtgtatgcattttataactttctcaagaaagattatagaagttagtacttattgtattttttagaataaacagcagaaatatacttcttacagttctggagcctggaagtctgagatcagggtgccaacacggtcaggttatggtgaggaccctcttctgggttgcagacttccatcttttttgttgtgtcctcacatggcagacagagggggaaagagctgagtccttttcttttttaaaaaaaatgttattttattttaaataataaaaacaaaaaataaatcgacacataattgtacatacctatgaggtatagagtgatattttgaaacatgtatacaatgtataatgatcaagtcaggattaattagcttatcacctcaaacatttatcatttttttgtgctgggaacattccatatcctctcttctattaataggtatttgcaaatataccagaaattattgttaattatagtcaccctacagtactgtaaaacactgtaactttattaatacttatatctaactgtaattttgttttcattagccaacatgttgtccctctacgccctacctttcctatcccttagtaaccactcttgacttctgagatcaactttatgatctctcttacatgagtgagaatgtggtatttgtccttctgtgcctggcttttatcacttaacatcatgtatgtactctaggcacatccatgctgcagcaaatgacaaggtacttttgaaaaggtggtgaaaaagctccttcataccctgatggtaaaaatgtgaattgttataagcttttatggaaagcagtttgacaatttatgtcaaatgtcttttaaaatgtgtgttttaaaaattatctttggccaggtgcggtggctcacgcctgtaatcccagcactttgggaggccaaggcaggcggatcacgaggtcaggagatcgtgaccatcctggctaacatagtgaaaccccatctctactaaaaatacaaaaaacaattagccaggcgtggtggcaggcgcctgtagtcccagctactcaggaggctgaggcaggagaatggcgtgaacctgggaggcggaggttgcagtgagcccagctcgcgccactgtactccagcctgggcgacagagtgagactctgtctaaaaaaatatatacttttttattgatacataatataagtgcatatttgggggtacatgtgataatttaatacatgtatacaatttgtaaaaatggaagcagtgtaactgggatatccatcaccttaactattgtctttatgctagaaaaatttgaattgttactatcttctagatattttgaaatatacagtagattttgcaaactgtggtcaccctgttgatcttcaagcactaagttttatttctaataagtgtatatttgtacccattaatcaactgctcttaattctgcacccccactccccctatccatcccagcctttggtaaccattaatctactctctatcttcatgagatccactattttagctccaacataagagtgagaatatgttctatttgtttttctgtgcttggcttatttcacttaacataaggccttccagtaccatccttgttgctgcaaatgacaggatttcatgcttttttgtggctgaataatattccataatgtaatatgagatattgtgttcttgtgtgtttgtgtgtgtgtgtgtgtgtgtgtgtgtatgtgtattacattttctttatttacttatttattgatggacacttaggatgactccatattttggcaattatgaatagtgctgcaataaacataggagtgcagatatctttttgatatattgatttcctttcttttggatatataccaagtagtggaattgctggatcttatggtagttctatgtttagtttttgagaaacctcaatgcagtttttcataggggctgtactaatttatattcccaccaacactgtacaagggttcccctttctccacatgctcaccagtatccgttactccctgtcattttgataaaagccatcataagtggagtaatgtgatagctcatttttgttttgacttgcatttctctgatgattagtgaggttgaacattttttttcctgtacctgttggcaattttcatgtcttatgagaaaattaattagaggctcttacttaacaacagaatgggtcaagcagaggaaagaatcagtgaatctgaagacagctacttgaatgtccagttttaaattggactatttgtatttttgcttgagttatttgagcttcttgtatattctgatgattagtcctctgtcaaatggatagtttgcaagtattttctcccattccatgggctcccttcactttgttgattgtttcctttgctgtgtagaagctttttagcttaatgtagtcccatttgtctgtttttgttttggttgctcttgaggtcttacacaaaaattctttgcccagaccaatgttctggaatgtttcaccagtgttttcttttagtagtttcatagcttcaggtcctagatttaaatctttgggtctattttgatttgacttctgtagatgtcgaaacagaggaggctagtttcctttttctgcatattgttctcctgttttcccagcagcagttattgaagagactgtcctttcttcgttgtatactcttagcacctttgtcaaagacaagttggctacaaatgcgtagatttattactgggttctctgttctgttgcattgatctatgtgtctgtttttatgctggtaccatgctgttttggttactaaagctttatactacattttgaaatcaggtagtatatgatgcctccagcttttttctttttgctcaggcttgctttggctatttggaatattttctggttccatataaattttagcattatattttctatttctgttaagaatggcattgatattttgatagggattccattgaatttgtaatttttgagtagtattgtcattttaaaaattattgaaacaaatcataacagaaatacaacatacctaaacctatgggattttcctcttaatttcttcgattggttgttcactagcatgtttttaaatttccacgtatttgcgtatttactgaggttccttttgttactgatttctagttttattccattgaggtcagaaaagatacttcatattatttctacttttttaaatttgttgagacctgttttctggcctaagatatgttctgttctggataattttgtatgtactaatgaaaagaaagtgtattccatagcatttgggtgaaatgttctatagacgtcagttatgactatttggtgtagcgtgtagtttaactttaatgtttctttgttgactttctgtctgaatgattggtctgttgatgttccctgctatgactgtattacagtttatctctctctttagatctatgtttgctttatatacttgggagctctggtgttgggtgtataatatttataattgttttatcctcttaaccaatccctttatcattatataattaccatttttgtttttacagtctttgatttgcaccctattttatctgaaataaacatagatactcctcctctttttttgttttccagttagatggagtatctttttctacccacttcactttgtcttacctatgtgagtgcctttatagttgaggtggatttcttgtaggaagaatttaattgtgtcttggttttttatatgttcagcctctctatgccttttaattggataatttgctccatttacattcaatgtcattattaagtaaagacttactactgccattttgttgcttaatttctggttgttttgtagctcttctctttcttcctttcttactactttgtagttaaatgattttctctggtcacgtgttttaatttgttgtttttcatatgtaatgaatctattataggtttttgcattgttgttacaattaggcttataaaacatatcttatagatataagttatcttaaagagatgacaacttatctttgatgacaaataaaaggacagaaaaatgaaaaaaatgcttttatgctttaactccatccccctcacattttgaatttatgttgtttcagtttgcgtgtttttatacggcctatctcttaacaggttaccatacctattactgtttttgatagatttgtcttttgggcttcacaatacttacgaatagattgcacaccacagctgcagtgttagaatattctggatttgtctgtatattaatattatccgtgggttttatatacttttacatgttttcttgttgcacattagtgtttttttcctttcagattgaagaattccctttagcctttcttgtaagatagatctaatagtgatgaattttctcaacttttgtttgtctgggaaagactttatctgacctttatttttctgtggatagctttagtggctgcagtattcttggatggcaatttaaaaaaaatttccacactttgaaaatgtcttcttatacactcctgttttcattgagttctgttgccatatgaaccctgattcctttatatgttatttgcttcttttctcttgctacttttaggatactctctttgtctttgacctttgagagtctaatcattatatcttttggggtagccttatttgagttgaatctgtttggtgttctctgaactttctgtccctggatatttatctctttcatgttttggaaagttttctgtaataggtaagctttttgccccttgctgttgctcaactacctcttgagcaccaataattcttaaatttgatattttgaggtatttttcagtattttgtagataatctttttccttttcatttttttctttttgcctctctggctgtaaattttcaaatagctgtcttcaaattcactgattgtttcctctgcttgacccattctgttgttaagagcctctaatgaatttttttttttttttttgagacagagtcttgctctgtcgcccaggctggagtgcagtggcgcaaccttggctcactgcaagctttgcctcccgggtacatgccattctcctgcctcagcctcctgagtagccgggactacaggcgcctgccaccacgcccatctaattttttgtatttttaatagagacagggtttcactgtgttagccaggatggtctctaactcctggcctcatgatctgccctcctcggcctctcaaagtgctgggattacaggcgtgagccaccgcacccggcctctaatgaattttttaattcagcaaatgtatttcttagtttcaagatttctgtttttttttgtttgtttgtttctctgataagtttctgaattgcttttctgtggcttcttagagatcagtgaatttccttaaaatggctattttgagtttttggttataaagtttacatatcaccatcttgttcaagtcagtcactggttccttgctttgtccatttgtagaagctgtggttcctcatttgtttttgtttcttgtggatgtatgtctatgtctttgcattgaagggttggttatttattccagtcttcccagtctggcttgttttgttttttattggacatttttgcttagagcttctttgtaatttacctgttgatttccctttttttcctctgctaggttactgcctaatttttggcactagatgacaccttaagccaaagtttgcctcagttatggtaaacaatgagagtgctactttccctgaatttgagaggtcccaaaagggatataccagtagtgtgggaaggctggctaagggtttgtgcagaaaggatgaacaattctcctacagtgaggtgctgcttaacagccactctgatttggcatccctttggccaagttacagagaaagtttctaatgctggggtggcagtcctgctgccccgtacctttttctctgtccttagggatatttctcccttcaggcactttcgatgtttccattgggttggggaagggacagatttcctgccaggcaatccacaatagtggggaaattgtttacccactttgacctcattttttccaatgtagaaattatgagtcagaggaaattttccggttactttctgctgggcagattgggggttggggtttcacagatattgaagtctggttttcttccctctgctcagaaatttttcatgtctctggctcctggaatagtctcatcctcatatttgagttcttgggtattgctggtgataatctctgtgctgtatatttatttattttttgtgggagtgagtgaagccaacttgcttctatgccaccatttcagaactggcaaaaatgcatgtattttttaattagtaatttctaatagtttaacttataaaaaaaaggttttaattatgaaaacttttatcttagcattatatgtagtggaaacaaacctcagtgttcaataatgggggatgtttccgtaaacttgtttatgtatgatatgtattagggtttcttaaccttggtgctattgagattttggcacccgctaattttttgttgtgggggctatcctgcacattttagcagtgtctctagcctctgctttctgggtgccaatagcactgccttttagtagcataattctgctgcgagacaccaggagtcattactgaaaatatttaacaacccttcagcacaggctcagaactgaccagcttaactgagcggggtaaaatttagaatagtggccgcaagtgcaatacccctttaacccaagttatcctgagaaatggctacatacccagacaccttgtgttagagacctagcttgctgtagtaacctgtagctgggggagagcaggattaggtgtctgggaaatccactggagagaccagcaccagggagagaacctgttgttctgagtgtgccagataacttcagcctttaacactccacagggagatggaaggcggcgggggttggtcaacatgtggaatgaggcttcaaggcattgtcctgagatattattggaaggaaaacttttccttttctgatttgggtccagtggttggggacctgcagattaactgacaagagacagattaattgaagaaaagacaaagtttattttcacaggacagagttcccagcaatggaaaacccactaaataaccagagataaaggtttatattccaaatttaacaaaagattggggagtggttttagggcttcagtgggaaaatgtagaaagttctatcaggctttttgatggtaatggcaacaggcagtttgtctacctgggagctgaattagacaactcccttacaggggagttaatggcaactattttttctgggaaagctctgttttagtcaactacttgaagttcagataagatttctttctgcatcttcttttgctcaaatgttttcactttaaaataatctgtataccaactctggggatctgaatgggtccccgtattttccctatgtagaagttccttcaaaaaaagaaagtgggttgattgctgcgcagagacatttgtgttataaattgcaaggtaagagatctataaaagagagcgaatttagattagaacaaggaaacaaaaagaaaccaaagaataatggttggagcaaactataaactcagattctgagtccagaaggcagccagttgtgatttccgggtgttggatttgaagcgtcttcagtgatgatagtagtgtcacagccacggttactccctggagcagaatgtggaagaggcaggtattccagtgggctttctgagtggcccacacagtggtggtgattaatcttttgaagttttatcaagtcatccagcttcagcttgcacagctttgggagtatgcttagaattatttcattggggaattttttttaatgtttccagttaatgacacatgtactaaaatagatttattagaagaaatttgtttaaatttccttgacaagaaacagcttttggcttctaatatattcctattaattgagttaaatcttaaaattcttagtgaactctattcatgttggggacttgtggtgtaggtaaacctaaaattataatgattataaagttttttatatggtaacatttcattagtatcagatgagagtgagagagtagaattctacagaaattgaaatctaaaatgaacagtctttaaggataggtgtgtggttttaataattgtaagtaatatgaatttaatgatgataatgagtatctggtgtgtgtgaggcaataacatcaagttctgttgcatcaagtgctgtggccgttgtgatatgagaaggcctaaccacaaggtgagcgaatctacagaagcttcatggaaggaacagcatttgagaaatgccttgaaaattcccgcaggcagacccaggggagccactgcaagtgggatgaagagataaggaaaggcacagatggtgggaagactggggagaggcactgtggcttcgtaaaccgagcctggtgtttggaactggatatactggagtttgttctttttcttacacttactagccaagtacccataagtgttccccatcttggaaatggagaaaatatctccctcacagaacatttgtgagtactcaatggaaaagtttctggcacataagtacccaataaaggttaccttgttccattttctaaaaacaatgggtctttgactttttcaggaacaaagactaaaagagaaattcatttagggactttttacagagatcttttaaaaacacataattatgttattcttgagcaaggggtaatttgattaagtcagtgaaaagcagagatcatagagttgtatgttaatatattagtattaagaaacaatggtccatggttatattgctttgttggaagttatttagaacattttgcatgctgagcatcatgaatactttgtctgaattattagtggcctccaaattaataatggggctttcctgtgtgtttttgacattaaattaagtttttctttgttctttgttctgaagtagtaactcaacttccattcctaattacgttctgcccaggctaatatgagcactagtttgtaatcttttgctacccagtagtggggcacccttttttgaagctgcctagacatggctaaagacacatttgcagtggggaaaagctggcaaggcgtgacagatgcattctggttattatccagatttatctgtctctcccagaaagtatgatcatcccctttgcttcccacctcttctgtgggaagcactctgctgtgcccacccttcccgctttgttactctttcactctatcattgttataataaggaaatgttttcctaaaagtagaattttcataaaatttaagtcctgacttaccgtcctggttcctggacacctgttttcagtgtgatgcagaaattggcctgtgcttctcataccaaatagaataatcctttatttaaacagctgtcccatatggacaatgtacattacgagacaatggtgttcaccatttggaatccttctttgttcttgaattagaaataagaatcagcaaacattgccatgctatggcagtctcagcatcatttcacagagtgtgtctaaaggagtagtatttttggtagctgaaaaatattacataagtaatgctgcataccagttagttgtattaaaatatatattatgtacagctgtgtacttggcttgaaaagcttccttgacaacatcatttaacttcttactgttcttttcatgttgctggtataaatatctaatatgtttttgttcaaaacatcaattaggtttcagtataatctttattaatacagatctgttattacaagaagactgccgagctatgataatttgcacagcaggaacaataaaatatctcctttctgtttcattctattccagaatgcttggctttttgttattcttttacacaacatactaaaaccttttatgattttttaaaaattatagttaaatctttaaagcttatataagcaaaagcattatttttttcccaaggtgaacaaaattgaaaggccaaaaatttcagatagattgaagaagacatatattagttacaaatctccacttttaatatctttcattctttttctttatgtagccaggactcctcacttcctgcggattcagaatgtggaagttaatgctggccagtttgctaccttccagtgcagtgccatcggcaggaccgtggcaggagacaggctctggttacaggtacagtaactcattttcatcagttgatgagagtccagcgggaagaatacactccccctggaggaggaacccagagaaacagactcaggtcctagtgtaagagtttccttctttgttaataagtagccagattacttagtaatctataaaagctaattatttttgtttaaacaccttttgtgaatttcttttttttttcctttgcttatgcttagtcatcttgcttggaagatctgattgtcaaattacttatatggcagtttattaaattacaaaatatagcactcttctcctaagtcttcctcttgagaaaaatctaaagagtctctttctctctctctctctctcttacacacatacacaccacagaacacttcataggcctttttgtcatttgaatttccaagctgtaagcttaaacttagaaattaataatacatattttacttttgagcttttaaattatatttctttggtgtagtgatcaattgtgtgacttgttttgtaattattcaaattccaccatatgtgttttgcatggcagagggttgcgtggatacatccatgctctcaggaatcctgacagaatgagtgggagtaaattgcctgtcccttctaaccagaatgccacccacttctttaagctctaggtttggggtttgccctgccttggtattctccagttgcattcttgtttctttcttttaagcattaatctggaggctgctcatttttcatcttgagtggtgttgattttttgtccttatctttccgtgttttgtgtgggtgtgggtttttttttttaaagtattatctatttatttttagtttgctactgagttgaactgtccttcgggttttaacccttctgtgtacgcggttgtgctccacactggcttccgctccatcatgtgtgctggccttgtctctgcacgtgccatctctccacctcctgtcatgcctcgcagtgtaattatgattgtgattggagactccgtgtgacactctgtaatttttaaatccttcattccttttaatcactgcaatgtaaatctgtagtcatttgttttgttttgtgtttgtcttagagacagggtttctctctgttgcccaggatgcggtagagtggtaccatctcactcaacctcctgggatcaagtgatcctcctgcctcagcctcccaagtagctggtacaacaggcacatgccaccatgcttgagtaattattttgtcatttttatagggatggattctcccttgttgcccagtctggtctcaaactcctagcctcaagtgatcctcctgccttggcctcctaaagtgctgggattacaggtgtgagccactgcacccagcccagtagtatttttattcttctctttctggggaaaatgggagacatttgagtgtatgtcccaagattaatcagcaatgcattgtcagatgggaaatgcattctggagaggcttcttgttgttttctctgccaggatgttccacccctctgcccagtgtcactctgttttttcataccctactgtcccttttagagactttgctggccaggaagtgtatgcagaggattatattgtatattccaagttcatctttactttcttctttgtctgtaaaagttttgtaactgctaacttaagagttttttgccgcttgtgaaaactgtcctccgtattcaaattttttttctctttttaacctacatcccaattgttttaaactcttgatgttaaaattcagaattgttttctcagataatggctatttggtattaaacacaatcaagattggccatctgtggtaattaatgatgagacaaacatcttctattgacattttccacagagtattaagcaccttttaaaaatgaaactatttgttcctttgatttatctctagaaatcttaattatttgtggaaaaatacgttttgctcctaatatttatgatattacttgagagaatacaatataaatactatattaagtctagagaatacaatataaatactatattaagtctaagctctcgccttaacagagtcatcttagatattcccaagaatttaaggtttgttgaggacatgatttgctctttttatttttgcaaacgtcctggacttggtgtgctcctgcttaaacttgagcacttatttgggttgggaatctttcactacttcctacacttccaggaactttgttttagagataatttgtcatgtggtatggagaaagctacttacagttttggggtttgaaaaacaaagggtctaaatgcaaagttatcagccctgactctactatagaacaacttggaagggttttgttttgttttggtttgttttttttcacaaatgtcttgtctatttccagattctcatttagttggtctagggtggggcccagcgtgcaatgttttattaaagactctccaagtgattccagtgtgcacccagggttggaaattactagtgtgaagcaaaatacaacacacattctaaatcaggaaagaaagaaggcagacataacatataactggtacctgtattcagttgcctcagtttgaccccaacgtttaattttccatgtactgatctttgaattttttctcattagatttgaatgatggtgttggtagttgttttcacagtcggtcccttaatgcctttctttttctcttgctgagtcttttctgacccctcttgtcttcagtgaccatttattgccctgcagctttctacactgcgctgtcaagaaggagatgacacagatagaactgttgtgactttgagctttttactgaaacttactttatcctggaatcaggacactatttggttagtgaatctttgtgatgttagaataattttactgttaaatagtttattttccctggttgggtaggcattttgtggggaaatatttattttattaatagcttatgaaataagacccgtgtccttcacctgcaagggtggtttttattaatctatatgtgtacaaagcagtttccagtagtgatgaaggttttcagcagatgctggttttgcacagcccttcctgccctcttgcccaggacccctcactcccccttgaacattttctcagtccattctttagaggtcgtgaagacatgtaaacctttcgtcatggaccaggtctttctaatctagagttgtaatacactaacacctgtctgcgtgtaaactcatttgggtcctcaaaataatcctgagatccaggcagaaaattgaagaaaagaacttatttttagttttttctgtgattcgaatctctctcaagagtgagtcaatatttagaaattaataatacatctttgtttgggggtacattggtgtttttgaatataatcatttacaatatttttttgagacagggtctcactctgtcacctaggctggagtgcagtggcatgatctcggctcactgcagcctcgaccacctgggcttagatgatcctcccacctcagcctcctgggtagctgggactacaggtgtgcaccaccacacctggctaattttttgtattttttgtagaaacaggttttcaccatgttgcctaggctggtctcaaactcatgggctcaagcaatccacctgcctcagcctcccaaagtgctaggattacagacgtgagccaccatgcccgacctatttacaataatttttactacttgtgttgcagtcttttgaggcccacaataggtattctgcacaaagtttcatggttgtatcccatggtagtttatctgttttgtaggagaggagttggaagtttaggattgtcctgggtcacaaagaaaaatgacatagctggcaataatacaactctgtttatttacttttatttcacctttaagtaattccactctactataccgtcttgttgaatttggaaggtagatgaataggcattatgcacttacgctttgatagaagaatttgggtgtgaccaatattacatcgttaatatcaaggtgccatcctgaccgtggaaaataatgcttatatgtattacatgtcatattgatccatacctgtgaaaatggccaaggttttgatttttttaaatatagattaaatataacccttgtcagagtctttcacaataacgtaacgtaaataaatctgatgatgacactaatgaagaaatgtttatgattaacagatgtgtcccatctgtttatattttcttagtctcatctgtggaccacacaggttatgttgccaagtgggattgttttctctagaacactgaacaatagaataagacccagtgtgtgagcgcatccattgttacagctacaaaatactttaaaaaattttccagacagtaggaagacaacatctgtagaactcttttcttgtatcgaaaaacctatatgcaatgcagttcttgaagatacttgtgatatgttatcggatatggcaatctattcatataaacatggactgcaacagtgtgagatactaaaattaagtgtatttatggaaatcattcaagcacccaaaatattactgtaattttttgctatcaactttccgatcactttttgagcccacattttgaaaatatctcagagtctgtatacatatactgtgtgtatgtgtgtgtatatatatataacactgaaaagagaaaatggaatttgagattttctttttatactttctgtacacttttatacttttgaaagtactttcttggctgggtgcagtggctcacgcctgtaatcccagcactttgagagggcgaggtgggtggatcatgagatcagatcgagaccatcctggccaacactgtgaaaccctgtctctactgaaaatacaaaatttagctgggtgtggtggcacgtgcctgtagttccagctactcaggaggctgaggcaggagaatcacttgaacccggaaggcggaggttgcagtgagccgaggtcgtgccactgcactccgtctcaaaaaaaataaataaaaataaataaataatttttgtttgctgatgggaaacttctgatgttgtatattttttatgtagtcactgacctttaagctatgtatggttgtattaaaacctttattgttctttcttcagtattccaaatattatttgcctatatttgcttgtttctctcaggactttctatttataatactttccagtaaatgaaggtgacaaccaaagctagctagtgtttatgtacctatagatgactcatgcacgtgcagttacaagacctgtggcatgggggccactgcctttctcttcccctgcctggggtcccattttggtgtttttgtaacttctgctctttaattcatttcttgtaatcgttgtagaggttcctgcattccttactcctgttagcaaccacatcacattcagagtgggtgggaaatacaaaggttctgcctccaggacaaagagcagaagacggaggtggggaggagcgatgtcttttcaacaaaggatgaacagatctttgatcaggctaggggttgaggtgtgcatgttgagtgaatagcagttggcagtggaaacctggaaaataacccctttctcttcacagtcattagaggtccataccatttttaaatatcttactttttaaaattacacaattatgtaacctctgaatttggagcaatcttcaaattaaattcctaattttattgacgagaaaacagaagcccagaaaatgtaggaaactttagtgcagctgtatatcctgtttttatgtttattataggtaactccattttattattgaaagtcagttttatatgtctaatatttttatgtctgtatatatatgtacatgtttatacttacgtataagtattgttatttatttacaaatgcatgaattttttctcttggacatttttcttcactgagtgatcttgcatctcaaatattagccttttaacctgatagtctcagatttactgtgatttacctgtgttaaatttagaaccttaaaatccatcatagcacaatataattgagagttttactgttttgcaagcagagtttggcatttattataagtaatgcaccagaatagccttttaaaatgattccataatatgcattagtttatacaaatagaaaaggaaatcagatgatgttactgtaaagtacagtagtcccctcttatccgagattttcacgttccatggtttctgttacctgtggtcgatgaaaatgtggtccgaaaatgtcaaatggaaaattccaggaataaacaattcataagttttaaattgtgcaccattctgaggagcacaatgaaaagttattctggcccaccctgtcccactgaggacatgaatcatccctttgtccaacaaatcccaccacctacccagtagttactaaggaggtgtcttggttatcagataggctgtctcaggatcacagtgcttatgtttaagtcacccttactttacttaaccattgccccaaagcacaggagtagtgatgatggcaatttggatatggccaaagagaaggcataaagtgtgcttccttcaagtgaaaaggtgaaagtgctcaacctaataaggaaagaaaaaaattgtatgcactgcttgctaagatctacagtaagaaagaatcttctatacttcaaattgtgaagaaggaaaaagaaattcattctagttttgctgttgtacctcacactgcaaaagtttacagccacagtgcatggtaagtgcttagttaagatatacaaggaggcattaagtttgtgtgtgcaagacatgacagaagctatccatggtttcaggcatccactaggtgtcttgaaatgtatctcccatggaacaggggggactgctatactgttaaaaacactggtacaaccgagcacctagactagtgcttgtcacatagcaaaatgctcagtgaatacctactaatgcatggggcttactggctacccaaacaaatcgtgtagctccttcaggtgagcatcaaaagtagatttgtagttagagcaggaaaacaagcacagaggaaatcgtttctctctgggatgattgctttaggcctgcagttcctgttcagaggatggtctttgatgagaggagcaattcatagaatgtagtggtgcctctgctgcttcaggctatatagcaaatatcatgcagagttacaaaaactgattaataaaaacaggcatatgttggagtaattttagaagcaaatatggtcaatatatcatctttcctaaatcttcatttcttgtaccctttgcctaggttttcttattctgtcatgaaacttctgtcctaattcttcctgtaaaaactttcttgccgtggcatccacattaaacgttatagacatacacctttatttttttccatgatccccatgaacataagaaatatacctttaataaggatattccacttgagtttgcacaatggcaacacctgtgtcatagtaatagatgaattaaacctacgccatccaccttttgtaaagaatgtaattccatttgagctcttcctttgaggagtttaattttcttaaaaaaacttacttagagttaacagtttttcagctgttggcctagagattgatatattttttttcttttgagagtttgacatataattccaccaagctgggtatgagctacgcaatcgtgaaaaaagtatgtttctccagtctaataaattgctcacattttgtttttgagctcagataattttaaaactttttctgagagaaaagagggaaaccttgagatttttataacctacaacgattttaatgggaacagtttcactgatctaccatagaatttggcttttgaatgaataaattaaaaattatatgaatagtgtttatattactgacttcagcaggtgtgtttgaaataaagtaattgcagctacatttactgaacactgctatgtgctagttactctggtaggtgatgttcaggcatttttttcattgatccctacaagaattttattatacgtccatttatagaagaagcggctgaggcttcttctttaatgacttttccaatggtgcattgctaatcacaagagctcggatttgaacccaggccgtctatgttgtatcgtaaccataatgcatgtttggtactgcagaaaaagacatagatagttcctcatgaattcataagtatcatgtaatttaaatgatagcattgatcagaatgtacaattaaagttgtttttgtatgtatgcgatgttgccttggctttcgtgttatggatatatgcttttggtcaacctttctaggtggcttttagtttcatttgttgattataaggaaaaaaatcacaactgtatttcagaacaattttgttattatgtataaaagccacaaaatgatatgaaaagaagtaaaattatggttcccttcacaagcttaacttgggtattttatgccatatatattaaagcagaaatttaacatcacttagcattccagaaaatactagaaatgcataaaggaggactgtctttagttgctatgggaaccatttgctctaaaaaattttgagtacttaaaatcacatccattattgttttagtcagttaaatatctatatctatatttatataatatactgaacaatcagactgaagctactgaaaacctttaggcgtataccttatgttttaacttaatatgattttggattacctttatttaaaaataaacatttcttttatattgatgaaacagtataacatgtctagggatactctagaagaaattaattaataatttttcctttgtgatattatctaactcagccaaaaaaagatgtaagcaacaggtgctgtaggatgtggcaggaacaggtagggcagtagagagccccttcctccatagcaaccttgaggtctcctggcctcgacttgaaattggactttttatttttatttttttctttccagcttttattttaggtcagagggtacacatgcaggtttgttacatgggtagattttgtgttgctggggtttggtgtacaagtggttttgtcacccaggtggcgaacataatacctgttaggtagttttttgaccctcaccttcctcccaccctccaccctaaagtagaccctgtgtctgaaattgggcttttaaaactactggtcaggttgtgtcagtctggagggcagaagagaaggaagggcatcaccactaatcttaaggtctgcttcctttggccctacaaaccatacattctgggaaagccttctttcttcttttattatattcagcggaaggttcacttgctcttcttgcttccaagtatccgaggctatcccatgagaaaggaagacagagatggccatggttggggctgcctgcttcatggggctggcgggaactgggaacaggtagaagccccacccactgctgagctggcagggcaggaacctcatgctccctgagcacagctgcggctgcccagccatggctgcagacccagcatccctgtgctcttagaggctgggagcaggcaggagccctgccctcccaggtgcagctgcagctacccagccacggctgtggacctgggcatctttgcactctcagggacccaggaagacacccctgcacctgcaggcttcgaagtacctgcttccactgcctggcctctccctgttcccagtgcccgcttcaatcttggagcaaagttgaggctaaacccaggtgctgtcgcaacccagccaggtgtgtgtgcacccagggcagcacttacatgccagccccctgccgcctcagccccttcctgactttaggcactgacaagcatgggaggaaggctgagggggtgttgagggcagtttggcactggcctgcaggtgcccctcagcatgaacagcctgagtaccatgaacaggaggcagacaggctccagggcagatgggggagttccccggtgaagtcccaccttcaagccaaggaaggcctgaagcctgggagctgtcagtcctgcagttcgggagtgggaaattatcgtgcttttttgatgcccacccatggccacccatgaacctgtcagcacacacttcctcccctctgaagcccatgaaatccatggactcagccagactcgagcactcaggccgacctgcctggagagagaagctgcccactccagggtctcctctctgctgagagctgagcacttgactggatgacctgcctgcatacaggagctacccactcaagggtctcctctctgctgagtgctaaacacttgttgggacaccctcactgtggagcaaagctgaccactatgggtttcctttgcgctattctgtcattcagtaaagctcctgttcaccttactcaccctccacttgtctgcatacctcattcttcctagacacaggacaagaactcgggacccaccaaatggcagggctgcaagggctataacacaagcagggctgaaacatgctccttgctcaccacgttgtgggtgacaagaaagaaggagagaagacctacagcccttcagggagcccagacctagaagctccccgagccagggctgtgacaccctcttcgtggctctgcagttcctggtgtctgaagtttctgggtgccaccacgttccccattgccagccttggaagctgcttgcagggagctggtgcccatgccggcacctggagctgcccatcccaccacagccagtgtgcctggctgtgctcagtggccagatcccatgctcgctcactcacacacccgtcacctctcccaactcgcccttggcaggcatggaatccaggccggtagtgtcagccgagcgcagcctgccaagccaagtgggcccgctgggcccgagcaaaactcaggtaaaggtgccactggccacagaggtttctggctggcgaagcaacaccccaaggatcccataacattatcagccattgatgatcattgccttggttcattaattcattaggagttgcagaatggtctaggtctatcagtcacttactgtcatcacctaaaagtgaccaaggtagttataattattgttgtcatcatcagcattgtcgtcatcagcttgtgtgtttgaacacatttgatgtgtttcagtccattgcgcttaatatctttattgctgctcatgtcttccccagccttccagtggggcttactctgcatgggtgactcctgtcctggtccatttcagggagcttctttgctttctggtgtgatgacatattctaggtgtatattttccattttctacttcagacctagaattggccatttttccagggaatcctggttgtttttctgtgggaaatggccattagaacttacaatctgaacatagagatgctcattactactttatttattttattgtttattgtttttggatcttctcattggagagagctaagatatcttggtatgcacacatacacacatttaaagacaaactgtgccctgagtgcatactgacaattcctatgcaaattcaaaactgtagggattttaacctcctttatcttacatctttatcctctttcaactatgttttcagaagagttgtatattttaaggcatattgactaaggaaaagtgacgttattaaccagccgtgtgaatgactagcctggccttttagatcatgtttgagaggtagcacaagcactgccactctccccatactagagtgctataaatacagtttaaaagtgaactggcttgagacctagttttgcaaaggtttgaacctttaaatatatgaaaaaatgttcgtcagtgttgggctccttagtttgatttggccaagttaacccagttaacagttgggatatttgattttaagaccacagaacttctagttttgctggcatttctagttactgcatttattaggtatattctatattatttggattaacttctagataaaatttaaatacaggtttattaaatgatgttattcagctattatgaatatatcacaaaatgaactatgtctaaatagcaaaatgaagctctaaatttccataatcaaattcttcttgaatataccaataataataggatataactttggatatctgtatgttattttggctatctgtatattcattagccaacttaacgtgtgcttgtcaatatatattgctagcatatgatgatacaagtcagaatttttagttttagtacagtactccaaattgataaatatttgggttaacttggttgtggtctagaaatcaaaggtcaacactatgttaattattaaaatcaaacttatgggctatataaaggtagattcttctttgagatgttcgattaatacaggatttagcttgcataagatatttcaaacaaaattactccaggccctgctgatgttattagtgatgtcggtggtaagaatttcaatcaatatctcacaaatgggcacatttgaaagttggataatacagactattttcactattgaagaaatgaaagtgccgtttaatccccacctgtatgtctgaggaagggggactggctcagagctccctgcctgatgcctgcgtactcagagcagctccaaaatgcctgagattgattaatttgctgcaagtgctgctaacttcccagacctcaatttctttcaatcattgctctgattattgcaaaactatttctgaaagacttaatatgtatcttttgctggtaaattactgctcatttagaagtcctagagttagtccattgcatagagaaggttgtaagtctaatttaaataactatcagtacttttttctagcctgctcaaattgaaatacatgcacatttgaagatactcttgcttttataaagagctgtatttaacccggtcagatatctcctctcaggcatcatcattatggttatttcactaagtggacaaaagatgggtcagtgatttatttaacaacccaggacattcggtcactgtgctttgcatggtgtctgaggtttttgttcccaacaactgtgtcctaggctgtctctcccagtgaactctcatatggtaaagaacagtgcgatgcccatccttcatcattttttatggtccttctgtcacgctattaagaatgtagagtgccagtgcttgacggggctgcctgtttcttattctgaaaatggggcaaaatgtggctgacaattttgctgtgtccacctgatgtatattttcacaattttgttttgctgtgggtttctagatgctcagtggtacctgaggttctgaacacactgacctctccaggtgtcactgtcatggggaaaggacggtaggggcagactctcatgcctgtctgcacctgacttgcagcaaaggaattggggctggccatcactccccacacttcactgtttaattccagcctagggaatggaatctggggaccaaaagacatcttaaaatcaatttagtcacttgttcaatgcctgaatcacttttaatatcaccaccagtcctccctaggatgtacaaggcatggtttatatgttaaagttagagcaataaaaaccaggcaaggatccctgccttcatgggacttgtattctagtaggggagatagagagcaactatggtaagtaagagaattatgcagcatgttaggaaggggtcagtggcactcataaaggaacagctaggtggtgccaagtaggagcatgtttcagtttggaatttaggcgtcaggttaggcctcagtgaagtatttgagcagtccctggaaggagatggagttggctctgggggatgggtgggaagcattctaggaggaggaagaggtctcaaggaaggaggaagcctggtctggaaagaacagccaggagtccacatggtggggctgagtcagccggcacagtggtgcggccatggcacagtgggactgggagtgcctgaggatgggaggactgggtgtgtgccttctcggtggtcgttcttagtaccttagcctgtactccaaaatctataatcagaaagtttccatatctaatttggtagcaaaacctccccatttttgtaattcatttggtgaccaaacctgacctgaatggatgtgaagctatttagggtttctgttttttcctccttaaagtcaatattcctaggtttggatgcagaaatgtcaaaacctaggaattatggggtgctgtctcagactttccttggggtgtcaaagaatatgcagtgcagatgcctttatgaaataaaataaaaaatctgaattctgaaccacattttactgcgaggatttcaaataagtaagtactggtgacttttactagtatcctgtggcccagacattcacatcccattcctgttttacgtgcctgtccttttcatgctggaagatggttgtcctctccccctcattctcagccagctgcgttaatgactagcctggtctccagctcctccccttcttcagttccctaactgtgggccaggggatttattcactgtctagcccacagtcctctgaacaagtctgcttctcttatgctctgccgaaagcctgaggctccaaatggaatgctgtgtgctgggacagggacaagagggaccatctctccagatacttcattaatacaactgaaaattgaattaggattttagacaaaaacctgctccacaattgttatgtatgttttaatgatgaagatgatgctaaatcagaactctatccacttaacaaagtctgattttacagggaagcatcagatgcacatttatttttattgatgtttatcttgttttaatttattgtttggctttgtagatatctttttccatccctttttgttaatttatgtgctcatatattgtcacctgttcatttgagaagcacatctatgactatcaaaggcaggaataaacttgttgggagaagtcagggatgaggaaatagccttgtgccaaggcaccagaaacagacgtcagcgttggtgccaacgagcagctgcgactctggtcgcttgcatgtttctagtccacctgatcttcctggcagttagcccatcttgttctccttgtgtccacagagctatcataggagacattgtctggtgctttgccagtgactctgaacactgtgcttcctcatttcctcatgctccaagaaatatggttcgacactggaggaagaaaagtaatacctttcctcacccatcacaaggtttatggctgaaatccctataacaaaagacagattaacaagataaacacataaaaaattatttaatatggctgggtgcgatggctcacacctgtaatcccagcactttaggaggccaaggtgggcaattacaagttcaggatttcgagaccaggctggccaatatggtgaaaccctgtgtctactctaaatacaaaaattagctggttgtggtggcaggcacctgtagtcccagctaactgggaggctgaggcaggaaaattgcttgaacctgggaggcggaggttgaagtgagccaagatcgagctgctgcattccagcctgggtggcagagcaagactccgtctcaaaaaaaaaaaaaaaaatatttaatacaagttttacatggcacaggagccttcagaaaatgaagacccgaatactcagggaaaactgtgtttttatggacagtcgtgtagaagtgtgattgagggacaacagggcaggatctgatggtaataagcggggtgcactgaacaaggcctgtttgttcagattctctgtggcctgtgtgacattcctgccctccagatacagggcaggatacctgccacatgaaggcctttaggggaggatggagggagaagtcagagagtgacctctgagtttcctagcccatctcagggcagaaaggggcaagtggaatttcagtttctgtgtcctgcttggtgggggggcggggagggaatggtctgcatgatctttctgatgttgtggttttctcagcttctttcagcttaaatacttagtatgccaaggtgccatattttggggtaccatttcctgcactgcatcaacactaacaaagtggagggtgaggtctctctcctcccttctcctccccacccagtactttgaggacatcccctcatttctcctccattagtcccaaagtgcatttgctgccttacgcgtgtcttcttagaatggggctgatagagagcctgatgttgctcttgcacctgacacattttttgctttaagaaccaaggaggggtctctgaatgtgtgcatgtcaggatttcaaaggaaactaataacgtcattgaaggcttgtatctttttccctcgtggatcacatctttctgcgtgttgggtcatttggcctttcgtttctgtgcctctccccatccttgccctgcctggtcctttcttccccatgcttcctctcctgttgcctcacccagctttccccactcctttctgattttctgtcttcacactgtcattcccccgctcttctccagtgtagacggcatgttttcctgtttctttcttctgttttgttatcccactgcccctgtggctcttctgtctcttcatgccttcctggtctggcctctgctcatttcattcatcttatggggtgcctccatggttgctgtctttgggctgctattctagctcatgattccaaagtggggtactctacttcggtgacccaacatgaccttaaagacttgcttatgcacctctgacaaatcaagatgcacgacccctggacaccttcaaaaagccacagggcttttagtttctcagatgatcaccacattggcatcctattgctgctgtaacaaattcgaacctcgtggcttcatcatcttactgttttgcaggtcagaagccctaaaagaaggtgacggcagggttggttcctcccaaaagctctgggaagaatctggtccttgccttttccagattctagaaacctccctcatattttgcctcgtgatcccctcctcacacttcagagcccgtcggcacaacctctgcttctgttatctttccttcacattgacccttctgccttcctcataaatagaaccttgtgattacgtttggccaacccagataatccagtctatctttccatctctagacccttattttaatcatacctgcaaactcctttttgccatgtaaggtaacatagtcccagattctggggactgggatgtagacatctttggaggcccttattctgcctaccacagtcatgatgagttggggcaatgttgctgactgacgacacacagaacctctaaaacattcttttactttccctgttcgtctccattgtaaatagggattctttgtctagggtttggggtttaagcctgttaatttagtagaacctcatttttctcttctacccctggaagatttttttccactgaggctgtgattcctagagtcagccagtatttcttgagttctatttattgtgcacctgggtacacaaaatgagtaagatacgaccctggaccttatggactgctagaggagaaagatgttactgcagtagagtacatgttgtgttgatttcattttctagatatctttaggttccgtccctttgtttctgtcttctctcattgtgtcatttgttactatgatttctgaaaacaatttacccagtttcccttgacatcagttggactcacaccgtatctcctccagtccattactgtacacacagaggtgtttgtgttacctctttgcctaaggtccttccattcccagcatcagaatacactgaaatctttaacatgtcatacttcttgttgcagtctgtattgtgcttttccttctagcctttttacctgccataccaagaagcacttctgttcttgccatatgggataagttatacttcccttagagttcccctagagttctcctatactttccctatagtttttttatagttctcctaaagttcccccatagctaccctatatttcccctatagttctgtgctctctcttggctcctgactctgaagagcttctcttattcactagacttttcctctttattccctgcctaagaaacttctgtgcatcctgaagcctgggcttaagcagtgcttcctagaaagcttgcactgacaacatctccaggactatagtttgaatatttgtcccctccaaaactcatgttgaaatattaatcaccagtattaaatcagtatttaatctccagtgtcattattgagaggtggggcctttaagaggtgattgggtcatcataggagagccctcattaatggattaatacatgtgtggattagtggattaatgggttatcatgggagagggaccagtggctttatgagaagaggagagacttgaactagcacactcagccccctcaccatgtgatgccctatgctgcctcaggaatctgcagagtcccggccgggcgtggtggctcacgcctgtaatcccagcactttgggaggctgaggcgggcagatcatgaggtcaggagattgagaccatcctggtgaacacggtgaaaccccatctctactaaaaatacaaaaaaaaaaaaaaaaattatccaggcatggtggcgggcacgtgtagtcccagctatttgggaggcagaggcagggagaatggcgtgaacccgggaggcagagcttgcagtgagcagagatggcgccactgcactccagcctgggcagccaagtgagactccatctcaaaaaaaaaaagagaatatgcagagtccccaccagcaagaaggccctcaccagatgaggccatttgacctgggcttcttagcctccattactgaaagaaataaatttcttcataaattttagtttcagatattctgttataagcaacagaaaacagactaagacatccagtcaggtcttctcctctgtgctatgggaggcagttcattgctctgtattgtaattattgccttgtctgtttttttttctagccagacaataagctcaattaggtaaatgatggttcttttaattttatgctctcttatatgatatagtgtgtgccccataaaagactgtcactgaatattggttgaacgaatgcctgaatccatgcacacatgaatggtttaatacaaaatggcctgcagatttgagtaagatgtgtgatttgctattcctgtgtagattctaagctaaaacgattgctgcttggtttctcctccctatgtactatttctcttgaagctgaagctgacttttcatgtgattaagtacaggagttaaaaatttattaaaggctcattcctgagcattcatatgactcactagagtcacgcagggctcctagtccgaggctgtttattttatagggcccatctgtggcatgaagacagtgctactgtgagtcatactcctctcagcatatgcataaatccaaaaaggagggtttcttttacttgagtgccctcagtatagccttgaatagttgtgaggggtcagtaagtgcaaacttgaaattgtttttgaataaacattcttttgatagatgcttctgtttggaaaaatattaggagattattacaaaaggatattattacaggattcatgccgcaagtaaatagataaataaatggatagatagccctaaggcctctttggttgttgttagcaaacaaatacttacagatatgcaatctgcctttatggcttaatttcttttcccttcaaaaaccagagatgtggttctttttcagtttggaaagaagactagggagtagtatgtctaagattatccttagggctagaatttgcttatttcctggggtggggtgagaatcagagactgaatatctatggaaagcagagaggaacctttctcctgttgtattattaatgctaaatttggttttgtttcattttttaacttcttgatgctgtctatgagaacaaatttagggcatttagtgaaaaaaacacacacagacttatgtgggactttattttctgacttacggcattgtgtggtataaacaagactgttttacagataatactaaagataatgttgatggaactgttcttccccactcgtgatgtttccttccaagtggcaggaactgtactattgcagcactcctgtctgctttctcactgcccaagctgaagctgcctgggaggaagggctgagcatgcctagcccagccccttctttggggagctgactgcctatgggaaccctctccctccatcctgtgagttttacagcagcactgaacatatgggaggccttgtggttttctagggtggcctgggactgggttagtgagtctgtttattctgtgcttcaggattagcaagcccattgttcctgcactcttaagtcatattcctcagtctcaggtttatcagtaataaaggtggtactttgatagccgctctgcctttctccttgaattcatcactcaggtgttccggcgcttgggcggggctgcatggtggaattgttatggctgtgtccttgcgtatgcctgtgggttctcccagcagccctgacagtgggtggtatcatctcctctttacagattaggaagtgaggctctatgaaggttaaccactctggatgatcactataggtttggcatactggtcaggctaactcccaaacttgtgtcccttaggtgattcggccaatgaaaatatcacagataaaagcttttaaaggactttgcatagtataaatcactgggtaatacagatgagtttgattcctttgtaggctagcattttcatagctatgaatgtaaacattttaatatagcctgcaagtccctgagcacacaggtgcttgcccacctccctagctccactggctgccttaacttcatccaaagccttcatctctttctcaccatcttgagcttcctgtagcgtttcctataactagaatgctcttcccctctcacccttcccctttgcctggttagcttctgtttacccttcagatctcaactcacatgtcacttcctcagactagcctcccacagccactatatctgcagtttgtctgcaatggggtttctgctagccagctcatctttcctaaaccaccctggccatcgtttctgattatgtattcactctaaacctatacaccccaaacaactgcaggcccataagcccagccaccacttttcttttgggtaccattgtgatcatgctatcttgacatagtgatagctcctggttgggatgccaagagtggttgctgagtgaataacggacatagtgcttgggcattacgcttggcataatgatcatgtattagccttgaggtctttgtccattgttttttactaatacttataaataacatgttaaagatagcctctttcctgattataaaatacacacacacacacacacacacacacacacacacacacacacacacaggtttccgctttcagggctagatatttgtccatattcgtatttgtctatgggggactgttggtgtgagaaactttatatatatgtgtgtgtatatatattatatatagagagagagagaaagagagagagaagagagagcacaagagcaagagcacatacaagagagagaactaaaatctctaacctgcttttgagactttaaatctctaacctgcttttgaagccacgaggtttgaggctttaaactattggaagcatagaatggatttccaagtgtgcataactaaaagggttacttaatatatggggataataaaagaccatatatggggataataaaagaccaaactgccccagctgtggaactttgtttatgtggtcctggggatatgggatgtagagaggaacctctcttgttacgtatgaatgtcatttaatagttactaggcacctaattctgtttggttttgtatatccaggaagaacgtcaaaagggttgaactattcttttagtcctgttcaatagggagtactctaaaacctaacttatagttgaatgttattcttaatacagtgtttattacttcatttataaaatgaggtcagtaataggatagtgggtgagctacttttatttcctagtcaagcatacaaataagagaaagtgctataagaccaaatgtggatagtttgaaaacaaggtaacaagttttctgtatttttactcccctgttgcactaattaacataatattttgaagaggcaaaaacaaaaaatgtcttcacacttaattttgcatcgctcagtctttaaggtgttgatcatggcagaattttagtttcctgctcagctattctcctggtacaactgcccatgggtaataagcaactgcaccaaggtctgcatgaaaacagcatggataatataccattgggtgtctgactgttttgctctgacagcttatattgcttctttttgtcctccccaccccacttgatacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaaggtatttaatgtgtttttataccagaatattcttctaaagtagatatgttaggtgttgttagttcattatccctttaaagctcaaacttacccttgtctgtttctgagcagtggtttgatgacaggctattttgatggattgcattttaagtacaaattttgcacgtgaacaatatttttgaaaaatgtgttttatctatgttgatttagttgcacaaaaaacaatgaatgtgctcttggcaaagtcttctgccaactctatatacagagattacaacttataaattttttttaaggaataaaattttttactgatgaaaaatcacttaaaatgcaaatattcatcagccagcgtgtttatgatagcagagtggttaataaaatgaagcagtgtcagtataaacatgctcagtcatatcacacaagccatattgataattctgtgttaacattcataatgttccagttaggttctattactatattttgcatgactgaaaaattgagtcattatatttaagaaggtgggggatgagggaaaatagaaaggggaaataagtttcctttagccggtttaatgggttttttgtaggctgaggaatttatagcattaagccaccaagacaatttttggtcccagacaggataatttggactttgaggtgtaccatgaggcatttttagacaacctgtggcaagccattgctgtttttcctaggagaacagaatgaggactgctttaagaaaagttttccctgcatttgttaaatatggcacataaaattgatctctctacatatataatcccagcactttgagaagctgaggccagaagttccagaccagcctgggcaacatattgagactccacctctacaaaaatttgtaaaaataaaaaaagctagccaggtgtggtggcagtgcctatactcccagctagtcaggaggctgaggtgggaggattacctgagtccaggagttctaggctgcagtgagctatgattgtgcccctgcattccagccaacctggacagagtgagaccctgtgtcttagacaaaaattgtctgtttcttatgtggtataaaagcaatagcttttatctgcacatttctcaagataggcagctttaaagattgctggattcaaatcccagaactaggtatgtggctatgggccagtggcttgccctgtatgtgctgctgtttccttgtgtgtaaggtagatatcagataataatgttatctaccttacagggccatgaggaagatcaaatgcaaagtgtatattatatataggacacttagtatacatagtgagcaatgggtgcttgaaaggcccttggtgggaagggagaggaggacagggataaacttctctctggtccagtctgtcagtggtcttcactggggaatggatgtctgaactacctttctgactttttaaaaatgtaaatacctgcccacctattgtctcctccctgtctggccacacccatattgagtcagaatatccagggacacagcctctgttataaaacctccaatgagtcagccatatgctctgttgtgagatcaccactgccagtgttagttagtcacacgtagcttatgggggacagtgcaccccagtgaggccacctcgagaatcgtctgcagcagtgactgatgttcggcgtaaggaagtgcacattaagatatctactcggataatgtatttgtcacagcagattcttaacatgtttttatttgtgatgagacttgaaccagcctaatatttaggtttaaagtctctaacaaaactaagattcttccctgctgtacacaccctaccctgttgaaagtgctctggcaagtgagacatcatgatgtacagaaaggacactagtttgcctacaaactgttttgtcattttagagttcatcattatcatcatcattattactaccattatttaattttcatcttggttcatttgtttttgattatttttccttttctttcagttgctatactgcttcactgtgacctgccactacccatgttattgattagtgggatgcaaatctagtagtatctctaaaaattcccttgtggaaaagttaatttgttggaagttataagtaaattataaatttctagtctacctgaacaaacataaatagaaagaatgaatagattcgtattcatatttgtgcaccacattttcctgtcttatggcagtgtagtagtatcttggctcactgtgataaaaattaccagggacttatttccatttccgcacactgccacagctcatgacaatttgcatgcagttaggactcaaatatgaaatttaactttttctccaattataattttatggccatattttgtatatagatatattttttaatgagataacatgctagatactactagttttataaggttattaccttgaggcaattactttaaaatatacactaacatttttaggccacttgtctataatttaacacttttttatataccatatcatatttggagtgctaaattttacaaatgggagaaactaaagtccatagagtttttaaccttttaaggtcacacactgatttgtggccagcctcccaaataaagaccaagtcctttaattgactaaccatcactctcatctttattcatgtctagccacttttgataaccaaggacataaaaatatttcatataatctccacaatgcatgtatatatgcatatatatatcaataccctatttagttacgtttctatatttcatatgtaaacatatttcatacagttaaatatgatactgacatatttattgatgtattaggcatttacatgtgcgtatccattagatatatgtctgtgtgtgtataaatactgccattactggcttgatttagaattagttttatggtgtcctttcacttgaattaagaaatattttaaattgcattttatcactttgtacagattaagattcttgccttctccttccttccttctttacctctttcatcctttccctttgggaaaatttgttgaaaatgcaaatgtggccgggcacagtggctcatgcctgtaatcccagcactttgggaggctgaggcgggtggatcacaaggtcaggagattgagaccatcctggctaacacggtgaaaccctgtctctactaaaaatacaaaattagccgggcatggtggcgggcgcctgtagtcccagctactcggaaggctgaggcaggagaatggtgtgaacctgggagacagagcttgcagtgagccaagatggcgacactgcactgggcgacagagcaagactccatctcaaaaaaaaaaaaaaagaaaagaaaatgtaaatgttggccgggcgtggtggctcatgcctataatcccagcactttgggaggccgaggctggcagatcacttgaggtcaggagttcgagaccagcccggccaacatggtgaaactccatttctagtagaaatacaaaaactaaccagctgtggtggcacacacctgtaatcccagctactcaggaggctggggctggagaatcacttgaacctgggaggcggaggctgcagtgagccacgatggtgccactgcactgcagcctcggtgacagagcaagattctgtctaaaaacgaaaatttaaatgttgccgtattcttgtgctgattcttctgtaaaccaaaagtccttttgaatgtctgtcccaattatttccaggttctagttgaatacttcatttgatttagcatatctggtacttttcttaatggagaattaaaacagaaaacattctcaggaaacaaatgcattaaagtcccatctattttaggatactagttacaatgtcttaaatgagtgagtgtactcatgaccctttgtgactttgcccctgagtttcattttgaatggcagttcaacaacccttgctagcatttgcaactcgaaagtaattaactgctctttcagtctggctacataaatgccttaggatgtaccataaaaggcccatttcatgtctcggttcaaggaatcgcctaatgatatgaattgatgttaaatcattgtgagttaaggcagagctgtttaaagaaatgaaaaaccagcacaaagtttcagtttataaacaacaggaacaatattttagtaaatttacattatgtttgtagtctctgaaggaaaattcattcacagttttgtgtcttattttgacttagtcgagtgagatttccccagcaattgtaaaaagtcagtatgacttatcccaccttgaatataaaaaagaactaagacaaccaactcaacaaagggaaccaatgttgctggtttttagctggtctaggagtttacccggtatcagctcaggtgcaaacctcatgtggtgctagcttctctgaggtcctctgcagcagggaacatggctgtgatcgattagctatgtctgccatgcaagaggatgcaagagggtagcagaaatttcagcaagcaagccagcattccagtaataggatatagcggattttatttttccgtgcatttgtatgagcaaaatgaggagttaaaaacagaacatgccaaaaaggcacaaaccacccatagatacagtcttgaaaaaaatcactagatttatgtttttctgagagggagatttatgccggtagaaatacgttgttttgtacaatgatctcatttatcatgtgtggtatcacccacagtggcatcggcatgtggaataccttcatttggtgcctagagagcctttcaacgggcatctaactaatatactgggagtactatttatgataagattgacaatgatataggaaagagtcggtctcagattttaaacaaagagagggactttcttgggttgtaaagtgtgtttgctagtgatttcttagttttatcaagctgtgcatggtatgttttttgcttcagagctttcctttctattcactgctttagtaagacttactactggaagttccctgaatggcagcagtggtggacttcattatccagaatgctcgattctcctgtagcaaaatgaatccattgtgatagttattttggaaaatgagtcatcctggaaatgtatttttgatgagataaactgtaatttcaggcatgtttttaaagtggtgatacctttggaatataaatataaggaaacaatttaatgatataagaactaatacctttgatgattttgaagacattctcaataaggagattaacaatgaatgcttcctagagcttaaatactactacttgagagaacttttaccagttaactttagtggaaaaaaaaaatcctttgatatctgtgtaactgactcactgtaatgagtgggcttactcattcaagatattgtaattagtatcctaaaacaggcatcactttaatgcatttttgtcttgagaatattttctgtattcaccattacaaaaagtatcagatatgctaatttgcatatgctatgcacggtggttggtgtcctaaaacaaattagggttatgcctacttgaataagcttatgtgtttaaagatggtttatttcacaactttgaatgctatgaaaatctttttcaacatactttttcttgttaacccaaacaaaatttttctcatcaatttattcctgaaattttattatcttctacattttaataattgatgcatgtttagctcttttaagactgaagacaaagcatctgaaagacagctttctggtttgtctttcagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctggtgagtataaggaaccctgcaattaattgtcattgtctttcctggtgttgactggcagcactggggttgatcagatgcctagcacgcttcccctagctctatcaaaacctgcatatgaacagaaaatgcccttagcctgtgaatagtcagctaacagcttgtgaacttggggaccagtaacctccaggcttggtatttctcagcctgcccccaccctttttcctattgttaatttacttcttactctgagtaccacattgttcatataggaattgtctgtgaagtttacagaaactgtctactctaatgatgtcctctaataggtcagactctcttacttgggcccctttgttttatgttcatagttaatgtgccagcagcctggaggggctctggaataacagattccatcttagagatagccttaaagatgtgttttcattgatgagtgtttaatggagggtctgctggcgaatgacttgggcctgtttgtatcataagcaagagtgatttgtgtgctgggtgcagtctttagtttcttagattataaatttctaattgtgctaaacccattccgcaacttaagtaaaagtagggttaatggagagagaagtgtaaaatcttccaaaaatcaaaacctgaatgaagctccccaattagagattgtagtgttgtttccgtatggctactctgtggtaggaagcagagagaaacagtatattgggatatttaagtgctcttttgtcttgtaaatgaggaatttctgtgttgaattgtgtgctgagatgaggagattccataaattgttatggtgttagttaattattcagatagcattagataagaatacatttatcaatgtttcatttctttcttaagttttaaaaatgcttagcatagtcagattctatctggtaggagtaagagaaattattaaaccttaaccattgtagctggtttttaaattttttcttcataatttgtattatactgtttccacaagttcaatactcatggaaaattctgtattttaaaaaagacttttgttagaaaagggaacaggtacttttttcttctggggatacatgctattgagtacagggactggcctgggttagtagactgtgtactttgctgttttgtacatctttcatctgtttctcagaccccacatctgtatcctcgtggcacctttgtgcaggcagtctggtccctggaataagacctgctgttttgatttggtgattcccacagccctgagtggtggctctaaggagaaaggagaatttcccaatcctttctcttcctgtcttctttaaacctcgtcatctcctctatttagttgaataaattccatcattgttgtaaaagttttatcttaccatttgttgcaatgcaaacaatagctatggataatactgcctatatcatttgacaagataggcattgctttcaaatctgttattttaccactgccttatgaattctccagggcaggttctttgatccccataatacagatggtgaaagtgaagcccgtgtgagctcctttctacttctaagctcactctgtaagaagtaagtttagtgttatttcactttagtgttaagaattcctgttttgggcatggcaatatatggtttctctctctctccaaaagcaggttagaatttcattgtttagactggagagagactgtgatctgtttcaattctagtcactagcagccccacctacataatgtttccagtcctgttcttttttttttttttacacatttttgccttttcttttggttttgtgtctgtacatctcagctattgacacattgctgtatatatatccactgattataatgcatgtgtctgtgttttcaggaagccttttgatgctgctgcataatgtgtaaatggataatgctcaaagagacaaattaccttttaataatagattgacagttatttttaagaaatgaaaaccaattttgaattgatatttgtaggcccacactgtgcctcaatgtatgaaacctcacctaaaccaggaagcctaatgacgatgcgccctttcctcttaactgtttgcagcctgcagttggcactgttcgtgatgcatggtctggttgtgccctgtgctggcatggagtcacccttagaaaatggagagagatatgttaggtgaaagggtcaaagttagaaagaagaggggaaggcatgttaggtgggtgaggaaagtgaaaggtgaggaaagtgaagtcaaatgagactttttgctataggaagaaatatggttcaccctttcttgacctggggttttgagaaaatctgcaggtaatatcagtaatcactgattatgatcagtgtggaattttgggaagcaggagcaagttaaagggaaacgtgtgctgtaaattatagactgaaagtttggtatcagtcccaaagtattattcagatggtttgtgagcatttagagtacctaaagagcaaatcatggatttcataaacatgggagagactagaagcattctgcagcaataagtggaaaacatccttggccaggggcaaatggttgatgaatctaacagggtgataagtaataggaataaatctaaatccttcctgtatggttcaaaaaagccaagagtactggcttggaattagagtaatacaatttagcagcaatatgtatgaagaagagattgaggatttggcttcaatgcaaatgaatctacaatatcatccatcttgtataaattatccctgtgatgttagtgcctcaccatcccctgcaaaaaaaaaaaaaaaaaaatcctaaaataatcttaggttgcatcaggaaagcaaaatgcccatattgaaggaggtgatagccttactctaccagtgctgtttaggcttctcataattctcacatttatttctagttcctgctttttaagagagacagcacaaaatagattttgcccatggggagagcaatcaggataggaaaggatgtggaacctttcttaactaatgaggaatggtggaaagaactgagaaggggatggggaggaaagggcacctgtgtaaactcgacaagatctgagtgagtttcttgtggctgatttgttcaagcataacctgacatggtagaaattgatttctatattcagaagaggattgagctggttgaccttgaagatctcttcagtatgaaattctatgattcatttcttgtttgctttctgatgagatgatccaccggatatttctaccctgaaagcctttcagtttcatttttatttcatccttgtctaaatactccataatcatgcttatcaagtactattctttgggcagtgaaggtctgctattacatttccaaaaatccgagcaaagggggagaacgtataagtttttattacagtgaagtaaaataaatttgaaggactgactcactctgagatttcctgcctgggttttgtgctaaaacatcacttcagttcttgaaataatagtgcttttgggtgctagagccagagtcagcggttgagaacacaggctctgggagcagctacctgagttttagtgttggctctgcctggcactagacataggactagagaaaaactgctaaccctctctgggcctgagttgccttatctataaaacagaggtgatgataataataatatgtgtttcattgttttgttgtgagccttaatgagctactgaatatcagttgcctagaacaaactcttacatatagcatgtggtcaatcagagttaactaccatttaataaatttttgtcttttaatattttcattcagaagaattagacactggctacctcattacccaatgttttagaaatattgcttatctgggaaatctaaaatctgagaaccatgatttctattgtgggctcatagaattctttgcagttgtgcattatgttctcatctgttaaatctgtttattttggccaagctctgtgttttcgtttctgtgctgcatcagtgacacctgtcctatcattttttggtgacacccatgaaactgtatttagcttcttgtattaaaatggcaagatcactatttattacccatcattcctgtgtggcttgtagacacagtctcattacctggttggatttctgcaaggattgtattgtaacacacttccaaaactcttgcttcttatgcttctgaaaattatttccaaatatatgcacaagctctccatgcaagaccttgatccaatcacatagcttccctgattccacatcttcatctctaatttggggcagcaacacctgccctgactgtatcagtggtgtttttgaagatcagggtagattttatctgtaaagacatttttcaaagtgataaaatgccctgtcaatatgggttattgtaaaaagtgattatagtcaagctaccttcaagctttatatacatatccagttgttttccaactttgcagttcagctatagttgggtaacttcagagagttaaaattacttcagcatccagttaaacaaaatgcaatttagtttgtgatttctaatgtatcctatattctcaaattatgtgcagcctgtatatcataagccattgaatagtagctacttgaaacagagaaatgggtgatgttgttagattaattttcacagtgggcttttttatgtgttttatttggagatacttctttttatgtattctggttattggttattaactgtggttaagtgacttgccaataactggccccaggagctaacgaaggattattataaactaatgactaaacaattaagattggtgagagtgaagcaaagcttaattaaaatgtgtcctttagcattaatatacctaaaaatatttgaaacaataatgattgcaccttaaaaaattatccataagatgcatattgagcatccgtatttgccgggcactattccaagccctgccagtagagtgacaagatttctgtcttcagaacttatatattttggggtactggaggaagggagtatataggcaacatatatatatatatatatatatatatatatacacacacacacacacacacacacacacgtgtggccaaggcaggaggactgcttgatactaggagtttgaggacagccagggaaacatagcaagactccattgctacaaaaaattaaatgaagaataattagctgggcaccgtggcatacatctgtagtcccagctacttggaaggctgagataggaggataacttgagcccaggagttggagattgcagtgagctgtaatcacaccactgcactccatcatcgacagagtaaaaccctgtctctaatatatatatattactcacatacctacacacaacacatgtgtatacaatacagtgtcagataaatgataaatgttatgaagaaaaatagaagaagggatagagaatagagaggtaggagatgatattttttattattttactatgtttaaatacacataacaaaacttaccatcttaacgagttttaagtgtacagttaaatcatgttaagtatattcagccaatctccagaacctgtttctcgtgtgtgggtacatagtaggtgtatatatttatgaggtacacgaaatattttgatacaggcatgcaatatgtaataatcacatcggggtaaatggggtatccatcacctgaagcatttatcctttgtgttacaaacaatccagttacactctttgttatttttaaatgtacaattattattgactcttgtcaccctattgtgctatcaaatactagtttcattgagaatctttacatcttcccaaactgaaacactgcatccactaaacactaactctccactccccttccccataaccctggcaaccaccagtctcctttttgtctctatggatttaactatttaggtgtctcctataagtggaatcatgcagtatttgtctttctgtgactggcttattccacgtagcataatgttctccaggtttatccatgtcatcacgtgtgcgattgcacctttttaattatgctgataattgaattgtatatatttgtttcatataattctttgtgaactacttagagactataagcactgactttggcattcagtttaaaaatgcaccttctttatgacttagggaaatgtttactagtaaagcatgtactgctgggttcctgaggagtccaagtatgatcagttatcctagaaatgttctgtcctaatggcagagccatcccatccacagctagcctgctgcttgctgggaataggagtgatgtattagaagtctttaataaatgtgatgtgtaagaagtatacacatttttataaatgtgattttttataaaagcgatagtgtttttataacttccatttttttaaatgattgagtgagttttaatatctgtctgcgtagagctatatatttgtctgcctagtatctgcctagttagagctttttacataactataataaaaacttggaatatgtattacattaaaatgtattttgttgtacttagatgctttgataacatgcagtaatagctatcatatctgcagtattttcagtggcagaagatactggacataccttgccactatttggagtcatttcacctttcaatctttgttctgtgaaacgttcagtgtctgcttatcccatttgtgatatgcagttttgtgaatctcctatttttttgtgatgacagtcgtactgttgcacttgaacagatgtatttgtgtagctttcttgtatgcctgccttgttcttctgtgaacaaataacatacataaacaaacatatatttgggggtattggagggagggaatatataggcaacatatatatacatatggaggataaacaaaggattagtgttccttcacagtaaggacccaacattcccgactgtgggaattttgtactaaatacaaatttacggtgttgtgttttcttttatcttataccctgagaatatctctcagtgtgccttatgtagtagcacaccctgtctgtcatacccggtccagtctaaatgtcactagatttaggttcatattggttttgaaatattaattcgctgtgtttgcctagtggtaacactggagtgattcgttttaaatatatctgaatgagattctcatgttggaaatgagtagtgacaggttccttggcaagggggcattacatgaagcccaaactgcaccatgcctgcattcaaccgaaggctgacctcgctgctatttatttattatttttagtttgtttctgtgggaaaaaaggaaataattctggttgaaatgggaataatctgaaattaaaccctgccaaaacctgatgtattttctcttaaatcaaagatagtagtatttgtgttttctgtacagaattatcactggcattgcaataagtatctggacttacagggctgaccctcaggtacctggggccatgtgggagctaatctaacaatggctgttattcggaaggcataaaggccaaagacctaattgagtggagcataatttatttttgatttaagtttatttaccagggaagaaattaaaagtgttctaattctaaaacagttctgccacagggcaacatgttttaatgaattttcaatacatgaagccattaaaaacctttttaaattatgaacattaaaagggcatgaggagtaccttccctattatgctgcagatgtcagatactttgggtcacgtcaccgtgtacataggacaggggcatatcagcaatgcagtgtcttttttattataatatattcagtcccttccttacaggtgtttaggccccagagattctgtaattaatacctaaacctcaagttctgctgcccttaaacacggattcagcactttccctgtgcttgaaccctaaggcagcagcagaggggtatagaatagaactgctggagcaattctgcatgagaggttcagaagctcctctaaaaagtgtggacagatggaggtggttgttcatagagttatccagtgactcttaaggtgttgtgactctctggaaggtgtcaggcaggccctttggctgtgaaaaatgagcgtgctaacagtgctcctcaacttcctctaggcttgtttttgaaatctttgtaggtggcttcttgtgtagctttgaatacactgaggaggccaggaaaatcaagggaaagagctggagattgcagtcgggggcctgtggcctagtcctgctgtccctctaatgagccatctaacatggggaagaatcacagaaccgtttcaggctgtattttgtctgtctatctgtgaggggcttgaccagcttccttgttctagggatctgacaggtcatcagtcgctgtcagagggggtttgctatgggaaaaacatgattgttgttagtatgaggccttgtctgagcaccagctacagctgtgagcgtggtcctgcagcccctgacatgtttgaggatgcctctgcatcctgctgcaatatctcctaggaaaggaagacatctactaaatctgctttgaacaattcttaaagagaccccaggccatcttaatttcccccaaatctcttatatatttagtaagaaaaaaaattattgatgatgacatgattaattttttattagagcacatgccttaattctttatcacatttataatgtggagaggttatattttatgatctttatgttagcatttatactacactggggtcctatgcataatctgtatgtactgcatacgtatgtgttttaaaaggacttggagcataattgactgctttaaattatcatagaggcttatacttttgtgactgcctttgtgaacattcagaggaaacagtgttcccctgggaaacttctttcactttatagtctgactgacttgggtgggtgaatgttggttctggcacaaatagctaaaaactctcaacaaacgagttaaccttgctattcctagtttcttaatccttctggtcagtgtttttttgttgttgttgttgtttgtttgtttgttttaaacagtaccagcattgtcttcataatgctgctgggaaaattacatatgctaatgcaggaaaacttgttagcagagtactttggtcacctggtggctcccgaatgaatcctaagtaggtttactattaaatgctgatacaaaattatgttttgttaccacaagggaaacacactcctatggtgaaatctttcaataggacttttaagctgaatggattgggttgcatttgacacatatacaagttgcagtttaagcaaaacaaaaaatatgtatgtatcttcaaggtagtgccaagaaaaagaaatgatcacatgttcactggaacctgggaaaactttttgttttgcctccttaaggtgtggtcgggatagaaaatagcatagtgacccagggtccctgttctgcagggtggcaaaaaaatagaataactgcaaatacttcatttacatatgagacactgttatgctgtggttgtggatgtgttgcaattattagtgacatgataagtgtttttgacacttttaactttttggagggttctgcccccactctaacactttttttttttttttttttttgagacggagtttcgctcttgtgtacccaggctggagtgcaatgtgcaatggcatgatctcggctcactgcaacctccgcctcccagttacaagcgattcttctgtgtcagccccccaagtagctcggattacaggcacgcgccaccacgcccagctaatatttttgtatttagcagagatggggtttcaccatgttaatcaggctggtagtgaactcctgacctcaggtgatctacccgccttggcctcccaaagtactaggattacatgcatgtgccacctcacccagcccactctaacacttgtaagtttatccagaggactcaaagcttgatggcagtttgcttagagctagaaggctgaggtgcgctgggagacatgtttctcttttgctcatttgcacacataccccaggaaggtaggtgaacccttattgagtgagattggatggctggggtcttggtggtgtggatgtaaggaattaaagcacacaggtaagattgttcaccatagggctgcttgtgagccaggcttaccttgcatccagtgtcgctggcctcagagcgggcaaagccagtcttagcctttgtcttctgaacattttaggaaaagttcagtcactcttgacttaccaggtatgttatgtgttatgtctggaaccactgtcatgctttgggaagcaggtggattttatcttgacctcatatgtcctgtgtacttccttctatccatgctcctctcagcacatccagatgcattctcttcttattcacccagctctcagtttattcgtcctcattaacacgaaatgtgggctcactgggacatactcagtggcatctggcctccagttaggacttgccaacttcatctgtaaggataatgctgcttgtgcttttaaaagctaaataagaagtaagataaatgagagctaaaacttgtatagtcataacaacagattatgaaagattgataatatgtcaaaattttagtttatgagggttagccatgttcctttgtgtaacacttttataaattaattttaagaatataaataactggtaattacctattagaataaactgcaagtgaatagaatgctttaaaaatgaataacgcatataaatggaatttaaattataaatacaagaaattttattaggaagtatagttatacctgttattaaaatagaaaagataatagagctgtttgataccaaaattgctgatcctccatccatgttattaccattgtggaatgagtaatataagtaatgtaactattcaggtaaaatattcccattgaccaaatagcaatatttccttcttatccatctggacaagtgactgtaaacacatatttatagtcagcattgaaaccctttctagaaggaggagccaagatggccgaataggaacagctccggtctacagctcccagcgtgagcgacgcagaagacgggtgatttctgcatttccatctgaggtaccgggttcatctcactagggagtgccagacagtgggctcaggtcagtgggtgcgcgcaccgtgcgcgagccgaagcagggcgaggcattgcctcacctgggaagcgcaaggggtcagggagttccctttccgagtcaaagaaaggggtgacgggcgcacctggaaaatcgggtcactcccacccgaatactgcgcttttcagaccggcttaaaaaacggcgcaccacgagactatatcccacacctggctcggagggtcctacgcccacggagtctcgctgattgccagcacagcagtctgagatcaaaccgcaaggcggcagcgaggctgggggaggggcgcccaccattgcccaggcttgctgaggtaaacaaagcagcctggaagctcgaactgggtggagcccaccacagctctaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggcttgagaactacgtgaagaatgcagaagcctcaggagccgatgcgatcaactggaagaaagggtatcagcaatgcaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacacagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcagatctctcggcagaaaccctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcgctaaacatggaaaggaacaactggtaccagccgctgcgaaatcatgccaaaatgtaaagaccattgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaagagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacggaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacaaaatgaaggcagaaataaagatgttctttgaaaccaacgagaacaaagacaccacataccagaatctctgggacacattcaaagcagtgtgtagagggaaatttatagcactaaatgcctacaagagaaagcaggaaagatccaaaattgacaccctaacatctcaattaaaagaactagaaaagcaagagcaaacacattcaaaagctagcagaaggcaagaaataactaaaatcagagcagaactgaaggaaatagagacacaaaaaacccttcaaaaaatcaatgaatccaggagcttgttttttgaaaggttcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagctcatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaatcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcatgaaaatggccatactgcccaaggtaatttacagattcaatgccatccccatcaagctaccaatgactttcgtcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgagaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacattagacctaaaaccataaaaaccctagaagaaaacctaggcattaccattcaggacataggcgtgggcaaggacttcatgtccaaaacaccaaaagcaatggcagcaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaacagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaagaaaaaaccaaacaccgcatattctcacgcataggtgggaattgaacaatgagatcacatggacacaggaaggggaatatcacactctggggactgtggtggggtagggggaggggggagggatagcattgggagatatacctaatgctagatgacgatttagtgggtgcagcgcaccagcatggcacatgtatacatatgtaactaacctgcacaatgtgcacatgtaccctaaaacttaaagtataattaaaaaaaaaaaaacattaaaaaaaaaaaaaaaggagagaaacatggaatagaaaaaaaaaaaagaaaccctttctaaagggctttttagaaatacattaacatttgaaaaaatatacatattaaaatatatttctgctaaatattatgtattgctattttgctattctttagctcagctataatgctcctaatttgagtaatgaattcatgataaataacattttacttgttaatgtttatatcttgttaatggcctttgaaaatcactgaagtcatagatgtgatataagaaggcaaaaaatatagaagtatatgatgaagaaggtaacagattccctcctctttcagtccctttgccagaaatcatcatcgttaatccttttgtgtttatccttcaacatctctatgtaagctcatttaggtgtgtaaatatcaatatatgtcctcagtcccttccttactaattctaacaaataggattatattgtacatgttattcatcagcttgatttcacatctgccagtattttctgaacagctctctagttgttagagtctagtacaatacatgttatataaacatatataacccacatataatatatataacccactcttattagcagctgtttattcttttgtaatatggatgacctaatttatttagcccctcctctcttgatggatagtcaggttttgttcattaataaagggaatatttcagtaaatatctataaatatatatagtatacaattatttcgatttctataagttaagtttacagttttaaggtagaattgcagggccaaagatatatgcatttaagactttagtaggtgctgtcagattactttctacaaggctctatcaagttatgctctaccagcaaggtgtcacaatgtcagggtcctcaaatgctttcgagcattgaatattaatgatcttttaaaacttaaaaaatcaatttattggtttttaaattatatgttcttgttttaattcgcatttcctcttttccatgcatgtattcagtatatttcttcctcagcaaattgtccatttctgtccttaggatgctttctaatcttttcctttttaaattgtagggatactttctatagtagggttatttaccatttgtcatatgttttcaaaatatttttcttattctaccatttgctgttgactttatttgtggtttattatagagaaatcttcacattttatgtagttaaatttatcaattatatcttttagggctacccatactcattaatacacacaataaatgtatcattggaatataaatcagtccaaatatatattaatttatcttggtagatgtctacatatgcaattatgtttgctaaatgacccattgtttcttcctaatggcttcttactttctagtcttgttttagaagatatttttctacatttttgttgaattttttttagaacttatttttatacttagagtatttagtcagtgagattctggtaaaaaaaaaaaaagacttgaggggaagactccagggctgaggagccttctggggacagttcctttgcacttcaatgatgcgcgaggagaatggtccattctcacctttgcattttgcttgacgtggagcctgagaatgtggcaggcagcatgtgaccacagggaaaccagctaaaaaggcagctgctatgaaagccgagtaggcacaactgagtcacagctcattttggtttgccccatttgtttattcatttattgatttagtctaatatttttgagcatctgctgagaggtattctcctaggctttgaggatacagttagtaggcaaaactaacaagtctcctgccctcctggacacagctttctagtttctaaagttctccattggtgtgcagtgtgtgcacacatttacatgaagcaaagcttacagagattcccagagcagttgtagagaagaggttctgaaagtcaacataaatattaggtcagacaggagcatcacaaataaatggttttaatccggacgttttgggctgcaagtaatataaatgcccctataggctaacaatgaggaaatttattaactcgcattaatgggaaatccataggtaaggcaccctttacagtttgttgttcagtgactcagtaatcttcccagggacatgggctctttccaaatctctgatctattggcctcaaccccaggctggctctctttgtggtgataaggtgacatttaaaagcaactggggaaacatgctgtgttcacatctaacgggcagagaagaatagttccccagtcatagaatgtaacttttttctttcaatcttttacgtcaattaaggaccgataataactagcagattttcatggattgattgccttagtgcacttattcttaaactttaacgtacttcagtaatgacagtgtatatcagaatcacctggaggacttgtgaaaagatcctgactggcttctatcccatgtttatcattcagttggtttagggttggatcaggaatctgcatttttaacaaattcctcagtgatgccgatattgaaaaccactgatttgcaatgatgaagatgcatccttgcaccacacacctattagaatggccaaaattcagaacactgccacacatcaaatgctgggaggatgtggagcaacaggaactcttatttgttgctggtgaaaatataaaaataggtgcagcctgtttggaaaacaggtgggcagtttcttgcaagagcaaacctactcttactgtacaatccagcagttgtgtcctttgacattcacccaaaggaacttcagacttatgtcaacacaaaaacttgcacaccagtgtttatagcagctttttattcataatttctaaaacttacaagcaacctagaggtcagtagatgactggataaactatggtacattgagacaattgaatatttttcagaaatgagctattaagccatgaagagacacagaggaaacttaagtgtatattaagaagtgaaagatgccaatatggtaatgctacatactgtataatttcaactacggtaaggttccacataacagtctttcagtctatgaggtctgcatataagatggtagtcctttaagattataacggagctgaaaatcacctagtaacattgtagccactgtaatttcatagctaatgcattaccttttctatgtttaaatatacaaatactctcattgtgttacagttgcctacagtattcagtacagtaacatggtgtatatgtctgtggccaaggaggagtggactacaacatatactctccgtgtatagtaagctatcccatctagatttgtctaagagcactctatgatgttcacacaatgatgaaatcacctaaagatgtttttcttagaatgtatctctgttggctgggctcagtggctcacacttgtaatcccagcactttgggagcccgaggcaggtggatcacgaggtcaggtgttcaagaccagcctgaccaacatggtgaaaccctgtctctactaaaaatacaaaaattagccaggcatggtggcatgtgcctttaatcccagctactcaggaggctgaggcaggaaaatatcttgaacctgggaggcagagattgcagtgagccaagatcgcgccattgcattccagccgggagacagagggagactccgtctcaaaaaaataaaaaataaaaaatgaaaaaaagaacgtttctctgtcattaggcaacccatgactatatatgacattctggaaaaggccaaactatggatacagtaaaaaatatcagtgtttgacagaagctgggagaggcagggataaataggtagatcatagaggactttttcaggtagtgaaattattctgtatgatactatagtagtggatatatgccattatatagtttccaaaatccatagaatataccacaccaagagtgaatcctgatatcaattctggactttgtgtggtgctgattgttcgttggtacgatgtgttgataatgtgggaggctacgcctaggcttgagggcaggggattgtggggaatcttcatatgcttcgtgccatgcaattttgctgttaacgtaaaactattctacaagataaagttttatttatgaaaaaaaaagagcctcacccttgagtctagggatggaatgagccatccctgagccacgaactgtggaagactaaatcactgaacaaaatcaagggtttggggaactactggaaaggaagagaggaaaatgaatgcggagtaagcaactgacagtggccagtataaaggttgatatgagttgaatataataattgtagtcaaatgactactgagaaattgggtaagatttatttcttttcttgagtaaatgtattcgtttgttaagtactatcagtcagaattgagatctgcaaagaaacttgctgtttttttttttttttaaagcttgattttaacaataaaaaaggttgattgtgacatggatattagaagatttaactatggggatcaattgtaaatccattcctcatatttagcatggatctcaccttagctccagttataatgaaataaattaataatacctgaattgtttttgttttgttttgttttgagacagagtttcgccctttttgcccaggctggagtgcaatggtgtgatcttggctcactgcaacctccacctcctgggatcaagtaattctcctgcctcagcctcctgagtagctggtattacaggcacctgccaccacgcccagctaatttttgtatttttgtagagacggagttttgccatgttggccaggctggtctcaaactcctgacctcaggtgatctgccttcctcggcctcccaaaatgctgggattacaggcgtgagtgaccgcacccagcttcctgagttgtttagaggatgttggcatgcacttcaccgtaggtccctcacacgtgcacaccttgcaagcagaggcaccgatggcctttgttctggtccagggaacagccttggaatatagagatagtgtctctctctggagcactggatgagctttctagttgtccaacataagaaagataatgtctctcttgagagcaaagggtaggcaggtttgcttactgcccataataagagatttggttttcctaactcagggctctttagctgtgatacaaactgacttcatgtgtagcatcaacttggattcctctgtattctcccttgagactttgggggcaaggggaaacaacaagaacacaaagctcatgttgctttgtgcatgctttgctttgttgttcataatacagttctatgtctctggcccaggagtctcctgtcttctgccagcatccatgaaacagtggcaggcaaactcgtaggcttgaaacttgattaagtctcagactcctcacagttctggacagaatatacttgaaagaaaaaaactgacttcttcataatttcctctaactcaaatcttgttgactgggaaactgaggctgggagtaaggaaacgacttgtgcagttttgcagtgcgtctgtttacagaagtgcctggcaaggccactgttaccaacaccctctgataactggtgcctgctcctctcagcgcactttgcttttagcctcactacaaagccagcctctgtgagtctgcccaatagctctggcttagggttgatttaaggatgggattggacagtaagaatctttcacttcaagacagagccagataaaactgacatgaaccaagtgaggtgactagtcgtatagaacatacagatataagctgacagggttattcaacaccgagagatatttatctgccagggtcatttagctgtaactctactaagaactagaatggaaaaccagctgaccatctccattgtttttctattttgtttgcatgttgctgtaaacagtttattttaaattataaaacgggactctatttgaccactaaatggactcaatttgaccattaaatatgcctcgtggcccaaaggatatctagacttagtgaagtggtcacgttaattattttgtctgcaagtaagctcttggtgagcctgccatgctaacttacgaggcgaatgttggtaacactttctctgtttgacacgttagcttggcatataactttttcttttataaagaatttctttgtagtactgtgaaatcataactcttattctatactttatcaatattatacgtggctcttactacataatgatcagtctcagctttaattcttaaaaaggtttatatcataatattaaggttaggatatgaaacattatgaagggtctgtgagcacgtgacagagtattctttcatataaattccaataatgttatatgatttttttttgaaaactcagacatttctttccaccctcagaattgcgtgtagcgacctttaaaaaacagtgcttcaccatggagctgacagaacttagctctgggctccccacctgtattttcactgagccataggcccgtggcaaagaaaattgaatgttgcctgggtgaccttatctataagctgggtctttaatttcattcctggctatattgaagctatagctgttgccaaagtgtctgaaaacaaaagggagggcagagagatgatttctgcagatgatctatgtccagccaactgaggaaatcactgacccgccactgtagagtcctttgttctggccacctttgtctgaccctgtctaagtatataaaaaacacagaagcattcccttctaggatagaatcctggagtttctaagattgacttccaaagacatcaacaatatgggtttctatgtacataaaactatttgggatttgggaggcagaaattacaatagttggcaatttgtaattcttaccgataggttcattggttggatacctttggaaacattttttgaaacgcagatctaagctaaacatctcttttgggcagattatgaatctaaggtgttttatttgagacaaatggttaacgtgttacatgacatatttattagtccaaatgaaaaatactcgttgaaattaaaccttcttttcccaaagatcgtgcagagctcataatatgtatttgcattacatatttttttccaggagtttattctcaggaaacgacatcgtttttaatataatagaagaaatgaaatacaaagtcgaaaaatgagactggaaaagcccaggcactggcattttgtgttgtgctaagtgttccctcgtcaccttgcagtccgctggcagaagtgtggagcggacacaggagaaggctgggatggtgcttggaggctggggaacaggctgcactggcatttccagtgaagtgacttgggacacacttcctctttctgcctgaaaaggactgagggtgaggggccaccttgtcccgccctgggttgatccctcccagatgcccacatctccagggctgtgtcttcagcccagctctcgctcctgcctctgggcatgctggctcctggacaccccacatggattccctggatatctccaactcctctgctctataatgcccctgagcgtcttactcctcccccttggccgtgcctgtcttcgcagccccacaaaatatttttttctaccagtgtctcttacctgaatcagtacttcaagctgcccactcattttggccagaaacctgaattgcccttgagtctttctactacctcacctctgcaccacatcaatcataaatctcatgtactctctttcctaggtgtcttggtgtttcggaggtttctctgcaatgctgcttgcctagcctcagccactactatggctccttattgcacccatgttcactctgctgccccctagagttgctctaccctacagccagatatctttttttttatttttagtatttttagagacagggtcttgctctgtcacccaggctggagtgcagtggtgatcacagctcactgcgcctcaacctcctgggctcaagtgatcctcccgcctcagcctcccaggtagctaggactacaggcacatgccaccacgcctggctaatttttaaaatttttgtagggactgggcctcactatgttgcccaggctggtcttgaactcctgggctcaaacagtcctcccacctcggcctctgaaagcactgggatcacaggtttgagccactgtgtccagccatcagaggtcttttataaatgcacattcagtcctaccatttctaagcaaaaatggacagtgagagactccttaacacacagctcccctatcctcctccccgttgcctgcttcccgtttctccataattcttctcacagccaggcatgctacatgctgagatttcatgtgttgatctgtctccctccactggagcatgagctggcctggcagggcttttgtctggcttgcttactgtgcctgagttgagccatcgaaggcactctgggaatggaaatgagtggttggcgcacattcccctatcatctggctttggccccctctccatcagttccccttgtttttccccactgctttcttagcttcagccttagcactttcattttcttgagatcaaggtgctcttcctgcttatgaagcaccatgaaggtagaatcacacctcctctcccgctggttttctactactcctacctctctgccccccgcccaccaaccccaccttcactctctacttaaatatcccctcctcagggaggctttccctaagcaatctctggacaatggagtcgtgcattcccttattattttttaaacatctaatatccctgctacactggaagcctgaaatcttcaggaaccatatctgcctgtctatgaatgcacacacagcacctagcctagtgtgggctttcaacagatattttggagactgagtccatgtgattcagtctgcattagtagtgcctaatcaacaatgaatgatcattatcttttcctccatggagccacttacatcaattaaagtgtgaggcagtctcccctccaccccaacccctatacttttcccacctgatcttccaactgaagttctctggctcccatacttgccccggaggaatgactgtgatgtgacaggacaaagtactgaaatatatatgagtatgaagtatatgcagtcatgcatccttaagcaatggggctgtattctgagaaatgcatctttaggtgatttggtcattctgtgaacatcatagagtgtacttacccaatcagaggtagcaaggccagctacacacccaggctatatggtatagccaaggctcctaggctgcaaaattgtagagcatgttactgtattgaatgctgtagactcttggaacacaatggtatttgtgtagctaaacattgaaacgtagaaaaggtacagtaaaaatatgatattgaagataaaaatggcacacctgtacaggacatccaccatgaatggagcttgcaggactagaagttgctctgggtgtcagggacctagtggtgagtgaatatgaaggcctaggacattactgtacaccactgtagactttacaaacactgtacacttaggttacattaaatttatttttttaaatttgtgtctttaataataaattaaccctagcttccttaaacttttgtaccttagaaacgtttcaatgcatttttcattgtttggctcttttgtaataacacttagcttaaaatacaaacacattgtacaactgtacaaaatattttcttttttatattcttattctataagctgttttctgtttttaagtttttactttttttttttttttttacttttaaaacttttttgatacctaaaacacaaacacacattagcctaggcctactctgggtcaggatcactgatagcactggccccacctccacatcctctcccactggaaggtcttcagggggcagtaacactcatggagctgtcatctcccagaataacaaggccttctgctgtctacctcctgaaggtcctgcctgaggctgcttcacagttaactttttttttttttagtataagtagaatgctgtaaaataagtattaaaaaagtatattatagtaaaaccataaaccagtaacatagttgtctattatcattagcaagtattaggtactgtacatgattgtatgtgcttgacttttatatgactggcagtgcagtagatttctttacagcaccatcaccacaaacacctcagtagtgtgttgtgctatgacgttaggacagctaggatgtcactaggcggctggaagttttcagctccagcatactcctatgggatgacagtgatatatgtggttcgttgttgatggaaatgttgttatgtggcgtgtgatggtgtatctttctctgaggtttattgaaagtcaggaagcttctacaaggattgtgaggcctcacattcatgactcagggccctgaccaggccctcctgatagctcctatttggcactatctgcattcgccacgattctggcattctcttccctatttccatgtctttttagtgctgttcactttctcagaaatgccttttcctcctcttttctgcttgtcaaacacatgtactttcatataaagtaggggtccccaaccccctgactgccaaccaggtacacctggctgcacagcaggaagtgagccagaggcgggcgagcatcaccacctgagttccacctcctgtcagatcagcagcggccattagattttcgtgggagtgcaaaccctattatgaactgtgcatgcgagggatctaagttgcaagctccttaggagaatctagtgcctgatgatctgagggggaacagtttcatcccgaagctatccccccaacctggttagtgggaaaattgtcttctacaacactggtccctggtgccaaaaagtttggggcctgttggtataaaggaacaggaatgcctgttttactcaccagacagagtctttgccctgcccctgtcctgccatggcactttcaatataggcatttgtctcataggctagaactatgctttttgtctctggctttctcatcattctgtgtaagacctaaatcttacctttttttctcttgtgcgctattgcctggcacactgtagaagcccaggaaagattttaaacatttaagtaactgctcctagttctgtctcaatcagaactaggagcagtcctactttctacttgcaacatatttgcctgtcttctttgccactaaccttcgttgagaaaataatctgtgaaaggtcattatcaagttatctcagcacttatttaatgtgtgtttagctgctttagctgctttactgtcacataaaaacgtgccatagtaaaataaagtaacaaagctgtcaataaaaaccccacttccactcaatatttaatgctaaagagccagagacatttgagattttcatccataatgctaaattgatgttatcaaggtcggtagctgatcaatttgccttgaaatactgttcacttgatgaatgaaactgtaacttgttagaatatggtgtgttctggaaaacaatgtgttttagtattctttacataatagtctccaaataaggtcaagataggaagcagcctcatgctatgaagcacctggtgtttctaacaaagcaagggcagtgatgactgctgatcagccaccatagtcaccaaagagtcaagaaaaatgcaaccaccttcttgagggcattagagtttataaggtaccaccacatccgttttcttacctaatcctcgtaatgattgcaagagagataacagtatcctcattttccaagtcaggaagcttgggttcaaagaggttaaatggtattcagaggtcacacaaagctcaatacaatcccaagtgtttcctgactcccaactgggttctttctgctatgatgtagctacttcattgctacaggactaaaaattgaaaatctgtacagctgtattaaatatttagaaaatctaccttcgtgattaatattttttaatttttttaatttttaatttttgtgggtagtatacatatatgccccatatatatatgccccatatatatatatatatatatatatatatatacacacacacacacacacacacacacaaacccccatatatgtatatgtggggtaaatatatatatacacacatatataattatatatatacatatataaaaatatataaatatatggggtaaatataaatatatacatataaaattatatacacatatataaatatatacacataaaattatatacacacatataaatatatacatataaaattatatacacatatataaatatatacatataaaattatatacacatatataaatatatacatataattatatatacatatataaatatatacatataattatatatacatatataaatatatacatatatatacatatataattatatacatataattatatatacatataattatatacatataattgtatatacatataattatatatacatatataaatatatacatataattatatatacatataattgtatatacatatataaatatatacatataattatatatacatataattgtatatacacatataaatatatacatataattgtatatacacatataaatatatacatataattgtatatacacatataaatatatacatataattgtatatacacatataaatatatacatataattgtatatacacatataaatatatacatataatagtatatacacataaatatatacatataatagtatatacacataaatatatacatataattgtatatacacataaatatatacatatactggtatatacgtatataaatatatacatatactggtatatacgtatataaatatatacatatactggtagatacgtatataaatatatacatatactggtagatacgtaaatatatacatatactggtagatacgtatataaatatatacatatactggtagatacgtatataaatatatacatatactggtagatacgtatataaatatatacatatactggtagatacgtatataaatatatacatatactggtagatacgtatataaatatatacatatatggggtaaatatatatatatgtatatgtatatatggggtaaatgagatgttttgatacaggcatgcaatgcagaataaccacatctcggagaatggagtttccatcccctcaagcatttatccattttaaaatgtacaattcagttattattgatgatagtcaccctgttgtgctatgaaatagtaggtcttattcattctttcatgattagtatttaaagagtaaactttaagtagtgtccaggggataggtggactctagaatagttgtagagtttgaatgtacacaaaccctaatgcaaatgagttatttcagagtcgggatacatttcaaaaaactccaactgactgtccctgacagtgtaaaactttcagaattcctcagaaaagtaaacctttgtctcaaaattatgctttgaagtttgaagataaaaggagagctgtctaaggcccaatgctcaaatagatggactaaaaacattttagaaaaattctggagaggttatcagaatttgaaatgaatgtgataacagatcccctatagttcaagtcctcagtagtgcgtaacaggatttaaagcagcttagctcagactaacgcatacaagaaattaaagccttttacagggttttgaaatgtgtttcattttctcaggaaagagaaaagcagattccttacttttatgtacctggtcacttaggaatattttgtactgtatggttctggtccgttcttagagcaatacagagaaacacagtagaacttattcaaatctgtgattgccagctgttgcctgggcagtgtttcccattgccttttggtgccagaatgagctagcattgttttggtgaggattggaagcctgtgccctgacatggagaacagtacatgcacatccccagccaaggccggtgaatgaaggtgtcatggtctgtgagaggttcagccatagcacctggtgctagagtaactcaacatccatatgcaagtgcagggcaaaattgtgaactaaaatggcctaaatttagcaaatgttttaaaaattggaaaatatctttatagacactcatttataatggaggtctgagttggtgttttggactgaatttgtgttcctcactgattcatgtgctgaagtcctaaccccagtattatagattgtgactatatttggatagggtctttaagaggataattaacttaaaatgtgataatccattatgaatggtgtctttgtaagaagaggagattaggatacaggcattgtacagagagaagaccatgggaggacacagggagaacacatcagcaagccaaggagacagatcccagtagaaagtaaccctgccaatgtcttgatcttgagcttccagcctccataactgtagaaaatgtgcttattgtttaagccactcagtctaaggtacttgtttatggcagccctggaaaatttattcagctggtaaccccaacatggggactgtcagttagacacagcgcttttgagctgtaactgtcctccaaaaatctgtctttaattctctactgcccacagtagatctcttgagaaacaagtgtaaaagtttatgtaaacccttggtcagttgtgtttaaatattgttttagaagaattattcttacagtcagaggaaagttgacttggttatgatgatgttagtgggttgaagctggctaagccaccagtaagggagcaagtggagaaacatttattatctataattgtttttaaattattaataacataagctcttgcttcagaatacttaacgtataacagacatgagaatcagtgactgggggaagattagtcatgaatgtttcttggcaggctccctgtcattccactaggtccatgatctgcggtgagtggagacaaacctacagcaaaccgatctctgttattctcacagggataaaggatggggaatggggacccctagactctccagggcacagctggggctgatggtgaaattaacctgggaggtgctttcatttctattttatctggtttagaaaactcataaaaagtaagtagatttaatatccattaaatcacatctaattttaaaaacctactaaagattaaaaccattttttcagagtcagcattatgattcacttttgttcacagtcctcatggatttattttgaaattttaagtaaacagaaacttttcattctttcttgatatcttcacaaacaaatatgtatttgaaaatgtaaatgatagcaggcacagtggctcatgcctgtaatcccagcactttgagaggggaggcaggggatcacttgagtccaggagttcaggaccagcctggacaacatagtgagaccctgtgtctacaaaaaaaaaaaaaaaaaaaaaattaaccaggcttagtggcatgtgcctgtcctcccagttactcaggatgctaaggcaggaggatcgcttgagtctgggaggttgaggctgcagtgagctgtgatcatgctactgcactccagcttgggtgacagacctaggggatctgttatcatgttcatttcaaattctgagctagaccttatctcaaaaaaaaaccaaacaaacaaaaaagaaaatgcaaatgatttagagatactttcaatgatctgaagtttttggtaaaattaacataatcctttcattagtttatggttttaaaattaggccctttctaattttgattaaaataaatgaaaagggctttaaaattttttattttttattgtaataaagtatacataaaaatatttatcagtttaaccattgtaaatgtacaattcagtgccattaaatgcattcataatattgtgtaactgtcaccacgatctatatccaaaacattggtatcatcccttactaaagccctgtacttaaaacgacaacctccactcctcccctccacctagtcccagacaacttttattctattttctttctctgtgaatatgcatattctgggtatctcataaaagtggaatcataccatggttttccacgtgtctgacttatttcaacaagcatgatattttcaagatctattcatgttggtagcatatattaaaatttccttacttttagtggctgagtcatattccattggatggatataccacattttgtttattctttcacctgttgatgggcattttggttgcttctaccttttgattattttgaataatgctactatgaacattaatgtacaatatctgtttgatttctaagggcttttgatacaagttagatttaggccccagaaaatgtcagattggagatcaagttcaacataagaatggggaaaatcatctatagagcaaataactattgctaaggttagagaatatagtacctttatttaagtacatattgcttattattattaatacatattcaattaatacttgttggtcataggtaagttgtaaattcactctatatttgtttttgtggctattacatttatcctaattaccactgacacaaacctgagagagcagcaatgttgatgggtgtggctaattttttttttttaatttcctagttacaggcaaagtaacaggaaaaactaaatgacttctagtaactggcattactgtaccaaaccatgggcagtatatcagaggcttgcaggttccactgaaatttatgctcaccttgcttccatattgctattattagccccaaaccaccatcttggttcatcttaacatagtgctttatttacagtgcatgttaatgtttatttcttaacactaattaagatttagccatgcctccttgagcaggacgtgtaagcataataagaagcacttctgtatgttcttacttataataagaagcacttctgtatgttcttacttccaaacaagaagctgcaggattcctgtccacccactatgcatatgggatttattcacttcatcctgctagataacctcctgtccccttgttgacttcagtttttctagcatagccaattcttcttggttaacatttttcttaaaacttctggttaacatttttaatgttgaattgatttacttcctcacactttctataagtttccagaataggaaaaccattcctatattattcactggccaccatctgctctcatactcctcacttcacctctcacgggcctcacctttgctcgcttcttttgtgaagctcttcaaagctttctcttttctcaggatgatgtttttgcctgacattttcttccttcttcttctttttattcttttgagacagtcttgctctgttgcccaagctggagtgcaatggcacgatttcggctcactgtaacctccgcctcccgggttcaagtgagtctcatgcctcagccttccaagtagctgggattacaggcatgcaccaccacgcctggctaatttttgtatttttagttgagatagagtttcaccatgttggccatgctggtcttgaactcctggcctcgtgtgattcactggcctcagcctcccaaagtgctgggattacaggcatgagccactgcaccctgaccactcctgatattttctgaacatttactctttccatctatcctaacactaactgtcatgcaaaatgcaccaatgtctttgtatttttgcagtgtgaagaatcgtgtgtgtttgtgtgtgtgcgctaagtgtgttctgtggtttgattctcctgttccttcactgtagctagtttattttaggttatattctcttaataagaagagactatgttgacttactttggataatgtcataaatagattgctgtgtactaaatggtttcaatgatagtatttttgagtgataactacttacaaatattaaaaatatgaatataaaaattattcaatattcagccaaaatcttttagggttaaaagcctcaaatgggttatttttatgattcaggagttcttcccaaaaggatggcaatgctgattggcattgattcatggagatgaagctcttagccttctgtccttcaggcttaaacagaggaggtatacatgtagacagtctacactgatcactgagacagagaagtgccttctccattcatgctgcctttttaaaagttgtttttttcttcaaggatagactctgtgttaatgtcagcccagttctctgtgtatacatgatggtggggcctgggggacgggggatgggtggattgcaggaagcttgtctcagtgtgccaggttttgtaggtgacagggtgtagtaatggtttcttacatgaatgattgctatagctaatggaggtcttgtgaaaatgattcagattaagcttctggtttgctttaagcttactgacccagtataattgagtgtaattcagtggaatcagtgaatttgtattcttacagttaatagcaatatattcttgagaatgaagaaaccatgaatgaggttcttaatttgcttttctgcatcttccatgaccttaagaaggatttcatgagagcattagggaaacttcaaaaaaattctctttacaaacactttacacctcactcactgttaaacatgatttatgttgataactgtgctaaagtgagaaataatgcaaaataggggatgtcatggttgttttatttaagggacaccatgcctttaaccacctgaggattgtagtgaccttaccagtaatgtcaatggaactattattatttgtgactagaaaatggcttatgactataaagaaaagaaaggagagagagaaggaaagctaaaagaagggaggaatggagggagatgaggtgacaaagaacagaggcaaatctaaggcaatcttcagaagtagtaaagtaaaacggaaatattggtttgcaaggcagtagcacataatagaatcgcagggtctaatttcattaacattcttgcagcaaataattttcctgaatgaaaggaaccagctgcaccaagcagatttatattttcagtagcaacccaatctagcaactttgtgagcatcttagatttggtttagttttaaactaataaaatcttagctgcctgacccaggagagctttttctcattagtaactgacacaaaggattttgttgattgtccacatggtttctgattcccagaaaaaaatgagcagtgaatgttataaaggcccataagttatgggatgtgagtaggaagccgaaaacttaataggaaaaccataggaaagaacccatcatgagatacatggatgatgtttcagattctcaggagattaacaaagtatctagaggtatttatccaatatgatgtttcttgggcataggaaaagctttttaaaccatcgaccagcctccagaaaaagatacatgataaggtaaagaaagttagtcaaaaagaaaaagaatctgtgactccattaaggaacaagagctactttgtgtaaaactgatgtgtattttcctcagtaccgtgccctgagtgggtaggagagggagttattataacctcattcctgcttccaccagagcacctgcactaaaaactgttttatcttttggggttctgggtatgatcctgtttaacaagatattttgactacaaaagtgtaatttttttttgaactatctgcctatatcattcacttctttgagcatggaggcaatggaaaatcttactacaatcaagtaattgcttcattagagaagatttatccacagaaattgatgagattaagtgtcaaagcattgttgtttcactcagtgcttctttgaggttcagaagtacttcctttgtacacttaaatggcagaagtgagaagccaaacttcacatttgctgatacctctaaatagctttcttgtcatcatcatcagtaaacacacacaggtaggtagacagtagatccagggaccaggggcaacaaagagttgtgcatgaatttgtagtttatttgagaaacaaaacgttaacacacagaaaactggtagtacggtacaggaagtcctaacttattgtcattgataggttctgggaaactatgactttaagaaaaacattgtatatcaaaaccaattttaccataggctaattaatataaatgagttaagttactatgtgatatttctggtcaagaaaacatcaccaaccttcaaaataaagacccaaaaaccttctaatgttaaatattgaaacaaatgtgagctatgtgtaaatgtaagaaagattaataaaaacaagtaagacaattatttattcaatttttggtgaatcagtgaatgatggcagtagtagtagtagtattggtgggttaaatcaaagaatacatatttacaaacaaagttataatgagcatctgttaccatcctaccaccacacaattaaaaaaacattaatgacatatcgtaaaaaaggattcctggcactgaaaaatttaatgaatgaaataacaatacagttgacaccttcagcagtggattaggtcaagcagaagaaagaatgactaaagttaaagataggtcttttgaaataacccagtcagacataaatgaatgaaaaaaataattttaaaaagaaagcctaaatggcatattggtcaccatcaagtgaacaagcattcaactattgtgaatgccagaggagaagagatagaaaaaagcattgaaaaacctattaaacctgaaataataaaaatttcttaaatcttaaaagagatatagacatccaaatataggaggcttaaagacttctgaatatacttaacacataagtctcctctttgaggcacattatagttaaactgtcaaaagttaaagagagaattctaaacaatagaaagagaaaagcatcaagtcacatgtaagagaattcccatcagattaacagcagatttctcagctgaaaccatataggtcaggagaaaatcgagtgatatattcaaagtactgaaagcaagaaaaagactcctggtgaagaatactatattcaccaaatgtgtccttcagaacgtaaggagatataaagtgtttcctagacaaacaaaaactgatgggatttgtcaccactagactgactatatgagaaatgcttaagaaagacctacatctggaagtgaaaggatgttctccatcaccgtgaaaacacactaaaatatataacttattgaaagagcagatacgtatatgagaaaccgaaaggaatgaaatgttattactacagaaagctaccaaatctcaaagataaacatcagagaggaagaaatgaataaaggatttacaaaacaaacaaaaaacaatgaagaaaatgacaggaataagttctcacctattaataaccttgcatataaacagtttaaatctcccagttaaaagatatggactcactgaatggataaaaatatataatatagcaagacccaaccatattctgcccacaagaaactgacctcacctataaagacatatagattgaaagtgaagagatgggaaaaaataatttatgcaaaaagaaaccaaaagtcttcagtagttactatacttagacaaactagaactttaagtcaaaaaacataaaaagagacaagatcagtacataattataaagggatcaattcagcaagaggatataaataacacacacacacacacacacacacacacacacctaacactggtgcacaagatatataaagcaaatatcattagcgctaatggaagagatagactccgttacaataacagatggggacttcaacaccaaacttgcttgcagcattagatagataacctagatagaaaatcaacaaagaaatattggacttaaactaccctacagaccacatggacctagcagacgttacagaacctttcatccgacaactgcagaatacaccttcttctcgtcagcacgtggaattttctccaggttacactatatgttaggcaacaaaacatacttccataaatataaaaaagtcaaaatcacttcaagtattttatcagaacacaatggaataaactacaaatcagtagcaagagaaatgttggaacctggaaaaaatatggaagttaaataatatgctcctgaatgataattgagttaatgaagaagtgaagaaggaaataaaaaaatggaaacaaatgaaaatggaaagacaacataccaaaacctataggatttcacaaaagcagttctaagagggaagtttatagtaataaatacctacatcaaaaagtagaaagatttcaaataatctaatgatgtacctcaagaaaccaagaaaagcaagaacaaaccaaataaaaaattagtagaagggaagaaataataaatatcagagcagaactaaatgaaatggagacaaaaatagagactaaaagagattaacaaaatgaaaactttggttttctgaaaagataaaatagataaacctttagctagaccaagagaaaaacagaaaagacccaaaaaaaattagaacaaaaaggagacattacaattgataccacagaaatagaatcattagagactattaggaacaactaacaacaacagattcctggacacatataatcaaccaagatagaatgaggaagaaatagaaaacctgtgcagaccaataattagcaatgagattgaatcagtaataaaaagcctcccaacaaagaaaagcccaggatcagatggctttaccactgaattctaccaaatttataaattagaattgagatggattcttctacaattattccaaaaattagaaaaggagagaattcttcctaactcattgtaatagacaagcataaccctgataccaaaaccagacaaggatgtaacaaataagacaactacaggcatcatcatgatgaacataagtgtaaaaatccccaacaaaatattaacatagtaaatccaacagcacattaaaaagttacaaagactatactttcagggatcatttctatagttcattactagagaagtttctctgaatgggtagagcactggaaaccatgaggaggaggcacagtgttctctcctgagcatgaagctgactcttggtgttgcttcactgcacctgccatgtgccactgatgattgttcttgtcttcctctgggagagtaagacggagagcatgcagtctgagtgcttcccattttattgttgtgtactaagaacagtgtttttgttgtacatgagggtgatagctttaacatttagcaggcaaattgttttgagaacatgtcaagtgagagcttttttcctttgttctttgcttgctgaagggatccttgtggggtgggctgcttggtctgtcacatggctctcaaaaatagtctttctaattccagtattccttggtttttctgggcttctgaaggtttttactatgtagtgatttcagaaagttcattattgcttagtctgctgtgtttagttcccttcaaggttttgtaaaagagacaaaagcttttatttcttggtaggtaaagcatgttgaagttatccatttactctttttttcctttttttctttcctttctttcttaaaaaaaaaaataaataaacaccatgatcaagtgagatttatcccaggggaaaatggatggttcaacatacgcaaatcgatgaatgtgatacactacatcaatagtataaaagacaaaagtcatatgatcatctctataggtgcagaaaaagcttttgataaaatttaatatctcctcatgataaagtctctcaatgaacttggacatacctcagaattttaaaggcaatatatgacatacagctaacatcataccaaacagaataatttgaagcttttcctctaaaatctggaacaagacaaggaagcccattttcaccactttcattcaacatagtaatggaagtcatggccagagaaatcaagctagagaaaaaaaataaaagtctccaaattggaaaggaagaagtcggattgtccttgtttgcagatgacatgatcttatatttagaaataccttaaaaactattaaaaagctattagaacatgtaatcaatttcaataatgatgcagggtacaatatcaacataacaaaagtcggtagcatttctatacctaaacagcaaacaatctgaaaatgaaatcaagaaagctatcgcatttacagtagttaccaaaaaaaaaaaaaaatacctagggataaatttaaataaatgaaagttttctacagtgaaacctctaaaacactaatgaaaggaattgaaaacaccaaaaatgaaaagatattacatgtgtatggattagaagaattattaaataatattcttaaaatacctgtattacctaaagcaatccatagattcattgcaatccctaacaaaatacaaatgacattgttcacagaaatagaaaaacaatcctgatattcgtatggaaccacagaaaatcctgaataaccagagcaatcttagcaaaaagaacaaggctagaggcatcccactacctgatttgacaatatgctacaaagctataataagcaaaacagcatggtgctgcataaaaacagacacatagaccaacggaacagaagagaacctgttaataaatctacatatttatagtcaactcgtttttgataaaggcttcaagagcatacgatagggagatgacagtctcttcaaaaaatagtgttaagaaaactggatctctgcatgcagaataataaaactagacccccatcaccaaatataaaactcaaataaaaatgatgtagacttaaatctaagactgaaactatgaaactgcttaaagaaaatgtaggagaattgatttggtacatcattggtctgggcaaatattttttgttaaaatattgaaaacacgtgggaaccaaagcaaaaaatagacaattcagattttttaaaaagctgcacagcaaaggagacaatcaagaaagtgaagagacaacctacagaatgggagaaattatttgcaatctatccattggataagtagggattaatagctagaatatatgaggaactcaaacaacccaacaacaataacaaaaatctgattgaaaaatgagccagtgacctaagtgaacatttctcaaaagcagacattcaaatggcctgcagctgtacgaaaaaaatgctcaacatcaccaatcattagagaagtgcagatcaaaaccacagtgagataacttttcatcacagttaatgtggctattatccaaagaaagttataacagatactggcaaggatgcagagaaaggagaactctcatgtcaatgttggtgggaatgtaaattagtgtagccattatggaaggcaatatagaggttcctctaaaactaaaaatagaactactgtataatacagcagtcccactgctgggtatttgggtatgttgcaaaagaaaggaaataagtatattgaagagagatttgcactctcatatttattgcagttctatttacaatagtgaagatacggagtcaacccagtgtccatcaatggatgaatggataagtaaaatatagtgtatacacaaaagaatattattctgccattaaaaaatgaagttttgtcatttgaagcaacatggatgagcctggaggacattatgttaaattaaacaaggcaggcacagaatcacaaatgttacaggttctactcatatgttggagctaaaaaagttgatctcatggagttagagagtagaatggtggttaccagagactgagaagggtaaggggttggaagccccaattaccctgatttgattattacacattgtatacatgcatcaaaatattacatgtactccacaattatgtgaaatttttatgtatcaatttttaaaaattaaaacatgacactattaaaagtactgcgtttattcctcatgaagatatttgtggactaataggaaaaaagcattaaatattttaaatatagaaagaatattcatatagtgaaaaaaattacaaatatggcaggctccccaagtacttttatacaacatttttttttatgtttttttgagacaatcttgctgtgttgcccaggctggagtgcagtggcacgatctcagctcactgcaacctccacctcccgggtttaagtgattctcatgcctcagcctgctgtgtagctagaattacaggcatgtgccaccacgcctggctaatttctgtatttttaatagagacaggattttgccatgctggtaaggctgatctcaaacttctggcctcaagtgatctacccgccttggcctcccaaactgctgggattacagatgtaagccactctccctggcctgtatagcattatttattgtgcatttggatgattattgtatactttatgaatttttataatttgtattcattccttttccaatctgcttattcctgcttagcatcacaagtagtcagagcctatattggcagctcaggacacaggtgggaaccgccctggacaggacgcctttccgctgcagagtgcactcacatagccccacactcacttacaatggaacacttgagagaatcccattaacctgtcatgcacatctttgggatgtgttaggaaaccaaggtacctggagaaaaccctcacagacatggggagaatgtacaaactccacacagacagtggcactggctagaaattgacatatttttctcatcggtgttataaccagatgacatggagtgagacagtgttattgagaacctggtatataaccagtatttaccataagagtcaagtcaatgatacagatgatagtatcagtataggctaggtgattggggtgagtcctttgagaaagcaagccttgagctgggctttctggaaagaaggtacaatccttctctgagcagaggcaagtgggatgggatgctaggcacagaagacagtactgatgacagtttgcaggagggactttcagttgtttaggagatagtggtaaggtattaggttggtgcaaaattgacaatggcaaaatacacaattttgcaccaacctaatataatgtgttgatgctaattgagcatttgttttgaaagagtagtaacagagaaggttccaagatagacagatgctcaaatgtgggaaaattattgtactagggttctccagagaaacagaaccaatatgatatgtgtgtgcacacacacaaagatttattataaggaattggcccacatgtatggaggctggcaagtcccaagatctgcagttggcaaagtggagaccagaagagcctgtgctggtgtggttccagttgtaaaggcagcaggctcaagacccaggaagagctgatatttcagttcatgtctgaaggccaggaaaacaaaaagaaaaacaaaaaacaatgtcccagttcagaagcggtcaggcaaggggaattaccagtctctttgttgtattcagccttcattctattggacaaggcccacctgcattagggagggcaatctgctttgctcagtaacgtgatgcaggtgttaaactcacccagaaacaccctcaccagaaacattcttcaccagatgtctaggctgcctctcaccttgtcaacctgacacataaaatcaaccatcagaatcatgaatgccaggaatttacatttaaattgtagatagttgaatatgatgctttatttaggcaaaagtccatagttagataaactgtcagcagatacatttattaaggtggcatgtgtctgttattaatcatatcaatttgtttattcccctcttttgatgtataatggtcttactgtgtgccaataagtgaatatataaaataatatgtttggatttctacaggtgtatttgaataacagaattctcacttgggggcccagcttcaattcatatttacatgccaagataattgttgatgttgtagagaggtgcttagttaagcaaagagatgagcacatctaaaatcaagctgggaataggatccttaggaataaatatttatgttcacggacattagtctaaagtggcatctttaaacctaccttttttgtgtgtgatagaaacatagagttacaccttatggtgaccgcctcatccatttcacaccatatatcatgaagtcacaagaaaagaagaaaatcagttctggatggcagtgcagactaaatgttctttcataggaagtcaagaaagtagcttttacaattgccaacgtttatgtgcttttccaaagacttgttcacattcttctccagcagtggcaggcacttgaataaactactcaatttggaacatagcaaatgacttcctggcctatgaagaatggtggtggcaataaatgggtggaacattgcaggcacctaggaaagagagcaccatttctaaaatgtttagtgaaaatagcattttcaagcaaactggaaatgtctgattgggggcagaagagtgagcaactgcagctttgaaggagagcagggtaacatgctacattcagcatgtgcctgaagtcatgggtccagcagctgtaccacctcttgctgtctctgacagcattggcgaggggtctgaattcgttgcaagtctctgctgagaagggctggcacatttctttcctgtgtcctctgttaggggatagcgatagactcctcgtaaactccaggatggagcctagttaggcctgtaagtgctagtgtctttgctgacagaattgctgagataattactgccacctcctcagttttgtgtgtcacaggccattgtccagttatggtttctctgaagtgaaatttggtgcatgcgaatgggtgtgtgtgtatctggctcgaaaggtggagctgctgagagattggactgccactcaggctaaaggttttctggtgctagacaactggatgaaaggtttgtttttttttttatttgcccctccaccagcctagatacacactggcttttgtgactttatagagttattctcaggtatgtattccaaaactagcaataattgtgaagtgattccaagaatccagtagttaagtctgtatggctcccaaaacccatgtccccttctctgcctaatcttccttaataaaaagccagttgatagtttttctttgctgagctctagcagccagttggcctggtgagattgaataacatcaggtagccatgtcaggcgtttggaaagcctacaggcagaaggcagtaagaatggtcttactgaacacatcatattctaccaatgttaagacatagatttatggcctctagcacaacattcactgtcagcacctgctgtgtgtcataattgatgtttcctttggtttccttgaacagttctgcctcagctaatgccattaagtttcagaacttaaaaagagttattgttaaatgtggaaaactgctcctgattattttggccattagaggaccacgtgagatgagatcatagaaaaattgccggtaatccatccactgacattcacactctatctagatttatgaagcactcccccaaggcagaaaatgcatctggaaagagtgcctaatagacatttaggtgtctggatgctgaatagatgcatatatgcatagtttctccattttgttatttcacttctgtttctaaaaaccttgataacatttagaagcaaatgttcagaagggaatgaaggtcctgccatcaggacaagacatttgggtagtagagcacataattccttaccaggtatgatttgacctgaatgcatgctagctcttgagtaggttagaagtaagcaagacttgaaacaaagcaaaagtcagaaccacaggcagaaaagacataatgtcacatccttggatgcctggtatgagaatgcagaatgttggcaagaaagatccatgactctgggagaagatggggaccctgttttctccaccattgtgagaaccagctctgcgtattctcctgtgtccgtgattgtcacagggtggtctccaaaccagcaagcatcagcatcctggagaatgcagacgcccaggctccaactcagatgtattgaatcagaaactcttgagtggcaagacccagcaatcttgttttaacaagtcttgctggtgattctgatgcattttaaagtttgagaaccaataaagtatcatccccaacagaggtggagtaaagtggatttcacagaacatttctccgtgattgcaattctcaggctgagatggacaagaaatgctgatacatctctgcccactgatttgacaacttgagagactaatgggttttaggagttcttattttttttaattccaaatgtttcgttttgattaaaaactgaaatatcaaagaattctctaaaaattctctattaggaccaaaaagatgaaatatacaaaacagtctggcatttgcttttgtgctgttacccagagtgtttctcattttgccatggctgagaaaaagtgttggtgatatagtttggcagtgtccccacccaaatctcaccttgacttgtaataatccccacatgtcaagggcggggccaggtggagataattgaatcgtggtggtttcccccatactgttcttgtggtagtgaataagtctcatgagatctgatgattttgtaaatggaggttcccctgcacaagctccctcttgcctacggcgacataagacaagaagtgcctttgcttcccaccatgattgtgaggcctccccagccatgtggaactgtcagtgcattaaacccctttcttttataaattacccagtcttgggtatatgtttattagcagcatgagaacagactaatacagttggcaaatttgggcatcccatttccagtatagacaacagaattattctccagatttagaaagagagaggaaggtgcctcagccagggcatctgatgactacacttgcagaagatggtctgagcaccgtatcacatctgctgaataaagtacggatcagttccggtcctcatgttaccttcaagattactaggcaaaaataaagtcatagctgtggcttaaagccttaaactaaattctgggagttaattacattatggacacgaatgcttttaagagattgtgtatttctttgcatctgtataattgcatcattagttcaacagcttcatttaatgcacatttgagggcctattacatacaagctggcattccttacctgctctcctagtgttgcctcttggccttctgtctgtgaccattctacttaaagaaacttagggaagaaggaagataaatattcgctttccttttcttggccatagaagcaccaagttcagtcattcatttcaatgggagctgagtgcattcttccagccctcaaaagcacttaaacttttctgatggcccagtgttgactatgtggaaattccacgtctctgaaaggaaatggaaatgcttcctttgtggactgacctattcaggaatttcatagggcctcagagaacatgacagagggggaatctcagctgtgcactgaatttctctactccaagtcactttctctgattgagagtgcgctgaaaattgttttgaaaaccaaactgaaagcaaccacttacttacagtaagggttgagaggggcatgttggataagacccttatgaaagggatccatagaatcactgtaattttgcaattcgtggatctagcctatgtttttatgtaaattgtgtgtgtgtgccatgtgagtaatgtctgccttatagggaattgcgtagaaaaattactcaggcaattcaaatggataacatttggcatgagttctcatattttgactggctgtttgcctgcctatctagtgaactttaaaaaaaaaaaaagaaaatgttctaacaggcttggaactgagtttgcaaagataggatgggcccaagttagtattacttgcagcccccagtaattcagttcagaagatgactgacctctggcatgagggatgaaagacataatgagggaaagccgatggcatcaggaaagggagcaatgtttcaacagctattaggctggtgcaaaagtaattggtaatggcaaaaaacacaattacttttgcaccaacctagtaattgctatagattgcacgaagccagaaggagccaggaggagagcttatggggggccctgtggctcgtgccacaagttggaataaacacagaatcagatcaaggcaatcgccgtttaccctacttttactgaaaatttgatttctttttttatttacttaaggattgaatttgttgctaactcttttccctcaaatggttccccctcacccatgcatttcagtgaagaatatgttttcagtgcatataagtgatgacaaaatttgcatttctgtagactccagctgtctggttatgtaaatgatgagcatacactatattgtattttccaaaagcacatgtgcagcttgtatagctaagtgttaaatttatttcagaacttatttaaagaatggtcctttgggcatggctggtgaatggttgcatggaaaaatatactcaaaggcagggcaacgaaactgtagaaaatgtctgtctcaattaaggaatgccctttgatattcaagtcaactgtgttacaaataaatcaaaaaaattcataaaccctctcaagtagagccatctgatttttatacgtatataactaaaatatcttcacatattacctcttgtctttatcctattaaaaaacaaacaggctctcttcaaagtcacatctctgggaagttcttattttctagttctagctttctaatgcagaaatattgcctcactttgatacacacctttatctttttcaaactacttttacataagtaatcccatctaattcccagatcagtggttgaggttgacatatgcccattttacagatgggtaaactgtgattcagaaaattgaaaactccttaaattgtatagcgagtgaatagcagggcccagattcatatccaagactcttggccccacctccagcagtatttttctttgtgcagtggtgccttttttatcacctcaggggtgacctcccctgtcccaggagcctaatgtccctcagggctgctcactctcttcccctcctctgattacagttctcaaaggtcattttattactattattacacagctgacactcattttatacttaaatattgcctcaatctgtcttttgtattttaagccttttaatttctaattgtggaataagtagtcttttttcctgattaaaaataattttaagtgctatattagagctggggacatccttcagaaaatcccctgaatcacagaggctctgtggagctccacgtgttaagcgggaacctaatttatttggcattacagtgacgtagcagagcaagaggtgaaaggattcatgggttgcctgatgctgctggagcccttgtgagggtttgtcggagcatatgaacttgagaccttccaactcgctgctgttaagcctgctgcctgtcagctcaggttgatctgtgttgtggttagtaattaagataaatctatttttgcatagctaatagctactgctctgtgattactagctcatatcttctgtcccaagtaaacatttataaatactttgaagacatctcagtgaaatttaaatttccttataaaacttcattttaagaataatgggcctgtatgctatgcatagccatgatcagtgtttccatgagtgagagccacatgagttacagtggccctgttcgcataataaatgtttagcaggaagcatttgcatattacattatgaggcttcctttctggccttcctgtgtaatttatcacaaactttgtgagaaaatacttgcaccaaaggcatccttgcacaaaacaacacaggtaaaggaggcttcctcctcctgcttctctcatcttttggcttttcccgggagtggaattggcatatttcttgccctttctccaggaaaccatgggtagaactgggaggatcttatattcccaaaaccatggcaaccccagacagattcaggattttagaactgctgtggtgtgctgggtccctgacactgaagcaccagtcacaccaaacactgccacagttctttgtcttccctggtgtcacccagaacactcgtgtgggtttgcaaaagatgcacaggcaaagtggccgcttgttgcatctaagtgtgggttttaatgtggattttctccaacaagtcatttgaatccattcgagattctctgaagtcttattttaggaaattacctcagttagataacaaatacatattattttgttctcaatattcctaagagtttaatttccatttcacttctctgtaggatacttgtcaactctgtccaaaaggtaagactagatctgtgctcctcccagtgttaaaccgcatcattccctctagataattatcctttgcatagcttatctaaaccaacctctcacttgctgattctgaatctcaggggtaggacctaggaatctgcagtttcacaagtgccagtggtttttatgatcagacaagttgggtaatggatctgtttcttgagcaaatatttgttagataaataccacctttagttttccctactaacatacgcttctcaaaacacttggtacctgcgttctatctctaatattggaacattctttattattattattattattttcctttttgcaggcaggtaagagaatcatgtggatcagattgtgtcccttccaaaaatccataaagcaatccagaggagcctcacttacttgctaaagccctttacaaattacaaagtgttgcaagttatttttatgattagggaacattctggaatcagtcacagtaaatagtttatctctttttcaaatgaaattaaagcacagcaaaatcaagtgacttgtctaacagtgcccagcaagccatcagtttgtaacagatctaaaaggagatgtctgaccactgttcatcccgatctaacaagcagtaagatactggaattgatcaaatgtctgagacaccgtggttgagacccactgttgtaaagcatggagatagctaacaggatgaatcagtggtgggggcctctaggttagagagtcagtactaaatccgctcttggccactgagggtctcattccaaacatgggaatgataacattggatagaaaactatatgttaaattatttcatacattgcaattgtttctggtggtagattcttatctaatagttaaaagacgttaggagaggaatcgatcttttttattcattgagttccccttggtaagtgcgttcctgcctgggctggaaggtgccttcccgcttgtggtgctgtctttatttttaaagtgacagcacatctttgcctattttttagggtacattgaagacctgggaaatatttctgtggaaattattcctgaaatccctttgaagtgtttgcactttggctattgtgtgaagaatggaaaatcgactgaagtggcattgggttggggttagtgcctgtgtaatcagatgctaatgtagctgccctgctaccagccccatatcacatcctcctcctaccacttaccataaaattgcagaggatcagctgtgtacagtaggaggtcggcagttcagttctgcacaatgcagaataaatcactgagaaatcaataaacagcagctgacaagaccaactataggaaaattaaaggctgacgaagaaggtcggggaaaagtttgatctttcagcttaaaaatcttaacagaaaaatccacttttttgttttatattttaaaataaaaggtctttacttattgtttttatgaatagataattaaagaatgaaaagaaaaaagcgttccccatcctagctcttgaatgccttagttcaaaacttaaataactagtgatgttatttatttgtactttgggtgatgtagggttcaataatgtggttggttgacagagacaaaataatgaattgttctctttgacttcctgtagctttggatgtgaatgttatttttccttttctctaaactttttggaggcttgcttaaagaaaagtgttgctgcaggaagccctgactccctggtgcttaactccatagaaacacgcacgtgcttagagatccacactgacctcgctccctccagacgccatcattttggtgcagacattattcagcagacactaggaatatgaaaagatacaagagctgagtcttgaccatttggagttcagagtctagaaagagaaatcctgagtaaatattaagtgcttaataacactgtaaggaggcttaaaatctggtggctgaaggtcctggcttgaagacagtttaatgctcaagcccctcaaaggagatgctgtagttatcggtggccacaggagaaggcatcacagagggttggaaacttaagctgagtttcgaagggcaggcagttcttaagtaagcgaggaggagagagcaaggacatttcaaacaaaggagcttctccgatatagcttcatcttgtgtgctgggtgagaattaacagtgctgtatgtaaggtgtggagtacgatgcctggtttgtgaggtgctcagttgatgttagctgtcattctgaaggatgtggctaaaagatgaagcttctggagacagtgaataaggcagttataccttattggcttccataactttttttttttttttaccctgaaagcctgaaagagcccattacctacttaacttggagtcctgatttttccagcaactagctaagaaactaaatgaatcactttggccgagcgcggtggcccatgcctgtaatcccagcactttgggaggccagggcagacagatcacgaggtcaggagttcaaggccagcctgaccaatgtggtgagaccccgtctctactaaaaatacaaaaattagccaggcatggtggcgcacgcctgtagtcccaactacttgggagtctgaggcaggagaatcgcttgaatccaggaggcggaggtcgcagtgagccaagatcgcaccactgcactccagcctgggggacagagcaagactctatctcaaaaaaataaataaataaaaaataaaaaaatcactttttgctttacacctcccttttcttccatgtaaaatgtgtcagttggactaaataatatctagtgtaccttccatttggaaatatagtaaatttactttgctataatgaatgaaagaaactagaactcgagataataaactatttccctctttttttcctgagtttcttttttaatgtgaactgtaatacctacctgaatataaacttactttacattcctactaatagtaaggcacaaaattatttgggaattaaaatttaagaacagacatttaggttagaatcagatgggtatttcttatatgtaagtatctgttccatcctgaaataaagtagaaaatcttagaatatctatttttagaagtgttttgtagtatttgtgatttctgtaatgggatgttatacagagacatgagtacatcctagactaggtgactttttagggttgctttgtgatttataagacaactccttgttgtcttcctttttcctaatatcattaccaaattaattttcctaaaatctctttggtcaaggcatttcccttttcaaaagccttcggtgactttttgtctcccaaggtaagtacaaaagtatcttctttgtccagattttcatcattatctcatactatttccatttatgaaatttctgtacccatcagtatggttgactgccagacctcagaaatgtcctgttccctaaaccactgagttttgttttcatggtctcacagcctgcccaaaccttgtccattctgaaagacccagttcaagaaagaggattcaccatgttgaaaacagcaagaattgagaaacaaatgttaaaatgttcatattgtgactgcccaggctgggtggcagcacaggaatgggggcaggtgggttaaggaggatggaagagcccatggacttggtgagatggagggagagacagccttgcacatgggaggctgaggtcagggagggtaggatctgaatttaaggaggtggcatactttgaggctgaaggtgtctttgaaaaccacaggtcagaagaagaggcagggaaaggaggtaaaattctttgagccagattcacttttaaagtggcttatagagatacaaagattatagactgcaggagatgaaagacaggagaaggaggtgagcttcagggtagattcattgggaatatgtttggatgtcatgaagataatttgacaacagaatctccttgaatgtggtgtaaaacaaaaataaagcaaaacatataagaggcattgatgaacccagcccaagatcctttcctgtaattcaggatatttaggatgaggaaagtattttgatttaagaaaatctagattggaataaatggagtgtctattccggacagaacaggctttcccaaaagagggactgttagggcctgaagagcagcaaaggatttgacttgggttgaaattatacaaggacagatagaagagagtagataaggtatactcaggttagagggtagattggagacaaatgttggcagtggaaaaccgcagctgaaatatcaatgtcccaaatctctgaaacaggacctgattgctgggagggtgcaggcaagcagggactctctcctggagagggaggactgatgggcacactttctgatgatcattcttcacagccatcaatctctagccctctgtgccagtcacagaggtttcactcttcatggtttcactacattcccgtttcttttaacccatatttaggctcatttaaatatttgatcatttttacttctgatacttattcattgctctgagtcaccctttgcccaaagcaaactgttgtagcctagaggggacttttgcagaaatatgagacttgttacaatgattccctactcctgtctttccagcctagctttccaatgcaaaggcagactttagagtttcacccttgcagctattaggaaataactgcccaagaaaattatcacaggtgacatgcagaatgcatggtggctaattagttcaactagaatatcaagaatgaagctcaaggtatcatgtttataacacagctaaggacaatttgatattacctgtgccttttagaagggatccctccttcaccttgaaaaggaaaaatacgaatttattagtacttaccttaaaatcatttctagtaacatgaccaaattatacgtatagaaataggtataagttgaaatgtttccttgcacattttttccttctcatagttcatccctcctttttgtagagaagaaaaccaggatttgttgccaccgtggtttccctttctgtgtttctggttactctctagtggacctatctgtgtggtcacggttctgcaagttggagagacgccactggggggcattgacctgtgctacttgagcactatagtgaattctcacctttttcaaagtagtaattagacctctggtagtttgtatttttagatacataatttcctttattgattccatacaactttgggaaatagtacatctgcttttattttaaactgaagagttactttagaaatgccattttttgtttccagaggctctaaaggattttcatttctgtgacagatcgacaggccatgaagattttctccagaatggtaacttggcatctgccaggaccttcctctggctttcttcagccttctaattacaatcatgcctcgatgaaggacagggtaccttgtgagaaatgtgttgctaggcgatttcatcattgcatgaacaccatagagtgcacatacacacacctacatggttgagcctactatgcacccaggctatgtggtgttgcctatggttcctaggctaccaagtcaataacatgtgactgtactgagtactgaaggcatttggaacacaatggtaagtatctgtgtatccaaacatatttaaacctagaacaggcgcaataaaaacaaggtgtaccatctcatttgagaccaccgtcatatgtgcggttcattattatacagcacatgtctgtatattatctttgtcattttgtgaaaacctgtcactttgaaatgctgtctcttagcaaaagggatcataattcattgaattttttatttttcaaatgaagtgtatttttttttcatccagaatgtagactagtgggaaacacatgaaagagctggactactcaagggtgattggcagtggcctcgtgctgcctcttgcactggggagggtggaggaggaagagtggtagcaaaaggccatttgctagcccaaccctgtcctgcagggctcctgtcaagaagggaggggaagatggaggaggacttcagttaagtaagtcccctatcttggtataaacactattcttagggacttcatgtttataaggacaggttcagtttcaccagcataaaaaccttcaaaaagcagtatgaaaatagtattaaataataaaaattttcaatttgtttgaaaataaaaattttcaaattggttcagaaaatattatgaaccaatctgttttagttaacccttgaacagtgtaggggctggggaaccacagttgaaaattcacgtctaacttgtggctccccaaaaacttctaatggcctactgttgaccagaagccttactgataacataaaccatcgattaacacatattttgtatgttatgtgtttcacatgctatattcttatgacaaagtaagctagagaagataaaatgttactgagaaagtcttaaggcagagaaaatatatttactattcatcaagtggaggtggatcttcatcctggttgtcttcaggttgagtgggcccaggagtgagtgggaagttggtttggctgtctcaggtgccagagatggaggaaaatccacatagaagtggactcgtacagttcaaatctgtgttgttcaagggtcagctgcacagcctcctggggtacataccatcccctctgttggccactgtgaaggaggaacgccattagttcaaggataacagggtcagtttgaaatgaccatgtactcattttggggagaaaaatctatttgagcttgtcaaagtttttctgtagcttcaaaaatatcaaactgtaggagttataaaactccacttttagataatatacttcttagcattaagaatttagaccttttaagaaaaaagtatgaatacatgttttaggtacagagctcttttacatccattagtgaaaattatatctaaacatatcatcccgaaactcaagatttcatcataaacaacaaattcaagttaaaatgaataaacctaaggtttttagcatgaattccagttttttctctcttttttaaaacagaggcagtataagaataatgagatcttattttggtttgcttcatttaattaggatttcaggaaattaggtaacttttttcatgacctttagaatacaaaaaattaatattcggtcaattttttgaaaaaaatttatcaccaggaatttaggcaattaaactttaaaaaataacatgcaaaagttaaagcaatttagaaagccctttttaagcaaattatttggtttttcatgataagtaatcttttgactgaaaatcttatttttcctgttttgttatttcaaaggtttttttgtttgtttttgaagaagtgacattttcctggattagtgaattgttaaaaagtacatcctttctgtctccattttttccctttcttaaacaaagcaaacatttgtatactcacacactgaaggaaaaaagtgcaagtgttataagataattagaacggttaggataattgccttttatggatacataatgcttcagttgtttactgctaaatgaaatgtaaaagtatatattagactaaggaatagtgtacaaaatagatctaaatacaaaggaaattgtgttctgtctgaaaatttgtagatgggtctaaattaacaagaataaattaagaaggatatatacacactcatttatacccttgtgcgtatctcacatatgtgaacacacacaccaaatacactgaaatgtccatatttagtgccaaaaattgtgatgaaaaaccagtgggattatcctttgtaatagctcattctttaagttgcatttcaataaggcattgctgtgaatccagaggagattgtcaattacagaatttttttcatgatctagtatttgcttggtgcctcagagaaaatggttgttcatctctgcccctcactgttcatgtttgggactattgtttggctgcgccagtagaacttattctgataagctcaccaaatttcaggagtagcctcctttcaataactccacacttgtgcatgtggcttagtgaacttactggtgactcagtcatagcaagaaagggcatctcatgtctatgtgactacaaatatcagggaacagattctccatcaccaaccccaacctctaccctaacacaaaggtgtatgacaaaatgagacaaaatgaaacaaaattgctccacatgctacagtggcctactgttgactagaagccttactgataacagaaacagttgattgacacatatttttaaataaatataatatttctctagttaggttttctatttcattttattttaaagatgacaaaaactaaatatgcttctcaaacctctacctttttcaaattaagtgaagtcttcttctcatttaaagctgtttatactcaatttgaaatatgaaacatagcttcaaatccaacaaagagaatgttgctaactctggataacacttggggacttgagtccctgaaaggctgattgacaaccagattgacaactctgattgacaaccttgcttactttgatagggcttactatacttagtatgatagtttttaaattaatttagagcagaacctttccaagggatctgtgacaagaatggttaaatactgaagtgttgaagaaagaaataatttatcctgaactttgaaagtgtattattactaatgaatttaaagataagtgtagaattgatcatttatcatttttaaaccttttaaattagaattataatgaaaaatgcactccccatcccacacacacaaaccccaacaactctttaggtgcctacaggtaggaaaaattgcatttatctgaattaatcttggagtgaatactaaagttagttggaaaagctcctgaaatgtatgagacctcgaaatatcaattaacaaaaaatagtacctaaaatgtcttctaagaagtgtagtcttttaactaggatccttcttcctgtgtaaacactgaaatgaaattttggaatgaacctaaggtggtcctgaagtgctgtgttactagaaaaagatataattggtggaaagggtggatggatacacaggaagaagcaagaacctgaactcctgctggctgatggaagaaaatgggtgatcaagtttttgcttctgaatatttgacataaacatcataattaacctcacctaaagaaaacttaaaaggccaggagtagtggctcacacctgtaattccagcactttgtgaggctgaggcgagtggatcacttgaggtcaggagttcgagaccagcctggccaacatggtgaaacctcgtctctactgaaaataaaaaagttagccaggtttggtggtgcatgcctgtaatcccagctactcgggagaccgaggcatgagagtcacttgaacctctcatggcggaggcggaggcggaggttgcagtgagccaagattgcatcactgcactccagcttgggtgacagagcaagagtctgtcaaaaaaaaaaaaaaaagaaaaaaaagaaaagaaaacacaagaaaaatatttgagagtcctcaaagctttgtataaacacattctttctggtacattcaaaaggaactgatttcagattggtgtagggcaaagcagaaagtaagtgtgtggtcacagaaatgaaaggacaagagagttgacaagagttacaaaagacagacaacagatcattaacattgctgttgatttaatttggtcactagaaatgcggcattcatttttaaaagaacgtctatctatccataccaataatctggagatgatcacactttccaagcagagagctgaagtgaaggcttgaggggatgcctctgcctctcttcattttctttcatctacatggctgaccaatattcacgcattaatagattttggtttctctctggttccaacatttacataatacagtaatagttataggaaagggtttgcatgttcattatataaacccataccgattttttttctacattcatctataaattacatacgagtggggtagctctatttcttgctaattcctgacagtatttattttaagcatgtctttaattcaaagggatcaaatatgttataaggaccacgtatttattatttcaggtgttttacacagtatatcacattttatccttaaacacatgcacatataggtatgacactttatacttgtatagtataaaaatattaggccaggcgtggtggctcatgcctgtagtcccagcactttgggagactgaggcaggcggatcacaaggtcaggagtttgggaccagcctgaccaacatggtgaaatatacaaaaatacaaaattatacaaaaaacatgcaaaaaatatacaaaaattttgtcctaaaaatacaaaaattagttgggtgcggtgacatgcacctgtaatcccacctactcaggaggctgaggcaagagaattgcttggacccgggaggcagaggttgcagtgagccgagatcgtgcaactgcactccaacctgggcaacagagtaagactccttctcaaaaaaaaaaaaaaaaaaaaaaaattagagcgtcctcagtgctttatataaacacactttttactaaaaaaatttacaaagcatatttccagttttgctttggagtgaggaaaacaagttcccaggagcaggtatcatgagtccactttacaagtgaaatagctgaggtaggtgatatcacaaaggccactgttgctttgactagacccaagaactttgtagctcaaaggtctctgcactacatccaccaagcattcatggaaaacctgggacgtaaatagggaactgtgcttgggaagtacagagataaaacaattctggccccacctcgcaaggagcttacagccttaaaaagaatgatcatagaaactgttaggtacaaatggaaacttcttgctaaatacaagaactactaaaatgttacatgacccaagagaatgggccaatgctgaagcccatgtcagctaaggctgaggtgaggaagtggtctttttgccaagccttgaaggacaggtaagactgcacttgataaaagaaggaaagtaggagagaattccaggctgaagtaacggcatttatggagactcaggaggctgaggcgggaagggaagattgctggagcccaggagttcaaggctggagtgtgccatgattgtgcctgtgaatagccacagcactccagcctgggcaacatagagttcatatctaaacaataatattaggtatttggggggaaccttaggaacctttttaaatgcagctgtatttgctgtgcatttgtaaaacgaagaagcagcatggtgaacccagtttgagcagagctgcaagttgcttgttacgcacccctcattgtcacagagcattcgatttatcctctgggcagaaggagcttctgctgctgatggacaggaaatgaaacatttatcacattgctgttattatttttaagaattctttaaggaaaggaaaaataatcaatccacaataatagagaatcaactccttaaagagaggaaaagtatctgagtgtaaattgatgggcaaattaatttccctttttttatgtaaaattgttgtgacatgttaataatttatgtaattttagaaagtaaattggattttctttcaacctttatatatgaatatgtggtcaacctaactatatactgaatattatactagaaactgaatgatgattcagaatagtataggtgacattcagtttcattaaagattaatagtagcatggccttgtgtgttttgccgtatcacaaaaagcaagatttagtgactagggccctggattatgtattaggtggcaagacttccagtccaagctgccacacacttgctgacatttgtgctcacgttaattttcccatccgtaataacgacagtaataacatccaaaaccagtatacccagataaatggtaaagattaataaggtaatatctgtgacaggctttgggcttcttagaaaagcactgaataaaaagagcagcagcaaaaccttctagatagatagtgtcatcagttcactgcactctgcacagaaggaccacgttgagattctgttgtgcagtgtcagtcccgtaggtcactgaaggaggaaggggtggctttgggagtgactttgtcactcattatttgaatgactttgggcaagttacctaatttgatgaatttgttttatctgtaagtactgataacatacattacttggactcataagaattaaatgaggtaaattaattcattcacaatcagaaaattctacctaaatttctctttttgttttggcccttgtgggaacatatgtaaaaagcagtgttcttctacacaattgacaaaatggcgtgatagaccttaggatttgttggtcatatttctgatttggtcattatttcttataatttcaccatctctctagtctttgttcagtattttttaaaactatgcagcagtggaaaagaaaacattttttattttcctcctacttcttttcttttcttttctttttttaatgtaaacccttcaattatatccacctcttatttcttatcctttgtttactatctggaattaaacaaggaggattaggggtggtgcttcacctttgtaaaatgcacttgaagttcattataaacataaatatataatttataaacatttatttttataatcattttaataattataaactaataatttataatataatataaataatatttatttataatatacttgtttaaatatataaatttaacttatttaatttataaatttaacccaacgctcttgggttctcatgcattaaatccctaccaacccagagtaacttaggaaaagatcctcctgagaaagttcatcattaaattttaaaaaggggacctttttacttctttttgataatcttaggatagcaagaattgacacttacaaagtcttattgccaaggagaaggcttgatgatgcctgttagtatatatgaatcagtcatttatcattaactgtttgcattaatgctccttagctatttttatcgaattagttgtgacaaaaagtatctgaagtttttgtgcttattactttttacttaaataaaactgcactctcactccaatctttttttcgtgcgtgtggcagaggtcatccgcagtgctctgtccaaataaccattcatttactttgaattatggcagtgggatgctcagtgtttgtggactcgcaggtcagtatgggtaaagaaggagagagagtccaggcacagccttttcagtatttctctacactgtgtctgaaggataatgcatgtggtcaagaagaattttcctagtcctgtgactgtttaaaatttgagaggggaaaaaaagtctaagacttctgtaatgctccaaattgtttttcaaatgaggttttagcaagatgaaaatacctttcaaaggatttatagacccatgagaatttttaaaaatctctttaaacataaaatattctcctagctactggaatgtttcgggtgtctctgcttaatcagctgcctcacttcctggtctctcagtactggcttggtgcctttacagcccaatcatggtttattgatattgtgctgcacactattctttccgagttttttctcccacaattgtttgacaattttgttcattggtgataatgaaagagaaaaaagaagtgccagccacccaacacagtcaacacccatttttgcatgtcgtttctgtgcagcagaggcaagcacagaacctgaacgtgctcagtgaggtactgtttagtgtcgttctgtgtgggactcggatttgtaaagcccctgcacttgtaattcaccaaagtttcccagacacagttccagtggcacattccaagccttttgtttccagtgcagtattgggacttggttgtaactacaaaaactctgatgataaatgcctgggattctggttggaaacacctgtcagaaggacttcaagaaaggttttagagcctagggtcttctgagtagcagtacctgttgactgacctgctgtgtgctctgttagaaaattatgttggaaaatactctgtgtacttggcgacaagcctttctgagccaggcatgtgttgatatgacatggcggcttcaaacagtcctgcaggtgctgtggtatattacttaagcttttttgattccaagtaacaaaaaccaagtgatttgtgcttaagcataaaagagacacacacacacacacacacacacacacacacacacacacacatataaattttactttaagttccaggatacgtgtgcagagtgtgcaagtatgttacctacatatacatgtgccatggtggtttgctgcacctatcaacccgtcatctagattttaagccccgcgtgcattaggtatttgtcctaagctctccctcctcttgccccccactcctcgaaaggccctggtgtgtgttgttcccctccctgtgtccatgtgttgtcattgttcaactcccacttatgagtttgaacatgctgtgtttggttttctgttcctgtgtgtgtttgctgaggttgctggcttccatcttcacactgcaaaggacatgatctcattcttttttatggctgcagagtattccatggtgtatttgtaccacattttctttatccagtctattttggtggagatgggatctcactgtgttgcctaggctggtcttgaactcctaggctcaagcaatcctcctgtctcagcctctcaaaatgctgggactacaggcatgagccaccatgcctggcctaattttgttctaacatctcagtaaatttagactaatcagtagatattttcagataaaatataaattctatcagttttatgagcacatacatttatagatttgtggaataaaatttgtattttgtggtgttatgtttgaaaataaaaataaaattcaataatgaaaaaaggaaaataagaatacaggcctgcctcatagggagaactggtctaggacttggaagcctatcttaagccagttctctctgcccctcacccccatgtctctgcctcccttcattttttcttctctctgagggctgtcccagggtcagggacactttaaataaagtaatctctgggatttacttctgtagaagagaggaccacttcaaaagactcactgtgaatttatgaaaaacacctgaagccatcatatggcgcttatgttgctcttgatacttctttcttttacctgctacaccccacatgagtaagagcacaagactgagctgtttagggtgctccaggcagagaaggcatggaagcttggaaagcgttttctaagtcttttctgctacacttaatttttgctcattactgtttgtatataatccttatcatttcatagctcctggcacagttgtgaatctgaatcttgaagggatctctgaagatcactcagacacagtcacctagacagaaaccataacaggtctccacccaccgttattaaatcatgcatatggttaggaagtgcttgccttgtaaagttagtgatggctgggcagctcctaactgcgctcctattgatctaggtccgtctgtaacttcctccaaggtgcacatgttccctttgcagcaatacagaataaggcctgtccttatcaatgacttcaaattcctgaatatgtaagaagtcactctgtcattcacttaaagatatttaaatgcctaacgtttactgggcagtgattaagtgctatggatgtcagattttaaaatgtttggcaaacatttggaatagcaactggacaagcttctgaggaagtgggagagggcagaagagaagtggaagctttccaaggacacctcagccccaggaagactgggtatcatcaatctgatgtagaaacgtcctctttattcagtcacccggtggtttacaaagtctttgacatgggagccagaagtcacaatgtaaggttagccctctaatataggaatgtgggtttcatgttgcggaggtgatggaaggacaagagccagggcattgtaagtgacagggaggatcgtggatgggataagccaggctaccccagctaggaaggaaaagagggaaaagtcaggaaggaaaagggctgatggctgggaagagatggacaaactaatgaaagagactaaaagttcagtcaaatgaatttagagaggacattaatccttggtaatataataataaagtacttgtataaagttcttgtatgttctcaggagtagggattgctgataccatgtaccaatatggaggagagatatataggctgattggtttcaaaaaaagaccatattggtcatcttatgtgtatttaacttaggataatactggatatagttttcattttaaatagtgtaagtttgcattcataacttggcataaagtgttttatctcaagaacttactaaacttgctctttaaagttcattgcagccaattggtacacaaatagttttagagtgttctattgttcttcctgagaattagactaagtaatgtgagaggagtcttaaaatgttaaatgaaaaggctcagttttaggcaatttttgagagctcatcattttcaagcacaggaaaacttttttaaaaaccttatagaagccaactggaattgaacattttaaaaattgctatggataatatacaatgtaaataataattctttgccaatttaaatggtaaattatcagaagacacacacacacacacacacacacacacacacacacacacgcacacccctcctatgaatgaaccattttctggctttggatttattctgtctttaatgagtcattttgaaatatgtgttttaatcaacagaaggagtgctaattactcacgtaactgcttcaaattattatgtacttattttttatgggctacatgtatgcctttaggttggtgtcataggtccataggggcagaaaacacggaaggtgctatactttctcttaggaaatctcacattggtctgtgtattatgaggacagaaatgatttttaatatctggtatgagttgagctctgtttttgttttatttctttaatttctgcttcttttagtatcagtagtcttatttattgatttaagcattgttagttgatttttttttcctttatttcaagtaactgaaaatttagatgtcacatttctgacagccatatcatttggttgatctccgtcattagtttctcttggggcctgatcgattgttcacagttttggctgtcattcttactgccccatggctgtgggtgtttctgtcaaagagaactgtgaattgagaatatagtggcagtttcatggcttgttggcaaggtgaccacgtaatttgtcatctgaacaaaagtgcttttggctaataacagtgatgccaggacaacatgcttaacccatttcaaaccaggacatatgggcactcaacttataggtgaccattttgcacttcagagccttaaattgtccatgtttctgcaaatctctctcttacataagactgtacttttcacaccaaattccaaagatttggaaacccaaatctttttttttttttttttactgagtcagggtcttgctttgtcacccaggctggagtacaatggcatgatcttggctcggtgcagccttgacttctgagacttaagcaatccttccacctcagccccccaagtagctggtactacagatgcatgccaccacttctggctaatttgtgttgttttaggagagacagtgtttcaccatgttgcccaggcttgtctggaactcctggactcaacccatcctcctgctttggcctcaagtgatcctcctgccttggcctcccaaagtgctgggattacaagcatgagtgaccgcacctggcccaaatcttactttatatgcagaactatgcggtagaagtggtgccttcctagaatagcagttttaatcagggctaaataatgtgcagtactctttttatattagacatattttaatggaacatgacccaaaatgtgcatttttttagatgaaagtttgggtcttcagagaaataccacgtttgcagcaagttgcttaatagagcatccccaggcctctctggtttctctccacttagaccaaagtggtactttggtctacatgtttgaaaagagctgacttaagtgaccatacattttgaagatgagaaaaactgattaactctggtctgaaaacgtttggacattcctgctgctcttcttttgtcaaatagagacataaaggttatgactggggggatggagaagaccactgaggcctcacatctctcttaaaaatctgcctgattaggtgccaggagaagtttcttctttgtgttactcaatgtcttgtctttaaaccttctggtaaaaggtgaatacactcaaggaaggtgtttgttgattcatttaacaattatgtttgatgtgtttattttttatatctgtattttatataacatgaagtatttacagtagcagaaacataagaaatgaattatttcaacagctggtacgatattagcgagagaactttgtttagaaaaatatcttgacctaaaacctgaggtcaaagattttcaagggaacaaaagtaattaaaccattccggataaaaacaaggatttgaagatgggaggagtgagaagagataggactgagctttaaggtaaaaactccaaggatttctttttaatatttagctgtctatcatgaagccctttctgtctactccctgagaacttcagttatgtgtgctgcacaggtaaacacctgtgtcagagattttccagggagagcagaaggagaaaggtgctttttcagtgaatgtgtgtgaagccccagtgtacttgagcattcacaagattcatcaagacaaagatttgagcaagagctcaaagcccaaagagtaaatgttttcccacctactcaaaactccttagacaaattgctaggctaaaatgcaaggcacctttagatcaaagtgcagggttgaagataattgcttttgtattcagaggcgggatttctcagcttacctctgggttgagttcataagacttttatgcctccatggaaagtctgagaacatcctggtaatcagggataaatttagagaagtggaagcaggtggtatcaaacaccagcttcttttccatttgcatagacatatccaaggccatgaatcctttgacatgggccagaagttctaagttgaatggtatgaaggaattaaaatgacacctgtagcaacagaagaatatgttaactacaagaaattgggatacaaaatcacagtattgagagtctcaagagaagtgtgttgaacaataatagcaattttgtttacttcatgctgaatcctagtatgtagtatattatttcaacagtatttcagttattatcatattttcaaacattaatatgcttaagccgggcacagtggctcacgcttgtaattccaacacttttggaggccaaagtgggtggatcacttgaggtcaggagttcaagaccagcctggccaacatggtgaaaccccatctctactaaaaatacaaaaaattagccaggtgtggtggtggacgcctgtagtcccagctactcgggaggctgaggcaggagaatcactttaacccagtaggtggaggttgcagtgagccaagattgtgccacggcactccagcctgggcaacagagtgaaactccatctcaaaaaaaaaaaatgcttaaaatagaacaaagcttgtcattttttaaaaacatgactcatttgatgtggtcttgtacaataaggcattgatttctggagctagtgatatattcataaacaaaccatttcctctgtcaaagaatctttttaaaatatagatattggatacccaagttattaatatttattaggacacaaatagatatccatttttactggcttatattcttctgtattgtgtgtatgaaataaagagcatttccccaagtttgaaaatactcattccttcatcataaaacaaaattcacttctaacaaagaactataaaatactgtaaaagttaattaagtcttgatttatgcacttaaggattagcctttcaggatttcagtgatatataattcaatctttttattatcttaatataaataagcttgacaattatttcgtgatcttagtttcattcaatttttacttagtgagatggcctgatattcaattcttattccagaatgagaaacatatcccttaaaataatagaagtctttgctgctttagcatatgagagtgattaggattttacattccttctagaatctattttatatggaaatgtgtacacttgtagggtaataaccttcataagtcatttgagatttctacttaatcagattctgcccatttctgctaacatattgcatagccaaatacatatgtgtataaaagtacttgtttatcagtcagatgttaaagagacttcccacgtggcaaaataacaaaccaacatagaacaggaagacccttagcctttaaaagttgattttaagagaagagcataatttctgaattagtatcaaagattagataaagaagatccaagtgaaaaactatcaatttactgcagttttagaaaaacgattgactagatacaaagacaagtcttatattttaaaaaaattgcaaataaagaagtagaatttatcactgggtcactttttatctgttagcgatttcttccatctctagccccagcccctgtcttctgtctcttctccacgcctctgtctaccccatcccttcactgttatctcctatcactgtcccctggttagttgtctttatgcacatggccgttcattgtttctttcttttttttgttttttgagacagggtctcaccctgtcacccaggctagagtgcaatgataacaatctgggttcacaacaacctccgcctcccgagctcaagccattctcctgcttcagcttcccaagtagctggaattactggcacgtgccaccacaccaggctaattttttacttttagtagagatggggtttcgccatgttggccagactggtctggaactcctggccacaagtgatcctcccaccttggtctcccaaagtgctgggaatacaggtgtgcaccaccgtgcccagcccactgttgctttctaaacaccttccagtctgattatccatcctgatgatcattcttaggtatgtagatccctaatctgataacctgatttttcaggttatcagaggcccataatgcttgggcccttagtctcactcccggaaaatttattaaataaatgtagatataatatgtgtgtttttgtatttagagatagcaccttcagcatgtttttaattcatgggcattttcaatatgaactgttgtccagaacttgcccattaaaaccatatgtgtaaaccatatgtgtaatactttctatgctgcctcccagagcccgacttagcagtggccttaatcaataaattattcattatttaagctaatatttattaaatacttactatatcagacactggagttagggggtcattgtactagtctgggtaaaagaagagcgtatttctgccttgctagtacatcagctggctgaataacaatagcatttaccaagagagcacgacgaggaagatgaagtgcaaaaaagatcatgaatgtagtcatgacagtgtctccttcaccactgtgccctttaatattggcaataacatctcaaatgctggcaaagtcaatgacttttaatttatactctttggtttttacttgtagagcattctaatcccactgaatccctcaggaaatgaatgtgtaggtctttcattctctttctcaccaacaccagggctgggccttccctatgcaatggcttactgcctgtatatcctacatggaggctgtggtaacttcctgtctggttcattcatatgggttctctcacctcaagatcagtttgaccaccctgacatacctgcctgcctggagttccctccctcatacctgtcctgcctggagtgcctctcctccacctgtcctgcctggagtgcccctcccccacctgtcctgcctggagtgcctcccccacacctgtcctgtctggagtgcctcccccacacctgtcctgtttggagtgcccctcctccacctgtcctgcctggagcacccctcccccacacctgtcctgccatcagtgcccctccctaacacttgtcctgcctggagtgcccctcccccacctgtcctacctggagtgtctcccccacacctgtcctgcctggagtgccctctcctcatgcttgcttggccactttctgtctactcttctagtcttagctggagtgtcacctcttttgggaaaccatcctgtgctggctccctgccaccatcctcccacatccccactaagaattccttccttccctctgtgtactcttttgtatcttgtatatgcctctatcactgtcctgataaacatctgtcattctcagcagtttacatgtcagtcttccccaccaatgtgagctcctcgagagtagagattgtgtcttatatacttattcagtttagtatctcctgcatcagtatagtgcctggcacacagtgagcctgcaggaaatactggctaaattgagtgttttcctcctgatgtcttcccaatgtccacaggatgagattgaaactttcctgccccctgtgtgatctgaccatccgtgtggctgaggtggcctgtctgcatgcctcggccctgtgatccagttgcattccgtgcaccgcagccttttgctactgatgttatccttgcccagatgtgttccttctttttccctgcgaagtaaacagcgcagaccaatccattcctttaagcaagagcacaggtgccaccatctttaaaaagcgcacacaagtcgatgccaatctgtgttatgtctctcttctcagaaccttcaaggaagatactgcatatgctttgtacaatacagtgtggacatcatatgccatctttattcacatagtccatgtagattacattcatgcctaccataaaagaagacactttttgagcataaaagttgtaccttatacgtctttaattttcccagcagcactgaacatagtttgaggtcttaagctgggtaacaagtaattgttgctgtaggcagaaaggagtggaaagtgatttgaaagcctaggccctgaaactggtttctcaacatgacttcaagggagtgtccaatagttcttccctcatcatggtccgtcagtgtgagaatttgctcaaaaccatgcataaggaatactatgtcaaagtgactgtgttagtggcatttcttagtgcgtgttccgatagtaatagcctgtggaccttgggcatattttgaagttcatctgtctattttagtataatacattttgaaatattaagttctttcaattccattattgaaaacgttttgtctgttctgtgtagagcacagatgggatccctcacatgaggtgtcttctctcaaaatgtatgtgaagtagcatcaactttacagataatccaatgacaacatgaggtggttcaactgagattcttaatacggtgacaggtacacagtaggtcctcaatatgttgattgatgaatgagatagttattaaacttttgaaagattctttatatatgttttatataaaaaatcacaaattctgtgtcataaaatctcacaaaagatgagtttctacgattaatggtagaataaaatgcctgtgtactacccaaaattttcctaaatttcaacgttgaatacttgtgttttctttatactttggatctttttctccatttttggaagagtgtgcgcttgtttgtattttactccctccttggaaaacggttgcccattcatttgatctttgagaaatttaagcaattacttaatatttatttttgtctttgcaattttggtgtaagtttcgtgttgtataggctattcggtagtaaacactttagttagcacatgctaatcacactcttaaatcttcacccacttgaagataactgatgtaacctactggaaattaaggctgtaaattttcgggtagagatttcagtgttgctgcaatcaatactttgcagatagtgctaacagctttttctatgaaatatgttggctagtgggtggaaaatcaatgtctgggaatgaaaaacaggtgtcaagtttgatagggacatcatgcgtttgatatttggaggccagaggggcctgtcaacaaacacggcaataattccgtcagatgcagtatgtgtggaattaataaaaatgccagaaacaaagcagtctggacagaaagctagttctgcaaaaaaactcagggcaaaaatgtatcttactcgtgcaccttaagtgaatgaattacagaaagacattgaggtagagttaaaatgaaggcacgtttgcagcactatagagtctgacaggagaaaacagtaggcagagcagtaagaggtagccacaccaccccactcaaagggactctgccaagtgtccagcagatgtgtggagatatgacggttgctgtaatagagtgctgtgatttaatttggaagtcactgaacccaagcaaatcagcagtcttttctaggccagtcaagcttggcctcattcaggagttggtgaaaatgatgaaggcctgagttagccaagaagagagaaggagcaagggataaacaactgaagacacattgatcacatgcaaaacacttgccaaatacagtgaccatcagtgtcttacaatagaaaggatgcacagttattcagtattagggaactatttgtctattcaataaattaggggaaaaataatgttgaaaaaaggggacaaaattattagtcatcgttgttcatagtattctcttcctggaaaatgtagaagaatccactgaaaatcaattaaaactgttacaagagtccagcaaatacatagttacaaagtaacatatgtaaaaaccagtaactctggagccacattgcttggattctaattctggccctactatcagttatgcaaacttgggcaagtctccttatatttgtgcctcaggttcctcatgtgtaaaaatggggattgttatgcatatgaaataaattattatatataaaacttcataatactccctgttacacagtccaacataacgtttcctcttattgttgtttccactgctattcctagctttcctataatcttcatagaaaatgtaattaagatttcatttacagcatcaataaagagtatacaatacctaggataaaatctaactagaaatactacaataaatggaggaagcctttatattttagagatgtcagttctcccaagagtaatctacaaatttaatataatttcaattaaaatcccaaaaagaattatgaagacttgcaaaatatttttaaagtttatttggagaattatgggcatgtgaaactaataaaaaataaattgaaacagaagcattcaggagaggatgatttgcccccatcatatatttaaatatgttatagctcagtaggataaaaatagaaaatacaagcatattaaatttagaaaagcggcatttcatacataggtaaccagaaatgagttatttactaactggtttggggcagcagagttatcatttggaaaaaaaatacagttagattaaccccctataggttaaggtttaaccccatagagattaaggtttaactgaaacagatgaagccttggaagtactaaaaaaaaggacaggcaaatattttttgtagttttgagcattgaaaagcctgagattcttctcagtatgatctcaaaattcaaaaccattaaataaaagattgatgaatttgactacatagttttacatctattcatataaaaaatatttttaaaagagaaggacaaatgacaacttagagaaaaaatttaaaatctgaagtaaaaataacttcagtctattatagggtcttaaaaatcaattaaaaaatgaatactataatataaaactgggcaaaggattataacaggcaatttgtgaaaacagagataaaaatacttattaaacatattttaaaagtcagtaccagctctaagcacagatgtaactatacatatgtactatacatacactgtatgtatcatgactatacactatatgtatagacactatacagtcatgtgtcactcaacaataaggatatactctgagaatgtgtctttcaccatttcatggttgtgcaaacatcgtagagtgcacagacacaaacctagatggtagagccaactacacacccagggtatatggtgtggcccattgctcctaggctacaaacctgcacagcatgtgactatactgaatactgaaggcaactgtaacacaatggtatctatttgtgtagaaaaggtacagtaaaaatgcggtattgtaatcttatgggaccactgtcttatacacagtttgtcattgaccaaaataccattctctggggcatcactgtatagatttgttaacgtctatcaaaccgaaaagtttgtttttaaatgatagtacctgaattatggactgataaccttttactagttattgtaacaaatttctaacttcctaacatgaactttataacttaaggcaacagaaatttattctcacacagcctgcagaagtctgaaatcaaggtgttggcagggccgtgctcctttcagaagctttaggggagattccattccttgcttcttctagcttctggtggttcttgccacgtgctggttcattggtttcatcactccagtctctgcctccatcttcatgtggccttcacttcatttggttttcaaatctcccttgtgtatctccagaaaggtacagattattggatttaaggtcaacccatgtaatctaggatgatctcttcatctctagatctttacattaattacctgtgtaaagttttttttttttccgaactaggtcacattcacaggttttgagacacagacttatcttttggggaaccactactcagccaaccctctgaccccaaaacatggtcctccagcccatgtgtaaaatacgttcaccctatcccaacatctaaaagtctcaacccactatagtgtcaaatctaagtccaaaatcccatttaaatatcttcaactcaaaagtaccaagtttcatcatctaaatcatctgaatcagatatgtctgagcctctgggtgtgatccatctgtgggcaaaatctccattcatctgtagacctgtgaaactaaaaaaaaagttatctgcttctaaaatacagtgatgggacaagcataggatagacattctcattccacaaaagagaaactggaaggaataaaggggccacaagacccaagctagtttgaaatccagcagatcaaactccattatatttcagagcctaagaataatactctgtggcccagtgctccactctgggctcacagttctgccggcttctgcttctgggctcaaggctctcccctagggattgttttccttttccttgaacaatagtatatattttcagccaagtggctctatcagcctgttttcttcctgtagaattccggaagtctaacagccttccttcatctcatcctgtctctgtcctcattctgtccaagctggtagtgtttgtgctgatacaacattttcataagcctagtgggtctcctgtgtatgttagaggatccaggtcattagacaagagaggcctccatggaattttcaaggataaccccattcttattcctggcttctgctgacatggctgattggatccatgagtcacacacataatccccttagcaaagggctgtccagccattcccttgaccctctctccagagcacctttccccacagtggacagcctaattttaatatcctttgcaatctggatagccgagaatcttccaaactatcaaatgctgatgtctttggcttaatagtttctcaattcgtctcttttccacttccattttattataagcagcaatgagaaaccaggctgcatcttcaaaatttggcttggaaatttcagctaaattgaataaaaagtttaattcttagatttattctatctgtgaagaaaaataacctgcaaatcatgcagaaaaaatataatcatccctcagtatccaggggggattagttccaagactgcccccctcctccccaccaggacaccaaaatctgcagctactcaagtccctgatataaagtggtgtgccatgtgcacaccctcccatagcctttaagccatctctagattgtatatattacccaatacaatgtaaatgctatgtaaatagttcttatactatattattttttatttgtattatttttattgtttttttcccccaatatttttggaccgaggttggttgaatccgcagatgcagaaattgcagatacggagggctgactgtacctataaaaagaggacagatcccatgttacgtgttctctccacaaaagaaataaacacaaactggaggggtacaaggaaacttttggagatgacagacatgtttattaccttgattgtggtacaggagcacatggatatatgcaaattcatcacattgtatacattaaatatgcacagtattttgtatctcgattattttttaacaaccctgttttttaaaaattgaggttcaaggtgaataaggaaataagctacttgaaatgattttataatactgacatatttattatgcctcagtgtatatcttactgagtatcttagagcacctatgcctcagtaagaatgaggtgtcaaaatggagtaaacactccaaatattattgaaatacaacaaagaaggatagtttcaggcggagtagccacatcatgctggaggttgcatcaactggtggtggttactgtgagaaaggaagacttggaggatcatgatagctcctcacatggcgtcggggtaactccggggaacagaaggataaaaattattgtgtttggtttcaaagtaaaaatgaattggttcaaggaggctgttctggcacaatagaaaatgttctacactctgatttgtcccaaacagcatctactgccccaaggcaatgcatgctgagacagaaggcaaagtaaccttttagagatttttatagaggtgcttatgcgttgggtaagtagttgtattaaattgtccttcattcctttttaacactaaaacagtgggaacccaggctgtaggtagaagacctctttttctactcagtttctctagctatataagttcctcaagggaggaggattggctaaggtgcaaaaatggtaaattgatagtactttgttcccaagtgactattattttgactgcagcacacaatgaatttttgtggacagaatgtaatgtgtgggcactcagctatacacagattaaaagttatgctttctcagagatgttgttaaccatggttagatttaagaccagtttgcagaaccaggcaaatctctcaggcactctctgacttctgcaccatttcctcccctgttacctgagctcctgcaacattgaagacttaatttgggcgcttcgcttgagtgcacatgtaatgtgggtatatccaaattggatatgtgttgttgtggctcaaagatggccttatttacaactgatgatgtaaatacagtttttctcatgtccacagtggcataaattttaaatgcaggaaagttgctgtttactgggtgtttatcggtcctaaggtttatgcttaatgaacttcctctgcttctgaactgggatcatgggctccttgttttatgaaagaaatcattccctaagcaaatgagtctctcagccagaaatgaatgatctggacagaatgatctggtgttgtttataagtaatatatgaagttgaataaaacatctaagataaggagaaaagtctatttttagggctgtcttctcagactaaaggtttcttcaaaatccctgtgctttttcttatagtagctttgtggcctctcctcacacttaataccttcattagttacaattagcacatctttttctcatccactttacaggaaataaatttcttatatctttactaaattccaggctctcagaaatgtgtttgtgaggaaaaatattttctgcttcagataatggcttctttagatgtttgaaaagtctccctttcctttttaaacgtgattttactatttaattaatgagacagtatactgtcctccttctgttgctgattcaacatcttaagtgtgagaagcctatattgagttaactgcagttattgaaaatacccatttctcttgaggtactaaattgctcattttgagaaatgagtcaaatgtatatatgaataaaacagtctgaattcctgtaaatatactttctctaatatcctagcttcacaaatcttttagtttccaatcctctgattatttttttttctcagtccaattctgatttgtaaaatcttaagtgagttaatttccttaattctggggtgctctctaaaggctgagtgtggattgggtggtagaactctgctaatctgcagaagacaaggtctgagatcgtgatggactagtaagaaatccacacacccaaaaagcatatggaagggtgcagaggtgcgagccatagtgttgtatgttagctcctgatcagtgatgtttatctaataattttggtgttttcctcctctttatgtgtcactctttgaccttgaacatggttctacttttgcagttcttatggtatattaaaattatttatgtttgactgctgtaatagactctgagcttcttgtcttttcatgtttatatcacctcttaacttatggtgcatattcaattattatttattgaatgaatgaagatgtctccccaaatactacttgtgaatcttttagaatagagacacgtggctatctctgtcttccactggactgtgctctaaccctggtatcttcagatttacccctgaaatggacttgatctctggaatttagaacaaaattaattgtcatattaatcatattttcattggttttagtgagaaacagttgagagggtaggaggaagacaggaacctgtgcagttttaaaaacccagctttctgggttttgtttttattttttcctcaattagcttttagatttttttttttttttttttggtgttatttgagacagagtctcactctgtcgcccaaactggagtgcagtggtgcaatctcagctcaatgcaacctccacttcctgggttcaagtgattcttgtgcctcagcctcccaagtagctggaattacaagcgtgtaccgccatgcctggctaatttttgtatttttagtagagacggggtttcaacttgttggccaggctcatctccaactcctagcctgaagtgactcacccacctcggactttcaaagtgctgggattacaggcgtgagccactgtgccttgccagctttttaggtttttaagcacatagccgtatttccaagcatcttatagtcacagtgttcatagtatttccagcagccctttagtcagcctcttgattgttattatgcaagtctctgtcttacccctaccccagttttaattctggaaactgcaacatgattgaagtacgcacatagccagaattgggatagttgttagagttagttctaggagcataatccatagtaaagcgtttggaacatcttgaattggtctgaatattagtaaataactggaactattttcaggggtttttttttgccagaattatattagagaaaacctgatacattttatgattttatgcaactcagaagtaattaccaaattcataattctgtaagagatttttaatacttgcattattagaatataccagatttattatctagaaaccagcctttgaaagttaataaaatgcagttgtcagaattgcaaatacctgttaaatcttatatattattttatatgcatataaaccatgcataagaaaatgaagcttcataaaaagttgtaggaacctttacagattactgtatttctctcctcaacaatataatacttgttcagatttgttttttaataaaaattaaaggagatccatcttaatcttaatatttccacaaagtttaaatgttgttttagaatcattgcttttatacttgtttttcttaaaaatacttaagtataccagtttagaatactgtttgattctataataagtattcaaaaaatggtagggattatctttattatttaaaatgtggtatttgatacctgctaagttccgtatttttcgttttaaacatttttaaattgacaaaaattacatatgtatggtataaaacatgctttgaaatgtgtgtaccttgtggaatggctacgttaagcaaaatgatatacatcacctctcatacatcatttttttgtagtgagaatacttaaaatctactctcccagcgattttcaagtatagaatacattgtcattaactacattcatcatgttgtacagtagatctcttgcagttatttcccatgtctaactaaaattatagatccctatttattattttccaggatagaagatttttagaggtgacaggccatgtagataaggctggagaagttcttgaacctttaaaattatgagaaggaccttttcatatgcatggatacctgggccctgctcagaaataattgaaaaccccaattaagaaaacaaaaaccttttcagatatattgcaaacagcatattgtaaaccaatagaacaagttacggttagacatttcaaatattttttgttcttggctttaccaaagaagtagtcattttatgagatggaagaaatgaagcctttcagggttgatttccccagaagtagatgattggatgcatcccatgtgaagacttctgggtgtgttgtgtttgagcatgtggagggtaaagaagttctggctggcatgctttcttagagtgtctaccacatatctatgcttgttatgtgcagccaagcatgaagcctgttgttctcactctcatcctagtcatcttcccattgagaattatttttctatttgggtgattacccaggtccaggggcactaatcctgcttcctgtaggatggttgggtatgacaaagtgtaaggttgcattgggctcatggtatgggtgcaattattaaagttatgtgtcaaatcgaagctgatttgaagttaaaggaataaggtatagttcaaggtcattgaaagcggtaagatttaaagaacagaatcacagatttgtttgtaaacagtgatatgtatttttatgtgaggaactagaaaaagaaggttcagtaaaaaactacaagtgagtttcttgtcgtttgctaccttttaatctcaagtttttaaattttcacttctgtgttctattgtgccttgttgtcagatatttaaaacagtaaacatataattgttcgatgagagagctatttctgttcattctggacctggatgcactgagcagttcaaagtttatttcaccagtttatctggagaatgttgttcatttatcagtttctgcatttgagagttaacttgctaaaattgatttcatcctatattccttggctcaagttgattacaccaatcagaatctctccatttttaaaaaattaactctgctatttagccatgcagcattagttgataacatttctttagcatatatttatgtgaccatgcagtcttgtcacttgggttcagtaaagtcttgtctcgcattctccatttagccaacattgttggtggtaatgacttggaattaatgcagtttgtcagcagctatagaatgcagtgatagcaggaacgtccttctacatcttcttcagactgatgtatgaaatagcatatcccatttatttctgtaccacattataaacaacatctatgcctggctttgctcaaggatggagctactaacatctgtgaagattgataccatggtttatcattttaccaggtgaaattcatggcaaccttaaaagcctaagccaagagcttaaagtattgctcaggtgtggatcatggattggattaaatagtgccgtgaaagccattttactctttcagctccttggtggtatatagacacacacttgacatttggtggggctttgaagttaattaaggcatcattaaaggcatgactttgagttagtctgcactgagatgcaccatgtgtgaccaaaagaaaaaaaaaaggccaagcatatttgtcatttctactacagtgtggttatatcttctttcttataagatgtgtaagcaatgtcctgcagtgtgtttgtgcagcatttatacccagaacttcttatgaaaagctggccatactatgattaagtccacttgtggttgggattcaaagtccccacagtagagcttgagttggcttaagcagatgaacaatcgtcagacttagttactctttgttgacttacatctgtattgtggcacctagggtgcagtggggcaaactgtcactgccacaagggtgaagtgaaaagtatatgtctatactcttttatctttcatttatcagctagacacatgtttccttcatgcaagggaaagaaaatcacaagggcccatgcttgtctctctttagaactctctagaattagcttgtcatgaaatgtaaaactaatgtgcagttgtaaaaactgctgccagctttttcctcactgcaggctgatggctaagtagatttggaaatgaaaggggttattataaagtgattactgaatagctaggtatgtcatcttaaacaagcagctaaaatctctgtgttagacattcaggctgtagtcttgttttgtatcattcatatttaagatgattttgattgtggaggagtaatcaagcactggggtaatttaagaaaaaatatatactgagtgatttttttcattgcttattaaaatacattagaatttaaatgaggcattctctaaaatgtgtaactattaagtatgtaccaaatataaaaatctgaatagcagttggctttagttcagagttaaaaattcttcacttgactaaaaacgtatttatcttcttttaaaatttaagtaaaacgtattgtaaaataatatattgaaaatggcatatatcaaagaatgaatggtttaaaaattataactcttaatatcttattactgtcagtttcatatgagagggcagatgccttgaagaatcttaaaagaaaaacaaaattaaaataaactgcactttattacagcaaatgcggtcattttcaatatccttctattctttttaaatgcttttcttggaattgccatctatgttgctggcttgaacaatcacataacctctgactccttctcccctacccttgagcttcagatctagtgtaagtgacatgctgggtgtcctttgaggatatctcaagcagcaagcagtgggaggcatctcagcctaggctcttgtcccattgtcccctgtcctggcaatactgccttcagtttgagctagctttttgggtgtctttttcctgtcccttttcccaccttcctgctgtacacctgcccagctaattgatcacagcccatggattgtttctcatgttgccattttcttggtccaggcctcatgtactcatcgccaagacagttccccctgtagaccctccaactcccccttttctgcaggcttcccctcttcactccgtctcaaccgcctacagctgcttattgtgtctgcttcccaggtcctcagccctctgttccccacagctgggcacactgggctcagtaggcataatcctgtactgtcttcaggccctttgctgacctcatgcaagggagatgtgaagagaacatacagctcagcacctagttcccttgcttctggttcctgtatagcctgttttatcttggtgatacatgaggagatcagatcctaacttattagccctaccaagcaacaaggtgcctgtctatggtggtacctggccctctttcttagtagtatgcctagtatgtgccgcagattctagtccctgcctgggagcttcttagtcactggtagaatttcttaatgttaacctgaagccgcagttttagtctgctgcccagacaggctgtgtgatcccctgacattatatcttcatcaatatggtccactctgcctggattgtttctgccctctttcaattatttggtcctatggtagtatctttattatatgcttgctattctaagtttacattagaaatgagacttgagtgtactgatgctgtttttttgaggtatgctagttaggtattttttttttcacttctttttcacgttgttctccatgttgggaggaatgtttatcctacaatcctgatgcttccatggagaagtcagggccacctccccaaccctcttccctctcctgcttcctatcaaacataaacaaagctggacactagttaaagtgataattattgaagtggggaaaagagtccagcatgatctaaggtcacccttgatctgtgcagagaggactgggcatttataaatgagaatgagggagtaggaaggggagggggcgagctgggtctcaggagagtcagggaaatgaaaaattataaaaagcagaaagggagggttaatccatgtgaaaccatctgggtttgttagctagtgcttatagaagttaagtttctactctttggcagagaccgggcttctgcaccctctaagactgggagtcagggagccctatcttcaagtgattgccacggaacaaacaacaaattctctgtctggagttttctcaggcaggcactctcagaggggctaggatcatcctacagatgaagcctcgagcttttagaaactgtgttagtgtttgttcaagtctttataggccagggttgaggcctagtcaacaagagagctcattggggcctgacaagagtttgttcaaggggagaatcttggtaagctctcacttcaccctatgagaaaaatgattcattgaatagatgacatttgaaaagggaaccgaagatattcagtctgtttcttctgggcattgtccacgggacacaaatgctcttttctgcaactagaggtaaattaaccatccctaggtgggagtgcagagtgcttggatcatctagtgaatggaggatgtgtaaatatgactcaagagtggattcactacgcagttgcagtaatcaagacatgcgggcacaatgataaacatgttgtgcctgtaatcactttgggaggccaaagcgggcggatcacctgaggtcaggagttccacaccaacctggctaacatggtgaaaccccatctctactaaaaatacaaaagttagctgggcatgatggtaggtgcctgtaatcccagctaatcgggaggctgaggcaggagaatcgcttgaacccaggaggcagaggttgcagtgagccaagattatgccactgtactccagcctgggtaacagagcaagactctgtctcaaaaaaaaaaaaaaaaagaaaaaacagaaaataaaaacaaaaaccatgagatacaactttatacccactaggatttctataaaaaaatatggaaaataataagtgttggccaggatgtggaaaaattgaatccctcgtatattgctggtgggaatgtaaaataatacacccacttcataaaacagtctgacagttcctcagatggttagacagaataccatctgacccagtaattctacttctagctaggtacccaagaatatacctagcacatgtgaaaacatatgtccacacaaaacttgtatgtaagcagggcatggtggctcacgcctgtcataccaacactttgggaggccaaggcaggctgattacttgagctgaggaatttaagaccagcctgggccacatggtgaaattccatctctaataaaaaatacaaaaattagctggacgtgatggcatgtacgtctggtcccagctactcaaaaggccaaggtgggaggatcacttgagcctgggaggcggaggttgcagtcagctgtgatcgcaccactgtactccagcctgagtgacaatgtgagactgtctcaaaacaaaacttaaacacgaatgttcacagcaacatttgtcataatggccaaaaagtggaaacaacatatagttctcatcaactgatgaatggcttaacaaaacgtcgtatgtctacccggtggaatattgcctggcaataaagaggagtgaagtctgctacatgctacaacatggatgaactttgggaacattgtgctgagtaaaaggaagccagttacaacagaccacattttgtatgattccagttatatgaaatacccagagtaggaaaatctgtagaggtgggaggtagattagttattgcaagggcacagggtggtgatggttgtgggaaatgggagtgactgctaatggatgtggaatctctttttggaaatgttccaaacatagattgtggtgatggtcacacaggtctgtgaatgtactaaaaaccattgaattgtacactttacatgggtggattttatgacatattaactatagctcaaaaagatgttgaaaaaagggacttaagtgaggaaaactaagaatgattgtaatagcagacttccacaaatcaagtcttttttcttcagtcgcatatgtcagtaattgatgtggtttggccgtgtctccacccaaaatctcatcttgaattgtaatccttacgtgtcaagggtagtgtcatggggaggtaatcggatcgtgggggcggtttcctccatgctgttctcatgatagtgagtgagtttcacgagatctgatggttttataagtgcttgtcatttcccttctggcacttattgtctctgctgccaccctgtgaagaggtaccttctgccatgactgtaagtttcctgagatctccccaaccgtccagccatgcagaattatgagtcaatgaaacctcttttctttataaattatccagtctcaggtatttcctcatagcagcatgagaacagactaatacagtaaaaaagtctgatattagtgaaatcttcacttgtctaaaatcagtaggtatatgtatctctcagttgagaacctgaaagagaagacagttatttattgaccttctaaaacctccacatattaatgcatagctgagtataccacttaccctctgtgtatcttgcatctattttctatcttgtatccatcctgtgtcagcactgttgcgttgatgtttttaaatcagttcccaacttgcagcaggggagggagggagcggtcagggacgaagtatgattccctatcccagcccctccccagggccccagtccgtgtgtctctgggtcctccttgatgtggtttccgtgcttgaatctattacatttttttccatgacatcatttattctccctgccttccccttcctcacaagaagatctagtttcaggggccagcattccccagtattcccagtgtggtcagattgactttgtgcagttgcatcattcatggcataaatgagatattaataatactatatggctgtcctccagacccatccatactcctggacctccaactcaaagctaagcatcaccacctccccacacttgctcagggagtgttccccgcaacatctgcccaccatgtactcttgcaacaaggtattaataagcgagaaggtgtctagaacttcaagtgaccactagaccaaataaaggttttttcttaatttgaaagatttgattcttccctgagaattcaacttcagaaagaatgaacgaaactaagactttttaagttatttatcatatctataacccattagaattaatagctgtagatcctcatgaaaatttttagttaattttcaacacggtaagaatcatgagcattttaaattaaatggaacactagatggcaaatgaatgctttaccttattaagatgattcaatgtattccatagtttttaggccacttctaagcagtatttcaaggaaacatacttggtagtaataaaaaaaatttttgtggcaaataaacaattaaaaatgaaagatatgcacatcaaactgtgattcatttttataagtttaatgaagaattagctatatgataattcttattttgtgacagttacattgttattgtattcaagaaagtaatacctacaaaaatagcaaattttgaaaaagaagatagcaccaaagaacaaaaatgtcttgttttatatcagtcacacaatgcactttctctaggtgttaaattagtaatacagtatatgtgtgtacatgtttcccattcagggatttgtgaccaggtggaatgagggtggtctctgagtcacctggagagctttataaaactccaccttaccctcatccccaatagtgctccccagcctcccaccaagatagctgaatgtcagaacctagagggaagagggtaagatgggtgtggtacgtggatgaattggccagggactcctggggctgtgcaacccacactctcctcatgttggtggactgtgaagatcaaggatgtctggaactttttccagttgagtgctatggacttgagaccaaagttaatttggaaaggaagtttggggtagccattcataaatacatgtaatagactcctcttgaaggactacggaacagatgataggcctccaagagtgttagagtaagtgagtatgaatccgtccattttcagtaaataaatgattgattccctggcttccaggaaaacaatgaaaaacatctacattgcctttgtattttttaaatcagcaaattgagcttactcagattaccttaggcttgagagagatagaaaagtattgcaaagtagtctgacattggtgggaaaatggagttgatcccacacaaaaactatgtttagggaaaaattgacattaaaatggaacaaatttggtagcaaaataaggagataattcagcagagaggtaaactgctctttattaaggagcaagcttttttttttcttaagttgttttatttgtaacagaaataatttcaagttagaacctgtattttccttctttctatctttttaaaataaaagtggcgggttcattttttccatagcatacctcctcctgccctgccattccagttgtcagtggggtgctgagaacacactcttctattgaaactgagttttctgtcatctcattccccaagcttccctggaagattagcaggatggaaaacctaggtttaaaataagaactaacttatcaatcataggctcttttaaattgaggaagtcttttttaaaaaaaaaaaaagttggtagtgaaaacacagaagaataattacagtatagccatcaatctagcagagttgagtgtggtcttttgtgaaaccatttgcgtagacttgtaaacaacttcaaatagaaaactatctaatcataagaagattgtaaataccaaaataggaggctctaaacaggtaaaaatattttaagtaacacttatctgcttagtattaactagaggtaatagttacatttgggcaaaactgaaattgtatttgattcacttttttcatcactaattacattacttctgtagcaaagagtgaatggtttgggttctcttttgccctgggtaaaatatcagttccgggtaaaatatcagttccaaacttccaaggctttttgtggatatcatagctttatgagggttacaaaaggtcaaaacccattccaaaccaatttttgacagttctgaaaaactctgtgaaaatcattttgcctcctcctgttttatatagtctgaaataaatatcaaggaagtctttcactgcagactcatatttgtttcatacaacagtttccttgtaaagttcatctataggatgaattgcagcctgtttgttccactgtatagaaacaattcaagattctaattttgagtgtagcagtggtgctccttctatagtgatgaactttacactttggaaatgtcaccaaggagctcaagcaaaaaccgaacagttccagtggtgagtgaaatccttgtttatagtgcctgtgtgacttccttaaaacagaaaagcacaacagagatgtgagtcacaacacagaaacttggaaaggcttttcacagaaaataggtaaatactgcagaaaaggagatatttctagagttgatttatgagacaaagagttgatttatgatctaaatgttcgctatatattatattgtgctagtatccttttaccaaatatgttgattaacaaatgtaggcattttccaggataaagattcatgttaatgggatgagatatgtaacttgatggttacagaatgcagtaagacatagagaaacataataaacatatatatatatatactgggatcttgaccatgtgagtccatgaaagtctgtgaggttttttttttttcttttttgagatgaaatcttgcactgtcgcctggcctggagtgcagtggcgcagtctcagctcactgcaacccccgcctctcaggttcatgtgattctcctgcctcagcctcccgagtagctgagactataggcacacaccgccacacccagctatttttttgtatttttagtagatacagggtttcactatgttggccagactggtctcaaactcctgaccttgtgatccacccacctcggcctcccaaagtgctgggattacaggcatgagccaccacgcccagccaagtctgtgagtttttattgcaactaagaaggaatagtcataaagggatttgattttgaaccaagactgaaaggaactgaaggctactttttggcagattaaaaggtggctgccactgtatgcatattggatcagtctgaacagagatattaattttggagggagaaccttatttgaagtacagcagatagatttgcttgactggtatggaaagcaagaagggttctgtgatctctttgatagttgtgacgtaataatggaaaggctttatttcggtcagacgataagagcatgaattagaagtcctttgattgttgcagatgaactgtcacatcaggaaggcattctggcagtggctggagggacagataagttagcggggagtaactagactatgaaccttggagaaaatgtagtttaagtatgaatatgaatatgaatattgaactctgattagtgaataagtggtattagtttcctgaaaaaaaaaaaccctccatacactcatacactcctgtcaacatgcatacctcatagtacattcactttcgtaggcttgattcatcataagttctgaaattgttaattataaatatattctctaaggactttcagtgtgcacagcatatacgtatatcaagtagaaagtgtatctttttatcatgaaacttacataaacataaacctcgtagatttgtgtatttttgtggcagttttccaacagatgaaaataagtgtcttgaggaaggaaggggcgggctctcttttctaattgcacagaggtacaatgtgggttagctgtggccttggatggtaacctgcctgactgctctcttcctcctgatgtgacagccctgagttccatttcatatctagcactaagtttccaagaatgagattcagaagtttgggtgaggggagggggagcaacaactgtacccaagtgtcagagccaggctgcactcaggcctgaggctcagcttttaggaaccaaggtctagtttcagggataagaatattactggtaggaagcctattactgtgtgttttgaaagagggggctttgtaattcttttcaagtcacaggactccatcccgtgggggtatctgtggaactgctgaatctttaatgacgtatgatcttgcttcctgtaagttaagtttgcctggtagtaaccattgtacctctctcagaagaaccaagatatactgttatccagaaaagaaatctcaaagagccaacaatctttctaggatattcatgcctttcctataataatgttttctgaagttatgtaatatttgatacaaacaaaaggacatacgtaacctacataaattgtgcagcataacaataatcaacttcccatcttaaaaacagaatacttctagaaccttttcccctaactgtagtcttctgctcattttatccctgtgtctccagaacagaggtagccaatatcttcatttttatgtaaatttttcctttgctcttctcttacattgttattaaaatagttttatcgcatacgtatgtattcttaaaccatttccttttgcatgtttttcaggtttataagattgcatcatagtagtcctgtgggacttgtttttttaattcaatataatgtgtttctgaaacacattatagctcatagccatagctaattctgtagtctaactttccattgtagggatatttatctgcttttggctcagtaaatatttggattgtttccttgcttttcttttttattcttttgacaataatgctggtaaagacatttctgcacatgtctcctggagcccagtgggaagaatttctctaggaatgcatttttcaaaccctttagatgcagcatgaaatgtattttcgttgttacatggttattacatgatacaatccatatcttttaaaatccattttcatgtttcttttctattctctttcattaaaacaaatgccactgtgatatgacctagggatacagcctgcactctgaaaaaacactcctccaagacagaacttctccaacttcagtgtgcaggtgaagattcagcttcaggaggtcagaagtagggcctgagtatctgcattcctagtaagcttccaggcgatgctgctgtgctggtgtgagaaccaacactattttgaatagcagggctctaggctctttctcaaatttctctgatgacaagaatcacccaggctgcttcttatgatacaaattctggggcttcatcacaggcccaacaaatctaagtctctggggatgaggcctagagagttttatagggtcatgtgttgcataatgacattttggtcaaccgcagaccacatataccactgtggtcccatatgattataataccatgttttcactgtaccgtttctatgtttagatacaaaaatagttaccactgtgtttctgttgcctacaacattcaatacagaaacatgctcttcaggtttgtaacctaggggcagtaggtggcaccctatagcctgggtgtggagtaggctctactgtgtaggtttgggtaagtgcactctatgatgttcacacaatgaaatcacctaacaatccatttctcagaatgtatctctgtttttgggagatgcatgactgtatttttgaaaatctgccaggttattcttctaagtgaaggaatactattctaggatttatgcctaagaatataacagctggattgtattctaaggttagctttacaagatgatgccaacttgtgttccatagtggctgtaccaatcccactctcattaatgatgtataacacattgcattgatctacattctgccaacaatcagtattaccagactttctaatttttgtgaatctgattggtatagaatggaatttactttgactctaatgtgcatttctcagattagtattaagcttgagcatattttcacgtttgtggtctataattttcctcttcttcaaaagtcctgttcttttaccaacttttcttttgagttgtcagctttttcttgtgattggtggaagttctgtatataatcaatatctctcgtttgtttagtggttgccaatgtcttctattctgtgctttgccttttacttttctactaaatacctctttatatcatttgtctttattgtgtttggttgttttcccttctttacaataataaggttttagcttaggttttcactttccttatgatacattttgataaatatgttcttaattttagtgtagcataaattatcaagcttttcattgatagttggtgcttaagaactatttctttgccctgtaatcagaaaaaataatcccctacattctttaatttaaaaaattaaatttgggtttttgtgcttctaattgagtcagaattgatttttgtatatgatacagagtaggaatccacttctcctagcaccacttgtgtttcccccaggaatcagaaacaccacctctatcatatagaacatcaggatttctgttgtgctccatgtctgttctttcagcaacaccacactgtgtagttactgtagcttttaaataactcttggcatctgatagaacaaattttcctacctcattcttcctacggagtgttctgtttggggacctttgcacgtctttatttactttagaatcaatttatcaagttccttaaaactctaattaggttttaattgaaattgtagtgattctatagattagcttggggagaactgacacctttaccacattgagtctgcccattcataaacatggtataactccaattattttggtcctcactaatgtctttcaatgaggttttggatttttatctgttattggtgtcttgtaagatttattcctgggctccttatatcatttgatcttgttgtaaatgaaaaaaattcagtaatgtttcagtttgataatatacaaaaaatgcagaggagttcaaaattaatcccctatttggtcaccttgctgacatttgctatttttgtataacttgtaggtcctgcttgtttgccaagcctgtcacattgtctgtgtataattaaagtgctgttttttcttgtttcattcttacacttttcatttcttactgtactgaatggaacctccaggaaaatgttatagtgaaacagcttagatttattttttgtaaacagattatggcacgatgttgattttacctttaattctctgggcattttaatagacaatattttatttacatgtattgtcattactagtatatactagtagtaatatatactagtagtagtaatatatatatatatatatatatattactactactagtggtagacttctgtgtaccacttttctgtttgctttctggtttttcctgtttttctacatttcccctcaccccttgccttttttcttttcttttgtttttttcccataattgactgaaataactttttttctttagatgagttacttgttactgaaggtattatcctatggctatctgtatagtgattaccctagagagtttgccttgcatacttaaagtttatagttgatatcttaaacttcccttcccagtgatggaaagatcttacaacactgtaactctgagcattgccctacctgtgtgtatgctcttgttgtcggcagtctaattctgtatatataaaaagctctaaaattagacagtattgttattttacaaacataagtttttatgtttttttgctcaccatttcttctagcatctcagaccttctttcaaaactcatttttctttttgaaggtgatcctttattgcaggttcattggtagtaagttcactcaggtacaattctttgaaattagctttattttgtcttgatccttgaatgatagttttgctacgtatatagttctaagttgacatattcatattttctctttgtactttgaatattttgttcccttgttttttgccttccactgttgttgtctagaactctttgttcaatctgccattactttgtaggtgatgtgctttttctctctagatgcttttgagatcatctctttgattattttggtgttggtggtttaactacattatgtctaaatgtggaatttaatttttctatcttttgtatatgttatactttctgtatcttttgactgatatctcttgtcaattctggaaatttctcagacattatgtcttcagttagtgcctctcctctattccctgtgttctacttctggaatgccaattagacatagatacaccctctaattttgccctccatcttcctttcttattttctattatgttcctatttctatttttctgtgctacattctagataatttcctctgatccatgcactacttcactaattctgtcttaagctgtgtccaatcttgctgtctagttttatacagtacataattaatgtcctatccattgaggtttttgttttatttcaacagtgtttttatttctaaaagttacgttagctgtttttaaaattggtcattttcagtgacgtattacatgttcatttttagaattacatttttaattttagaagtggcacgcaaattttatattctgaatctggtaatttgagtgatgtgaatctgttgtttcttatctcttttgactctgtcagggcatcttgttttctgttatttttgttaatctttactagtgagcttatatttgggtgggctttatttgtgaaagtaggaggcctatatttatgtatcagtgtgtttatagaagatttgtatttgtgtttgctggaatcaggagatggtactgactgcagatactttacacactgttattcgtatgagattaccttgagaacatcatatttggcttccctgcccctggcccatggcttaatctttggatgccggtgctgatatagacaactagagttccaccttaccctttgttttggataagggacatggtgtaaggtgttgctggagacacactacatcctacgcaattaaaaaaattgtcttataccggatctagttgttttcaaatgggagagtccttgagagtaaatgatatgccattctgttataatcagaaattgtaataattactttatggatgtattcttcatttattaatttatctaattatttgatgagtctgaatattttgctttcatacaaacacaataataatatgatataatgagtggttgttgagagaaattcttaacataaacctttgtcaaatacagttgctatagccaaagaaagaaatagttctatgtattgtaaatctctatttgaaatactatgccaaataaatgatgcaactcataatcgcacattagggctggttgcagtggctcatgcctgtaatctcatcactttgggaggccgaggcaggtggatcacgaggccaggagttcgagaccagcctagtcaacatggtgaaactccgactctaaactacaaaattagccaggcattgtggcaaacacctgttttccctgctactcaggaggctgaggcaggagaattgcttgaaaccagaaggtggaggttgtggttagctgagattgtgccaccacactccagcctgggcgaaagagtgaaactccatctcagaagaaaaaaaaaaaaagataaatgcacattagactttgcttatttacatttaactggaaccattactttaagatctgtccttcggagccagtataggcccatagccttgaaatgcagccttttttagcaaaaaaaaaaaaaatggaacatctgaacattgtttttcttttggagagaagtttgacattgtctgttgtacttagagatgtataacatctacaagtcagcagtcttacttttaacatgcactaagggaaactggccaggagggcgtatagacaaagatgctgctcatagcactgcttgtagtagagaaaaggtaaactcagctatcttttctgcagtaagggaatggataagtaaactgtattttatttatttaatgtaattctagacaccagttaaactaacatagcttcaactctgctatattgaatgaaatctcatgttgcaaaaaatagtagcatttttgaaaatttttaagcatcctagatatatataataaaagtacaaaaccatgtttgggaatgatagataataacctttgaataggaagtaggaaggtggcaaaattttatatcagtaatattttatttctttaataaaaagtgatctgaaacaaaacataaaatgttaacatttgatattagtggatacacagaatattgttttattttgtacttttcaatgtgttttaaaggttttattacttaaaacttcaaaaaccctaaacaccaacaaaaaattattctgtttaaaatgaaaacatatttcaaccattgttgtgatactgtgatacttcttttttttttttttttttttttagctattcttttttttttattatactttaagttttagggtacatgtgcacattgtgcaggttagttacatatgtatacatgtgccatgctggtgcgctgcacccactaaatcgtcatctagcattaggtatatctcccaatgctatccctcccccctccccccaccccaccacagtccccagagtgtgatattccccttcctgtgaccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtgtcctgactttttaatgattgccattctaactggtgtgagatggtatctcatagtggttttgatttgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattaggtcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttctataaggtgtaaggaagggatccagtttcagctttctacatatggctagccagttttcccagcaccatttattaaatagggaatcctttccccattgcttgtttttctcaggtttgtcaaagatcagatagttgtaggtatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaatttaaagtagttttttccaattctgtgacgaaagtcattggtagcttgatggggatggcattgaatctgtaaattaccttgggcagtatggccattttcacgatattgattcttcctacccatgagcatggaatgttcttccatttgtttgtatcctcttttatttccttgagtagcggtttgcagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctgaccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatgtatccatttcttctagattttctagtttatttgcatagaggtgtttgtagtattctctgatggtagtttgtatttctgtgggattggtggtgatatcccctttatcattttttattgtgtctatttgattctcctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaactgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttgtgttcttttacatttgctgaggagagctttacttccaactatgtggtcaattttggaataggtgtggtgtggtgctgaaaaaaacgtatattctgttgatttggggtggagagttctgtagatgtctattaggtccacttggtgcagagatgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactcttagatccaacttgccagtgtgtgtcttttaattggagaatttagtccatttacatttaaagttaatattgttatgtgtgaatttcatcctgtcattatgatgttagctggttattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggctcccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagactggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagtagatcgcatcggctcctgaggcttctgcattcttcacgtagttctcgagccttggttttcagctccatcagctcctttaaggacttctctgtattggttattctagttatacattcttctaaatttttttcaaagttttcaacttctttgcctttggtttgaatgtcctcccgtagctcagagtaatttgatcgtctgaaaccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggagtaccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctcctagagctgtggtgggctccacccagttcgagcttcccggctgctttgtttacctaatcaagcctgggcaatggcgggcgcccctcccccagcctcgctgccgccttgcagtttgatctcagactgctgtgctggcaatcagcgagactccgtgggcgtaggaccctccgagccaggtgtgggatatagtctcgtggtgcgccgttttttaagccggtctgaaaagcgcagtattcgggtgggagtgacccgattttccaggtgcgcccgtcacccctttctttgactcggaaagggaactccctgaccccttgcgcttcccaggtgaggcaatgcctcgccctgcttcggcttgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatcttccattgtgacacttctaaccttatttttgtacagttcatcattcagggagaataaaatatgacatgttatcattattaagtgccttaccaatacccacatttctttattttggaaggtatcaacagtaaatttctacccctctttttccaacctctctattcaataacacttttattttttatggatttaggggtacaagtacagtcatgcaatatggatatatggcgtagtggtgaagtctgaactttcagcattcaacaagctttttacttaaaaatttaacttaaaaaaattctcaaaatatttatcctgaaagacttggtgaaattattctgaaaccagataccttgaatgactagcccagggtccagtatgtattcttttactttattttttaaatgtactagccaaaccaagaactaagcaaagcatttggacatactgcattacctaacattcaacattacctaacaccactagggagtgctccttctaggctgtcaattgtggcctatgtttagagtgttattttcccttacctgagatctgtgttcttactgtaagtgtatatcctagtcattttattatacaagataatcctgaatgtttgccataacatgtaaataagaattccagctttcaaatatgatggaagtttaaatgattagttttttaaattttaaatttaataatttaaattaaattatttagttgctatgtagataatctatttcccagcgagatggggcagtagtttacttacctttacaatttaagcggagttcaaaccagcatttggaatacaagaaagacatggtgagactatgtccatcttaaaccaagaaataaagtagaatgattttgtgtagactttggcattgttacactttccttcatttattctgtaagactatttttttttttgcttctcttaaacgagtactgtttttgaaatttggcctatttgttaggaagatactattctcccttatataggattgtatgattttttgaagaaaaacagattgtttccaagggcattttttgatttttgttatgataaaatgtgaaaactattaatgtgatatctatgaaaagtattctggaggaaaaatatattcaaatttatataatttttaggataagtttgaattcgttccattacatcaccagtacatagatgcctgtagggcagtgtaaattaaagattgttgtatcccagcaatttcagcttgactgacaaggtactttttaaactctggaaagcactgaccaattgaaagcctttaactacttcacctaaaaacaaggccatgtacccagaatcgttgctgcctaggaatactgaattttggggtaggccactataatattagttactcagacctttgctctgatttcactaaatagtaaagtaaagggagctattgctttattattttgtcaccctctagtgtgaccggtgaggcaggagtacagtagctggaggtcctgaaggggcccaccatgccattctggttgttattccctttattgtaatacacctccatagagttcattgagaggtagaaaagagaaacctgttagtgggagcattggttgtaatctatgtttttgattatcaatgacatgatcctaaaattatacccaaatatctctcacaggttctgaaattgagtttctgaaaaagcactgtagtagtaataaaaggtaaagtgcagagttccaaagaaatgagctgtgaattgaacctgcaatggaaattgatcctatcagtcagtttttgcccttgttcatagaaaaataggactgaatgtagaaggagccaggatcactgattaaataggatgctgaagtgctggaggctagaagtgggcttgctcgtcccttaggtcagacttctctgctggaaacctggctcaagctggcagaaaaagaacagaatgaaaaatgctgcaggcatcagtgggagagtcggtaagagctcactgactgagcttcctgcgtgacagccagtgcacttctccatagggaggccattctcatctcttatcatgagtcagtgggcccacagtggacccactggcctcatgattcatgccaacggggcctgtcatgataccctttcagggaagcagggaggcatcagtgtggccagagggtgtgagtgtgaagaaaaatggctttgctatcaattccattctcagtagcatcctcaggattgtgaggaaagaggacaaatttcctacaactagtggtcctatgaataccatttattacccttttatctaactgtaagagatctatattgtgcacatagaatgcttgtaatgctgtgccatgttttggggggacagtgtttgtattctactcccagaaatgcagtgtgagttgcaattagcctaccaaaattacacatttctggttatgaagttgccatttgtttcctacagtgtaatatatttctacagtgatgcccttcagagtgttcagtgatcatcagtataactcactagagtaaatgtccctgtggaatgcctcattcacagttagtagcacactaatggaaatcgctctgtagaaacattgaaaacaaaggtattataaaacactaacttgagatgtaattattataaatccatttctggatcagaatttaattttgcaaaatggcagaaaaaaaagtaaaaacaaagaagcattgaaatcaggcaatttgcttagtatgagaattgtaaaagaattgtatgagaattagtaaaagaattgtcagatttccttagtcattggtcatagcctatcaacactatcattaaagaaggctgctgtcataggtacatggtagcacatggcatttcctttatgttattgtatgtatctgcttttccagccatttccccatccctcttaactttgcgtttggaccctggtaagagaaaatgacagtactccatctgaagtggaccatgtccctgtgtcatggtattgatttaacttatcctgtaagcttttgacaaatgagaatcagagtcaaagaggccttcatccctatcctatgttgacgtgacccttcctacccccattgatattgaccctgccacgttgatagcaacacattagtaggcacagcagaactacagaccatagtcaaaggctcacagagggcacaaaggaaaatactctgcaaaagcttccgtaagatagttttgctttggttaactgtagttatgcttcaacgtaaagatgcaaaaaagtgagtgtcaccctcttttcatctaagatttagacctcatacagcctctgtctcctgtctgattaccactcatgacaataggcaatttagagcctttgtcatagaaatgattgttttgtgttaggcttagctgtagtacttggcaaatgtatgggaaatgtgagacataattttaccatgatggaattctaaaaggtgctcacagagaaagggagcatgcaaaaatacttgaccggtacacagacagaagcctttgttttcagtcctgaattttaatttaagtatatattttcttggataaggaatactgaatgatgcagacttatttatgcagtgaaaaatagttttccattgaaattaagttagaactgtacttcttgtttaaactaatatctgaagcctttagtcattttattagtcagtaaaattgatgaaaaccttaggaaaatgcgttagaacagtcctgtgatgaataggaggcctgggattaataaggaaaagggcaaagggacacatgttgatctgtgtatgtatagagatctggagcttattagaagtttttatgaacattcaactaatgaagcattatataaaattagacatttccgttaagttgtaaaagttactagtctagggaaaaaaaccttcaatgttatttctaaataatttatttatgacattttcccaacagtagtaatttaaatatgaaaaattaattttgtaatagggaacattccatgagaatgccactcacgatttcttggaggagttttcatctttggttcttagatttattacaggacagagtagcatgaatgatctttattaatcccattttatgattgcagcagatatctggtaaatgctacgttgcatatttaacattattccattttaaacattttcatttgtcagaggttgcaggtaaaaaggggggattttaagttctctctgtggcataattgatggagaaaacagacacaaagaatttatgcacaaataggaatcaagaagggaacttcaacaatagtctagacaagtttgcagcaccctgaaatgcaggccaggctctctggtacagctgaactggggaatgtggccttgaccctctcgtctatagaattagcaggaaaagggggaagaattcctctcagcacttttgtctcaagtttaaattcattggatctttattatattgtacattctttggtcatgttttaggtgaagtcttagtatctttaatatcctgatttcttcttatttgattctctttagtttggtagagaaaacagtggagtggggacagcatgatttgtagttgtcaggtctaaatttgaatgccacagcaaaccctgaccctgatcaagttattgagcctaccttggtcacaatttttatgtctatatattagaaataaaaatatttacaggattattttgaggaataggaaatttatagaaagcaactcacacatagtaagtgtgcaataaactgtagcttttatatctcaagtttattgtcccttctcaattgtagatctctttacattcatatttggtgagcacacttcagacaaacaaaaatcaaaattatgaatcaaatgacctatgggtgtataacacaaaacattttaggttaggcttttcctaaaaccctgaatgctgaattttttgtagtagtgcatggtacattataagtgcttggtaaatgttatttatgtagtagtatttattttcatcattatttcataaacaaatttaagctttctctgcatatattttgttttaaattatgcaaaaatgcttatattctctccatgtcatttagatttctaagcttgaaactgtacctggagcttgggctaaaataagattactaaaaaattgtcatgaacaggcaagaattactttagcattgattgtgtggaattctattcagattgaaatccaaaaatacctgctctgctcagaagtttatgttctcttactatattatttcatgtataattctcaagcttttactcttgttttccaattacatgattataaattaatgtttaaagataaaacacatgtatcagtattaagattggtttattttggccgggtgtggtggcacacgcctgtagtcccagcactttgggaggccaaggcaggcggatcacgaggtcaggagatcaagaccatcctgactaacatggtgaaaccctgtctcgactagaaatacacacacacacaaaaaaattagccagaggtggtgacaggtgcctgtagtcccagctacttgggaggctgaggcaggagaatggcatgaacccaggaggtggagcttgcagtgagccaagatcacaccactgcactccagcctgggtgacagtgtgagactccgtctcaaaaaaaaaaaaaaaaaaaaaaaaagcagattggtttattttatcagagacccagagaaaaagaggcttaagtaagatagcatttaatttttcctaatgacaagtttggaagtaggaaggtcagggctggtatggtagttcagtgatatcagagaccctggctcctccttcatcattgctttgaattcttaacatttaagtgtctcatggttcaccatggctgcctgagctccaaacatcatatcctccatccagctaataggaaataagaaggaccaaagatggtgagcccctgccttttaagaacacctctcagaaactattttggacatttcatcttatatgccattcatcagaacttaggcacatggccacatccatctgcagaaaataatggaaactttcatctttattctgggtagccaaatgcctagccaagatttagggatttattatccaggaagaagaggagaccaggtggtggggacaactgggaatatctgtgacctttgggattgacctgagcctttatctttcttctctctcatgttttcttttgtcttcttttctaaatagatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagaccgtgagtacctttgaatgatatgtttgtgtaaaacatgttctttcaaaaaacaacttttgtttcgagatctttgctgtgcagatggaagaaagaactacttattttgttgaacaacacaaatgtgtatctgtactctgtattcttaagcgctgattgaaagagggaaaagggagtagagatatagaaatgtcattctttattactcatacagttacttttctatatataatcattccatattgctctcaatagttcttcaagttttatttcattgggctgaaaaattgttgttttgggtattagattatttatataaaatcattggactgaaaaattgttgttttgggtattagattatttatataaaatgtttacctaaatatatttaaatggcattctgaaacatttttcatagttcagataaaatttcagcactaaataggggctgcccttgcttttcaacacagtcttgagaaactgtaagttggtggtcatgaaacaggtcatttttctccacaggaacaatgttgaaaccggatgttactttaataaacaactactttacaaataaaccatgcatgtcaccagtaacgcatcaaaaaagcaaatatacaggaaacctccatagtaatttaaaacagtaaaattatgccttgaatctcaatgcgtggatataaatgtttctttacacagatgacacagggaacccttgtgtgtaatgacatattcatatagtacataaaatacaatggtagtatatcataaatttgacctaaaaatcatttttccggcatcaaaatgaatgacaaagaatgtaggaagaccattaaacgaatgaactgactattcctaagaaaaatagttgtttagctttttgtttcttcatgtaactgataatgtaattttgaccattgattaaattgtgagttgaatgtttagactactttatcgtttcatttaaagagctaaaaaagtatttttgagtgtttctacctacccagcacctgcgtatttttgtagaagaaaaacatagaaatagctggagtagatgaggaactcactgcacatcctttctttcctcttttattgtccctcaagtcctgcttgtgttggttcctctcaagcagttgtttgagagggagtctaagtttgatggaagccactcaggcaaggctgagaccagaagctctatttctgtttcttccaactctctctcatctcccagaagaggagaagatggtgtccacattgtcatcaagttatggctggctccttcctgccttacatttctctattgactctggtcctaacatctgttgtttctacttccaaagttttagattgttcttttctgtcaatttccattggctgtattcaaatccttattattttatgctgaaatttctataattgtttctaccttttctttgtggttccagcctttttctattctaatgtccccctactcactcactcactaatcttaaaaatgtattttcatcttggctgtctctctacaaaagtcttgagtggctcttcacttaatcttcattccagtgccttggctgtcaaggtcttctgtattcttggctcatattctaggagtaataacttctccttcacagcatcttgttctgcaaagccatccctgagtgctggtccctgtgcctgctctgtgcatcctgggcttcccatcgttgcctgattgttctccttggccagtcggggcctctcctggccgcttctcaagctcgcctactctgctaccagctgaagctctcctcacatttcaggtccttcacatagctgtctccagctcttcagtctgtgttattcacatccctctgaccttaattgtacttcataagatccttaactctctgaccctcaatttcctgatctgagaagtgagaataataacaattcttagatacattagggatagaagaaatttatgtggagagctggttgtaggctgtcagaaaggggcctttcttagtattgtaatgattcatagccactcatgattcttctttgctccctcattatgttatttgtatgtatttttttctttttattgtaaactacttgacaagaagtactgtctgtttttcttctatagcaataggcgtgatattgagtaagtaataaacaccccaaaataccttaggtctttaaatgaaataataaagtattgttgataagcatttagttcatgttttaataaacaataatggttacatcaatgagagaaataaaatgcagtcacttccagatatatattgctaaagcatgaacctattgaacactatgggtttcaaattgagaactgtcatgagctaggaattctgttaaattccatcaaaacatgaggacagaattactttgtttgtttaaattatcttgctagtccctgaagctggagcatgcattacttccaaataaaaatctattgttttcctagcacactagcgtttcattaattagaaaaaactttaatttcaaattatattttgtaacccctccaaaaaaaatacttcagaaaaggcagagagaagaaagaaatagaataattgtcaaacagtatccagtttgaagagaaaagaattggggagtcactttgtttatccatcaacaaaagttataattcattgaacattgtgagttttattatagtataatacttttattgaaatacagtttttttcatcagaaattgtgtgggaaaaaatttacctttcattaatgttagtagaatcctatacagcccagggataagttgtacaaacttaggtattatggctttatatcccagatcctgaattcccagagcttctaaaaataggtactagacctaagttactatgaggtactatcttccgtaacttaattagtagtatattaattatttattcatattgttttaatttacattgtctttctctgaccttaaagtgattatctgaatccccattagggtttcctgtcaactattctactgccatttaccacagggtcaccaccagtacattctaataagtccatccttctgagatatcctcttcctaacatgattttgaatacctcctgtgtcatattactgttagtattttcttttatacgaattgaatgaaacaaatatttgttttgtctaactcttcaccttctttacatctgcacatggattaacacatattttcaaataagaaatatcactggctgctccgcctatggagtagccattcttttattcctttgctttcttaataatcttgctttcacttaaaaagaaaaagaaatattatcacaaaatagagtcactcatcttagttatcttgatggtgtgagaaaactgatgatgtcatcatcataaacactttcaaggttaagaggaagagacttagtcgagttttctcaggcatggcctgttttagttcaacttctaattatgatgaacattttagtctcagagcttggaattccagtgttcttagaactcaccagtgttgtcatttctaatgttttttgttgcttcaatgtagtcgtatataaatttcttcaacataggactaacaattattttcatatttatgtgctatttagggtttcaatgttaaaattaacttggctgggtatagtaactcatgcctataatcccagtactttgggaggccaacacaggaggggaccacttgagcccaggagattgagaccagcctgggaaacatagtgagaccctatcactacaaaaattaaaaataaattagctggcatgctggtgcatacctatggtcccagctactcagaaggttgaggtgagagatcacttaaacctgggaggttgaggctgcagtgtgcaatgctagccccactgcactccagcccggatgacagagcaagaccctatttccaaaaaacaaaaaatcaacttaatccaacttcattttaggaatgaggcaaatgtgacctaaagaggttcaatgatttgtccaaattgcacaatttaatcatttattagtcttaagtcagaacccgggcctcccatatgaatcagcattttttttgtgccaaacaacacttgactttaattggaataactgtaaatgttctacatttatatataagtagcctctaatctcaaaaaaataggcatactatctatgagtccttttgaaatcctaggcaggctttccaatctgtggtagtcttagcaatcattaaaaaactgctcatatcctctcacaatctaaaacattttttccaaccccttttaaaaaagtttattgagatatgtttgtccattcaccatttgataaatatttgggttgttttcactttttggctattatgaataatgctgctatgtatattcatgaacaagtttttgaattaacatttttttcacttttcctgagtacatacctaggagtgaaattgttgggttatgttgtaaatctaccagtgtttaaccaattgaggcactgccggagtgttttcaaagtagcggcatgactttaccttccctccagcagggtatggggtttccgattactcttccttcttgccagcacttgttatcatgtcttttcgttatagtaatgctagtgggtatgaggtgatatctcattatggtttcgatttacagcgcttgctagctaatgatactgagtatcttttcctgtgcttattgactatttgtttgtcttttttggagaactgtttattcaggtcctttgcccatttctaattgtactatttgttatcttattattgggttttaatattgttacttttacagtctagatacaaatctcttatatatatgatatgcagaagccttctcccattctgtgtcttgtcttaatagtgtcctttgatgcccaaaaggttttcattgtgataatgtacattttatctagattttctttcattgcttttgcttttggtgtcatgcctaagaaattgttgcctgatccaaggtcatgaagatttatttatatgtatgttttctttaagagttttatagttttggttcttacagttaagtctttaaactattcagatttaattgttatatatggtgtgagatagaaatccaacttcattcttgtgcatgtggatatccagttgtgccagtagcattggttgaaaagattaatctatcctcattaaatgttcccagtactcttactgaaaatcaatgtactgcaactgtaagggtttcttgagtactgggattctcagttcgattccatatctatatctatctatctatatatatatatctttatctatgtaaagatatatatgtctcctatgccaacaccacactgtcttgattactgtagctttgcagtcagttttgaaatcaggatgggtgagttctctccgactgcttattggtcattcacttcatcaccaaaaaatgtgatcatgtgccccaaaatatatgcatatttataaacaggatagctattttgtaaataagataggcatactagtacactaaattgtctataacatgaagcatactaaaaaactacatttaaaatgatgatgggataaataacattttataatgatattgaatattattttatagaaaactggcaaatgacatcttcacttttgttagtttttttgcaaacttataagaaggtgttatgtattttaagttttgaaaaatggcatcaaacttcccccaaatcacatatagtattaacaaataaaataatgtttaaagactatattgttatttcatctatatcaacttctactttgtatgtattttaatagatatattagtacagtagttcatatatatttttagcatggttttatcattcagtgttatggttataacttgaatccatgtgatatataactgttacttactttcaatcttttcagtattttataacataacttactaaaccatttgacttgtttctcatttattattattacaaaaatcactgctttgtgaacatttttgtatatgtctcctggtgcatatatgcgagaattttactagggaatatacctgcacgtgggaccattgggtcatatgttctgtgcatcttcagctttactaaatgctattaataattttccaaggtggctctaccagtttacacttccacaaggagtatgtgagaattctcatcacttgaaatccttcctcatttcttttggaagagtaaaaacgtttatttaatagatgggactgagctctgtctaattgattaaaacttttaagaaaaaaaatgataaagttattcttttaatcaagacagtgtagctaaaattgtttaagattccagatttttaaagaaaaattgagtatatgtgtggactattaaaatcttttctctcaatagaaggttaaaaccaagtctagaaaaatctactttttaattgtttattacttaaacatttatttcctcccaccctcctttagtcccaggtgctgttcccactgaatccatacaaggaagtacctttgaagagaagatatttcttcagtggagagaaccaactcaaacatatggtgtaatcactttatatgaggtaatatatatgtttgttagtaatttttaattagaaatactcatgatcatgataatgtaggctatctagtatttaaaaatgcatacttacataatatattttaagaagtttaatgctttcagtagttataatggttgttatatagaagaaaattgtaaaaataagtttttgaattatatataatttgaggatttagctttacaatgagttggacctttccagattatatgttattatatgttaagacacagcattacatttaaaaattacctttattaaaaacaataagtattttgaaacatgcattgattataagacaaacacagaattctattcttgcttagctattaaatattttactactgaattatagaaggacactgattatccagttagcaaagtcaataaatattgtctcaggactaacaatagaataatatcttttggtttcttagtattaccaaaacatcctttcgacttctgtgacatagttttgtctactgaggcatatcaaatggttgaatgatagatagcagagaagaatttgatgaattgttcaaggaaaaaagtaacagcaataacagggtgacattcatcatcacatctgtgcaagcatcatttcactatgcctattgtcatagaaacaagcaggtgtgtttttttaagctagcatttatttgaatgcaaattccacaaaattatatgttgtaaagtttctaaaaatcgtggcaaattctcatatggaacctctgcttgaatacctttcagaactactgacaaaagcctgtaaagatgagctgtcagacagtgatcaccagtaaaccccttccctgacccaactagcctcacatttatgtttccttgtaatttttgaaaattggtattgaaacacacacaaaaattaattcaaagctaagcgaagaaagataaaagaaaaaagttgatttttgtactgttattgatgctgttcattggctgcttcattgtaaaagaattgaatattatgaaaattcatggctcagcttttatagagctaagtgttataaacaaatcaaacaagttcatattattttttctcagtgatgagaatcttttagtttttatttttggccccattgccatttttaggtctcagttttgggggatttttacctagtaacaggattttaaactaggaaacatgcaatctttgaaatcaactttaatttccaagccgtaagttcacctgtcctaaaagccacatgttgctatctagacagacagaaaatatttaacagattctttctttttaatcctacaagagatatatctctgtgtggtaagtcactttaacatgaaaacaatgggaataataattcaaaggaaaaacccattagtctctctgattctgcagccaggactacccagttgaacactgatctaaatactactacaatggggatgcatgaatgtgtcataaatcagggttttaaaaatcagatatgtgtaagtagaacagattggttcagttttgtagggaccaaaggggaaatatgtgatccaggccaaagtgattaaatacaagctttctggccaacaagtctttctccctttcccatgttttctacaagtaggaaggaagggagtccccagctccctcgaggtaggtcttaggtggagtctcaggaggagctcttcttgagctgaaatgcacctgtgagctacgattcacccagcctatgccagagtttacaacaggcacatacagcttcctcccggagctgaagatacatgttgacccagattcagtacctctctggagaatcacagacttctgagacaaaatcacgctaaggaaatcaaacacttgccccaaaagaagcagggaccatggcaacattgttttctgtcatggagtcacatttgaatactggtaaaaatcagagggtgagataaattgccatggttggaaaaaagtttagtaaccaatgacacaggtgtttctttaagggaggcagcacacaggataatttttgaaggaaagaagaaagcacagatggaatattgttgatgtttgtattaggccgctcttgtttggctataaagaaatgccagaggcttggtaacttataaagaaaagaggtttaactggcttatgcttctgcagaccgtacaagcatggcacttgcatctgctccaggcgagggtctcaggaaccttatgaatgtggcagagggtgaagggcagcaggcacgtcacatggcgagagcaggagcaagagagagcaaagtagggggtgccacactctcctgtgaactcagagcaagaattcactcatcaccaagggggtggcccaaagccgttcacgaaggttctgcccacatgacccaaacacctccaacattgggaatctcatttcaacatgaaatttgaaggggacaaacatccagaccatatcagtgctggaaatgaatatgctgtagctttagattattctctgttctctctttgcttattatgaaagatacacaaaagcattaatgatcaaaaacggctgacagcattgttttttccaggagttatggcagttcacagccttacatcattcttctggttttcttccttgctttctccttttcactcctctgactccattctcagccttccagcactagccttgcctctctgaccttgtcttcgttctggctcaagtccttctcgtacgttaccctccacctcagtcatttaattttgtcaatcatcttcctacaacctgggtctgatcattacacctttactcagtagctatcaaaatctcttattttgtcgagttgtcaatttaatactgccctctgaaagaatacttgtaagtgcagaagtattcaaaataaaatatccttgcttccgaattttacttttcaaatgtaactactattaacagctagatacacatccttctaaaattttacaaggtagaaactgtagtgcaaattcattaatgaatataaaatggatgcagtttaataaatattatcaaacccagcattttattacaagaataaaataccatatgagactcccacctcacatcatacaaaaataaacaccagattcatgatctaaacacaaaagtttagaagaaccttctaagaaaaaggtaggaagacatttttgttatatatttttctaagcttgatataaaactcagcagtcattaaaaataaagattgacagatttggttatataaaattttaaacttctgaatgatgaaagataccatgaaggaggtctgagtacaaacagaagacttggagagattattttcagcacttacagcagtcaacaggctggtggctataatatatagagacctgctacgtagtaataagaaaaaaacaaaacactcttttaggaaataaaatggacaaagacacttcaaaaaaaaattcacccagcatgtaagtatatggtaaagtacctacccagccttactaatgattgagaaatggagtattacaagtgatacagaagtttaaatttctataatatcaagtgttaatcagtgatgtggagaaatgtgtacatgcatagtctgttgatgggaacacacattttgcagtctttttttttgtaggcaattagggagattctatcaaaatgtaaacatagtatgccaaacctatttctagaagtttattagtaatactccccaatgtacaaggatatttgcccaagtattttcattgtatcctactaactttacatatctctagtgagtaaataccagactcctggtcatgagactaacacatggattgttttaaaagctttagtatgtctgagatattggaaaaagacaaaagtagaaaaggtactgttccttttctgttgaagtaactaccccatcagcaaccaactatagaaagaatgaaatgagttccaaacttagggactcaatacatgagtgtgtgactagagtatcaagtgcagttttggttgggcactttaatcaagtagaatggtctagatttgccagctgattgggacattcaagagtctagagttgaagacaccttaatatccttagcctggataactgggctgttagtcaccatcagctgagataggtggttatgtagagggaatgagaatttaggggccatgttaagaagtttgttttcaatactcaagggcttctgtgatccaacccaaatctatatttataacgccatctcctactatttttcttctggaactcaatgagccatgtatatgaaattgtctcttcgccaagagccttctgagccatcacacaccctgcttttgcttagattcattctgcctgtgccatcccatcgctctcctcctatagcagctctgcctatctttcagtattttattcaagtactttacttttccttgaaatatcctaggtcctttcctcccctaaaatcagatttaattattcattcctttgttttctcagaataattgcttaaacctcaattagaggatggtgttttatgctggctggaattaccatcaactcacagtctagaagattttgattcccctcttctataacatgcaagtcaaagattgcatgttattctatcttggtttcccatgaatctctcagtttagaatttgaggctttaagtagagaaagggaagacaattttggaagatttcaggcacttacctgcaaatcagaaatcatccaatagaagcaacagtttactccatctcacccaaatctaaccctcacacatgatgttgagatctcagtttgcttttgacatggcacctcccataaaattacttacatccaacactgctgcagcaacgttttttacagaggcttcattacagtttcctggaccttcagccagggacagagtacaagtacagaagcttccagacttccttcttgtagtttgctgctgtactgaagtacttaacaggcacttaataagcatgtattgaatgaacaagtggaaaagtaaagctgaaaccatatggacatttgagtttgagcatgggagtatattttggtgccctttagagcagctgctgaggttggtgaatgtctaccatcagctctgtggcaggcagtggggttgtagagttagagtgcccctgctgccgagaagcttttctcattctgatattcagactccagggctctgtggatgggtctgagatggggaaacccatcacctttgtgacatttggtggacatatacatgcccaacatatttgtttgttaggcgtgagggagaggatctgtaatttttaggagtgcatgaattagtgtatacatgtgttttttagaagtaggaaagagaaggtgtctaatttttaccaaattgtcaaagggctatgactggaagccagctaagaaccccagtgttattttgcagccacaaggctttcagcaagtccaagcccatcagccctgctggaacaacaagtcccttagtaaagcgtttgcttgatagtctctgtgggtggagcaaagatcccacttgtcttgagtgtttacatgagcggatgcacacacccgctctccccaggagtagttttaggaaaatagatactgagtgccaaatatttactgatcacagtgggatcaggaaaagaataagacatcagtcactcctcagaaagaagatacaattacatgaaatgttccaattcctctggtatatttaaatcatgatttaagatcaaagaagagatttcacagtactccaagattcattgcccagtgaattgtatgaatagtcacaacacaggcattcagtggatctagtgattgttaggccaggtttaggaaggctttacagatacacagaatgagaactctggattgggacatggatgggtactttttttgtcccagtctcatctttggaaaccaaccctccctccctccctccttttctccctccttctctccctccctccctctcaccctccctccctctctccccttctctctctgcttttttttcatttggtttctgtgacagctttctctcctttggctctcttcttgcatttctggctcttctgttggcttctcctcctctatcctgtattaaatacctacattcattagggagtggtaccaggctcccttcttttttttctaaacttccttccctagtgaccccctccattccagaattgaatatcatctcaatgttcatcacccccagtcttcacttccagcccagtcctttcaaatcacagcttcatgtcatacatgtgtgtccacctgactgccgtgggcatttccaacttagtatgtccacctgtgtctgtaaatttctcctcatatgttccattcttttcgatacatgggaccgtcttctgatcaagcccaaaatggaacctatcctttattccatcctcttttttttatatccagtccttcactgagttctgtccattttatctctaaaagatgccaattcttttcatctcttgctgtctgtaccagccccaccttattccaagcccctgtattttctcccttgtgctatagctctaggccctggactctgctgtacttcctagtgccctccctactacttcaattgccccaccaatcaaatcaaccttccacctgcagtcagggtgaactctttataagggaaattagatcattttattttcatgcttaaaaacgttcaagggcttcctgttgtatgtatccaaactttttatcttggggtgcaaagcactgtacagtatggtcctacccacttctcaagcccccaaggaaccacaccgacctcctttctgttcatatactgtgcccactcactcccgcttcactgccttagttcctactgttcttccccaaactctcagcatgattaactccttgggaaagttcaaatctcttcagcttaactgacatctcagtgggcccttccccagccactctaagtggctgtgtaataacctctctcccctgacagttctccttattttagcaccctattcgtttcttccatggaacttggtgttttgaaagtattcatttacttactgtatgcctccccagctccatcccaccctgtccagattctcagttatctgaaacagggcgtgtatttacctgctggccatggtgcttgcagagtgtcagtgttcaatcaatgtttgaataaagtaaatgaatctgaataggtagaaaacatggaaacagagctaactgtctcatgttccaggcaggtgaaagcttacgagcaaaagcagtgtcagaaaagccccattagtgtttgtagggcagttagtctttatcctctgaccagaacagaaaggaatataatggtgtagtatcacagattcagaagtaagtttggagaaggtgagagcaaaactaaggagtttgggctttctctcgtatgcatttatgtttcattaaggtttctagacaggcaataaaatgaatgagaacactaagctagccacggtgggcagcgtcagtcctcattttaattatactttgtcatagttgttggatcacttctccccttcccctaccagactgatacctccttcggggaaggtacgattcctaaagcaccatgcaagaccccagctccgaacacagtgcttggcacatgagaggggctcaatgaatatgtttcaaatgtgtgggtgaattagtgagtaaacattggaagcaattatgcattcataatagaggtttagatccgtctcctccaaactgccttgttccctggaggtatccgaatggaggaccaagtaatcatacagcggttacatcgctgacgtccttcgctcagccactagggggtagattggctttgtctcttcttgacttccttaaccttgcagaggaagtctgttagaggattaacaatagatactctgcatgactccaatagtgtcatgcagtgcagtgattaatatatatagcaaacagttttcttgctaaagcttagttgattcaatctaaatattctttcagagaggtcttcctaattgtaatgacatggtataaatataagaagaaagaatgtcaattatcacttcgtataataacagtgttagtgttcatgcacataaattacaagtaagtttacctatttaaaagcaagaaaagtgctcagttttgcaatttaaaactttcgaatatgccacattttaaaattatgtcattacaaccagtagaagttagtaatcaccactaaagtgcatgttcttgaatagttgatgaactactcatagtgaaattctttaaaatatcatttgaaagggtaggatttaaaggcacctatgttatatttattttcaaacacttcagactcatccaacatgctttgaatatctgttatgtagctagtatcatgaaaacttctagaactgcactgtctcatatggcagctactaatcacacatggcaatttaaattcaaattttcagttcctcagtctcactaaccacatttcaaatgctcagtaaccagatgtggctagtggctacatttccatcatttcagaaagttctattggaagacattgctctaaagaaaagaaattaatatgacccataatgatcactctatttgtagcatcaggaatgactggaatctgtctaggattccagtcattggagcagatgtcctcacccacattgatgaaaacacttcagtgccctcgttcccaataggtaatgatcctaagtcaaattatggccactagattaaagatgaggccttatccttgtcagtatcttatctgtttgagctagttgtatattttcttattttgttctaaacccattgtaatgtagttttacaaaatgacattttgaaagcaaacaacttcaaagtattagcttaaccccgaactcatcctgtatattctaatctactggcttaagttcccctgtctataaaagtaataactcagcagctttggcggagttccttcatcccttcagtggattcaggatttcaagagtctgagtaggagcttatcataaagtgtctgacagtgcatacatcagaagggtttattggataaagatgcaatctgagtccatctgctccagatattttatcactttctcattcttttgcagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcaggtactctacattcgtgagttgtgtcttttatcagaagtaacatttttgtccgttttcattcccattgtcaagtatgccaagctcgcccacactaacattgtatccaaaggaatactcctggatgcctgaagctcagactcacagctttaaatgaagtactacaaatatttctcatttgggagcttaagatcctcacatgttaggaagtggctattgttttagcagggcgtcttggaggacttgggcatgaggcagaaggttctgttgagacactctcatccccttgtcaatcccaagttgccagagcagtactgttggaaaaatctctgtaatgaaccatgaaccatcgggagctctgcagaaagacagtcatatagagtctgcttcctgaaggatcagcctccttgggatctctaccataagaaacttctgtcctgaagagagaggcaaatacatgagggtaccaggaactgagggcctccagctttttgcttttagagacttaattatgccatctaacaaaagacgtaatttgagaaatatttctaggcatgttcaactgtgcagaaaatgtctttgtacttcagactagaggaaattaagctgccatctggtatgggatatacaacagcaataaaaaaattgcatgaatattttttcccattttttcccctttgggtatgagtgtggaagtgttgagttttggctttaactattttgtttggggtggagcaggtggggtggaagtagggaaaggagctaactcttgttatcagccatggttaggtcaataatatttagcctgacctttatatcttttatctctcattccttgttttgtattaataaaagttatcatttggagttgaaggaaaggaatattcacaactagagtattgtaagtgtttggctaggttttgagggagggtttagaattttctttttaagcaattataacaagggataattttttattgtgtaatattttatgagcacaaacttgacttgaaatttaatacacttgatattctgtgtatagaattaggttatagaaacagtatggagagttgagaaagagaaaataagtctttgggaagttagaataattagagattagaaaactgacacagattgaagaaaatgggttggtagaagaaagaccactggacttggaatcaaaaaatctaggttctagttatgattttgccaggcacttcctctctgattttgatcaaataaatttactcctacatacaaattaagataatattatctagcgcatgaatttatcatggggatttaaagatgaaataagtgccaatatatatacctcgaagcatgttttaagaaatttttcccatgtaagttacactacaaagattattgtcataatgagtgtattttttgaataaaataattcatttttgctatttttattagataagaattctgatcaacatggccgtattagtccgttctcacactgctaataaagacatacccgagactgggtaacttataaagaaaagaggtttaatttactcacagttcagcatggctgaggagacctcaggaaacacaatcatggtagattctaatcaatggttttgaccactttcagcatgccaagttcaaataattttattgaaaatcaagcaacctgacattttcattagcctatatggctcatcaagaataagtatttgatttttatagtcttaaaacagttacagtttacaggtcctgttttcaattttcatggacctaagagagggaaccactcttgttaattctatgttatgaattggagttaatttttaagagaattgaaataaattttaatgctgagatcattcaataaatggaactcagaagtaacccatatctgttataaacaaatctttttgtatatgtaagacaattttaaaaactgtatttgcaagaaaacgacctctagctttctcatcaggagtctctaccagtgggctgtgaaaatatggtatgccctcccacatcacagctccgtgtaatgatttgtcttgtccgtaattactgaagacctctgttgctatcataataagacttaacagtctagagaaggaagatgctggaaactggccttagaaataggatttacattgggaggagaactaacatttgtagaattatatttgcctgtctctctgttctctctttgaattacgataataaacgtagagggtagttccccccattttgagatgtatagaagctcttatgctaattaaaacaaaacacagcaaaaagtcaaacccaagcctttcttatttcagttcctatgtgttttccactgtcatgcttttctgagagcccacagattgtcactaattaattccaacaaatctctctgactcccactgtcctctttaaatccccaatgagtctggtacatgaaaaaccttgatttagatggaataactataaagtccaatgattatttcctaaatatgcctttagcataaacagtttatttgagaattcatatgtacagaaaagtgtaccaattgtaagtgtacagctcggtgatttttcacaagctatgctcatttagccagaatccaaatcaagaaacagaatattactcacaccttagaagccccctcataccatctcccaacttcaactcaagatcacagaggacagtatgggctgcttttagcagctgtccctgtgattctatgtagggaatatatgtgaagcttgctcgtggttgttgatagctgcaatgtaaagtaaatgcactgtgttcttaatgctctttgtaaaagaaagtggaaactaaactgagaagataaaccagaaataatgagtctcccattctacgcctttttccccagcaccctctatgccagcttatgaacttgagacacctttgaatcaaactgacaataccgtgacagtcatgctgaaacctgcccacagcagaggagcacctgtcaggtatggaacagagggttgggccggctctagatagaagaaaactaaatcaagttgattaattcctccaatgtgttttctagggatttgctgcaaatctcagccagcatgtaaatccatatgtttattagctctaattaaaagtaatgactgaggaaaatgaaagggctttgatgtaaggtgatcaagtattgtttaaagggttttattctgatgcaagtgagttgttcttttgaagataaggaacaaagcactagtctgttgaggaggtagttttaaattaaaaggtgactgcttgatgcaatttggttacccaagggcagatgacatttttgttctcagctctgttctttgaatggatgtttcgattttttcatttgtgtgtttactttgggttttatgtcatttattttttagtaaattggctaatttctcaataaaatatgagatgtatagttttttgaaaaaataacagattattggaaagaacattgtgaagtctttatctgaacagattagagttaattaccaacatctaggcccgcatcttattccatgatgatttatatagctaagcaattataaagtataacttgtatagtgactgaataaaataaattgattatttccacgacagagcaaaggatgcctgaatagctctggagtatcaacttgtcataaactcattaatctacataagtgaaatttctacttgattcagagggatttaaatgttttacctttgtattttggaatagtttcccttcagagtcatctattactttgaatagagtacttggaagaaagatttacattgacaattaaggcattatagggtttattttcatgtttcttttgtagaatttgatttcattaatgttttgacacctggctatatttgatcatgttttcactgcagtatcataaggcaatcagttagatttctttctattcagtaaaatatatatggaggtttcggttcataaagtcataagtaaaaccagaatagtattagtttttagtgaagtcagattagggaagagtcacagaaatttttatttgaaaaatctccaaaatgtttaaaacaatttttagtttatactgtagaataatgcaacacagtagctcatatgaggtttcatgcttgctgttcatagatgcagtttgtgagaatactatgaaatatataaaatctctattccaaattggagatagtgttactgctacctttcgagtgatgtgcttgacactccccaggccctctgggttgattcctgtgggtggcactgagaggttgcactaatccaatggacccaaggcacgcattagatgctatccaagactcaagtgtacccatgaccatggctcagtcttttttgactttaaaagctgaaatttattaaatgaaaatgtatgctctgaccatggccttgggagtgtcatttgtttctgacccacttaacagttgctcagactcagcaataaagggtcattgggacaggactcaatattttactgcaaagcatcatgatcatgtgaatagttagagttcactcagattcaatgcctccaaactgaaggaagctgaaagcttaatcatttttcaaaaacagccagttatcccatggtactttgttcttatatggataccttttgcacattttctatacttgtatcttactttcaaaccctttcagttggattttcattcgcatctttgtatagatctttccaagaccaagttttgttggtttgtttgtttttgagatggagtctcactctggtcgcccaggctggaatgcagtggccttatctcagctcactgcagcctctgcctcccaggttcaagcgatttcttctatctcagcctcccaagtagctgggattacagacgtgctactgcacccagctaatttttgtatttttagtagagacagggtttcatcatgttgaccaggctcgtcttgaactcctgacctcaggtgatctgcccatcttggcctcccaaagtgcagggattacaggtgtgagccaccatgcctggccaagactaaattttaaaataattgctctttgcgcaatatacctgcacccctttcccagtcctcttccctagtctttacaaggtgccaggcacactccaaactactgttcctatttctagcatatgcctcactaagacattattttgttgttgcttacttttacacatgtctagttgtttttcggagactttgggaccttactggtagttcttggtgtcctcaggcttcctattcttacatctataaaaatacagatccaaatgcttgtcagagtccaaaatacataactttcactgcagaccttacatcatttcatcactttgtattgcctcaccctcttttacagttgtcataacatcccggtttccaagttcaacactgctgtgcttttaggaagggtcatgtcagtattggtgaatatgctccttgaatttgccaggggcactttgcatccagtctctaataccttcttcccctgttagcatcttgaaattaataaatatatccatgttcattattcacatctgtaattttagaatcatgatcaatccttaaggggcatcattcagtaagcattatggggaaacctgctatagacatcatctttattggaaggatgcctatcttaaatgggtaaatcgtgttggcacaaatttgagagaggaaattatttcaacctcacctgtcgaaaagatttttttttttttttttgcagaaaagtgaatgttgtcttcaagggattcattatataggacaacataattggactgattatctgtagaatagatggaagaccaatatagcgagaaagactaggttggggaaaaaaatgtgtatagtaccctctaactaaatagggcatattaaaattctcaatttcatgtaatgtttagacaaataagaactctgattatggaatcgtatggacctaaatataaagccataatgtaaattaaaacatttgaacacatctggaaatctgcaaaatgcacatgtaatcaaactgcagtacaagaaagcttttcccaaatgataagataaatactagaaggaggagggaaatggaagcgaacatctgtttgctttcctggattttgcacagtattgtgtgttcaaaaatactgtcattgtgtgatttccaaaacccatttttttcaattgatttgattttttttttaatccgtattcattgatgttgaaaattcagtcgaatttcgtttatgcacttcactaagtaaggtggtcatgtattgatttccctacaaacactcagcttggttcatgtagattcttgaaattgcactaaactctcaatgtaaatgattgttgtctttttattgatcaacacatcagctctgtcacataaaattatttaaatcctgagatggccaagaagaacacaattccatcattccagccagtaaactagcatgtaggagagaattttaatgtctgttcatggattcaaagttttttcattaataagatatggaaaagtgtaactttctttcatttatttatgtatttattctttttttgagacaggttctcactctattgcccaggctagagtatagtggtgcaattgtagctcactgcagtcttgaccttctgaggctgaagcgatccccctgcctcagcctccagagtaggtattagagacaggatgcacagtgcccctggcaaattcaaggagcatattcaccaatactgacatgacccttcctaaaagcacagcagtgttcaatttggaaagcagggcacctcaaatgtggaactgaagccagagagagattattattgctaatgaaagtctgtcccagcactttgggaggcaaaggtggaaggatcacttgaggccaggagtttgagaccaccctgggcaatgtagcaagaccctgtctctacaaaaaagaaaattaaaaaacaaaaacaaacaaacaaaaaacatagcggagcatgggtatgtgcctgcagtcccaacctaggcatggttgtgtgtgcctatactcaggaggctgaggctggaggattgcttgaacacaggagttcaagatcagcctggacaacatagagaggcccaacatagaccctctaccaaaaaaattttttttaagaaagacaggagataatcatgcatttttgttttaaaacgtttctcagaaattatggttgttggcatacaaatggttatggtttagtagttcaaggttatgaagcataaagcatgtttttttttttctcaagcagcagcaacccatttgtttatctcactgtccgtaagtccaaggaaagagatgttcagtccattaacactaccttcctagacatcctattctcttctccacgctaggagcctttgagcatgccaacctcatggggttcttgtgaagactaaatgaggtgatattatttaacacttcaaaccatgctttgcacatactcagcaccatgtaagtgtttactcttgccttagcagtagttctcattacacgtttctattcataagaccagccctggtcctccagcatttccttttttcgtctcattttattcaaatctgatatcatgaaaaatctaattttacatgaaaaatataattatttcctctatcaacagaatcataaatagaattcatataaattcagatttctctgatgaatcttaagtttgattgcaaggagctaccagtttatttgtgcatttgcaagttttcaggaattgatcttataaataattagcaaactcccctgaccccaaatctatataataactcagaaaaaaaaatggatgtgtttccctattgatccctgaatcattatgtgattgtggttattatcagcttaactgaataaacttagccataaaacaagcaaaacggtcttctgtttataaccactctaaaaggaaataaacacttggcaacatagtaaatttcacaatgtgccatgggtatgaagaaccagtgagatgtattacttacgtaacttaacaaagcctaatgttctagtcaccctttaagtatatgaatctctttccactttattaaaaaaagatatttgtgatttacatgccattttataataattcagtccttataattatgttagaattcactccccagattccagaatttgttcttttaatcagaataggtttgttcaagagtttgatcctggcttagaggagccagctaaattctattatttattcaaaaaagtttatccctttatagtattttcctgctggaatgacaatattattttgagaaacaaaaaacttatagtgtaaaaccttgcaatgcaaagtttaccttaagatataaatattctggccaggtgcagtggcccatgactgtaatcctaacacttcgggaggccaaggtgggaggattgtttgagctcaggaagtcaaggcagcagtgagctgtgattatgcactccaacttgggcagctgagccagaccctgtctcaaaaaaaaaaaagatataaatgttttgtaatataaattttaaagtggctttattttaacttagcctattataaatcaatataggggctagacacggtggttcaaacctgtaatcccagcactttgggaggccaaggttggaggattgcttgagcctgggagtgcaagaccagcctgggcaacaaattgagaccctatctcaattataattaaattttaaaaatttaaaacaaaatataaataaaataaatcaatatatggtttccagatctaaataatgcttactctaaattaattagaaactactgaatccattaataattaatacaactattgcccctaagatacaagatcatatcaagtgtcgcacatagccttttagacagaatttttcattcttcctttggcaaatgttaaggaggaaacttctaatattcaaataatcactcactttatatatcacataaattatgggcctaatttttaaaacgagtgcatgacatagagaaggacacattttgaaattagataagcatagtttcaaatccaggctctctccacttgtagttacgccactgttaaaaattccatcttaaggtctctgagcctgggcttgcctgtctttccacagcaaggataataccccttatatcttacagctgtgctaggattggatttgttaaatactcatgaggttcaagcacaaggtggtgctaagcattggggatatggaggaggctgctaagggctctcttctccaggggctggcaatgtagattggaaagagagcaacatggaatctagtgtcctgtagtaagtagggatgaggatgggaaccagtggcctgaccagggagtggtcagtacagggaagagtcagctaagacttcagagaggaggtaaccctggggccaagtagctgaatcttgacagacggctgttgttcagagcatctgtgtgatgtggagtatgttgccagggaggttagatatgtggcaaggaataaaaaaatgagagagacaggttggctccatgaagacagggaggactgagtttggcctgatctgagaatgagaagtgtgttataatcagagagaggggtgggatgggagaagaagcaagggagatagaggatgaattggacaaccttgtactccataccaataagtagccattcaagggattcaggtcagggaaaaaatgtaaggaagagctgcagcagcaatggaggatgggttagagggcgtgcggcctcagaacaaactaataggagcggcataaaggctggaggatgtgctgggcccagttaagatagagctaaccctggcggcatggaggaagggggtttcataaatgccagatgctgattttcattagaaataggatttagagaaatcaaaaacacttagtcctttttagaaggaaaaaaagagaatatattgatgttaaaaatactgtctggggtattgttaaagtgaatactagaacgcttgaaattgaaaaactagcctagcaatgactttccaataattcattggaaatcactaattatataaatatttttaaaccccaattttcataagcagtaaaaagttgttcttagtgtctcttgtttggaagaaccttctggatctttcttttgttgcttctcctaccttccttatattgcaccttaacccctttgctgtgggcctgtgtccatcaattttgtgacaatgactgtacgtgttgaggtgttaccatgatgcctactcagtggatgtgggtggcacctctggttactaaaagctagagtgtgaaatgcttctctcggcttcagaaggcatgccagcagcacacttagtgggtgattgtggctcattcttggctagggccggggaagacctaagttttttatcatactgctttgctatccccaaaagaacccatgcctgtccctgaaaaggcaaatatttgagttggaactacagactccatgaaagctctcgaatgtccttcacagtggaggccacaccttgcacattcgtggaggcgagagccaggttgtgttatgcgttcccctcttattgaccagctgcacagaagccattcggcaggaaggagggagacattaaagtctacttcattttccattgaccgtagagaaagttacatgctgtttcttttccctcatctagatagaccgtctttaaatgttaatagtggaataaattagaaatagtttcaattataaactcagagcactaaaagattgcaaatgcctgcactgaacaatatattactttacgaattgtaaagctgctctgccatttgctctcgggaacccttgggtcttcttaatcacagttattgatttagggagtttaagggatgaacttctagaggtgttccaagctagggctgatagcctttcttggagaggatcttggacattttgagaaagattaactgatttgactatagatgcctcactttcacatatgtgaaatgtgaggaaaggttgcaaattccaagagactgataaagtcatgtgtgatcactaagccggtatgcttcttagagccctagacttttagaactgaggacgaccaactcagaagtcctgaccacattcctcatgttacatttctgcttcatcctattttggtggtggggagaggaatgagggcacagatacagaaggaattatgttttacatcattctcttcagcagggcattttatcaaccagcacttataagtatactcaatgtaactatttattataagaacaccagtgtacacaaaagtgctaatatgccttctatttccttaataactattttttaagtatattatattatgcttgtgaggcttacctgtatttcattgcaacttaattaaattaatattcagctcttcaatcagacagtagaaagattagggagtggttttggtgttttttcccatataattatgtcccttttgacatgtatgtatggcccagttccatctcatctctacttctacctgctaagtgttttcctgtcctgtatcaatgtattttccactcaatgagaagtagtaagagctctgtccagttattagtacctggttaaaatcctggcccttcatagcattgaaaagtgttgtaggaaatgttaggattgacacttggctactgttcagttattcttcattcattcaccagatatctactgaacacttattgtcttcatgtcattgtgctagggttgtgataaaagctgtctagaaaagtacagggtactctaagagtatgtgacagaaggatgaaatctcaacaggagaatcaggagtgtcttactgagaatgtgttacttaaactgaaacctgaggaggaggtaggtagataggttcaccaagtaggagagcaatcagtagaaaagcctaagataagagaagttaaagagacctaaacagtggtcatcctagtcaacaaaattaaaaacacacaaggtttgaccatcactcaggagcattaattagatttacatgcagttgtgcagagcataaggacatttcattcaacagactgcgtatacagcagtggtcctgaaatattataatactgtcttttcattgcaccttttctacatttagctttaggtttacagatactccccactgttttacagttgcctacagtattcagtagagtcacataccatatagctctgtagcctagcagcaataggctctaccatacagcctaggggtgtagtaggctgtaccatctagggttttgtaagtgcaccgtatgatgtttgcacaaagatggaatggcctaatgaggcacttctcagaatatatccccatcattaagtgactcatgaccatatttaatgttgagagtgagcatttccctaggctaaacattatgtaaaacatataaaaatataatcagaaatgcaaaatcatttgatcacaaaatgattttaataatttagtttttgaatatcatgcaatacctctaacctaattaagagtgcaataaatgtttattgaatgaacctcatctttttcttgccagcagtaataattatcacctgaaacatttattacagataagaagaccctagaccttcatttaactagtgggacataccaggaacaagtggagttttaaattatattttcatccctaaataaaagttaaatatcatgaaccttccatagaatgcagagctataaaagaacaccctgcctttacctttgaagcaatcttttttttttaataagaagagtaattgagaaagattgcttcaaataagccattgctataaattcagatccaatcaggaaggtcactccaatttgcaggcttatactgactcctgcaaaaacttgtcttctcacctcttgaggacagtgatgacaccccctcccctccttttcgctttaccttccatcccccacaatcactgtcttagttcatatttgtctttctcaggtctccaatccccattcaccctgtggctgcagggtctttcctcccagcttaataacccatcagtgtctccctattgccttcagcataaatccagacttcctctaatggggaagcctctggcttctactcacttcctggggcagcctcccttccacctgtaaatatttgcctgagaatatcctgggtggttccatgccattttgtgggtttattttgcagctgatgtttctttcatggaatcttctctcttttatcttccctctgtcctgcctgcacacacacacacagtctctccacagtctctttctctctctctctctctctttctctctctctttctctcacttatttccactcccctcctagctatggcccagatgtcacctccttggagagcccaccctggccccctgcccatctgtgtcctgcagctctcccagagagctcagccctagattcattcactgcactggctggtgaccgcttgtcctggccacctactagctccttcagggccaggcctgtcctctgattttacttctgtatttccaatcctggttctatgccagacacaggcttccatgagtatttgtttatttgttttgtttttattatttgtttctcatttttttaaactgtagaagaatttttactgaggcaaaaactatgactgggtttgcatattagatcaaccactggggccgggacattggggaagtaaacaggccaatgtgtcttccggatggaaaattaacagattaccgtggatggatgcatcaaaactgtcttttgccaaacacaaagattttgaatggagcaggctgtgctcaggggttccacctcccagttcccaccaaatgactgaagtttcatttggtagtataagtgacatctaatctctctgatgtaaacaattcatacaagttaatagtttagaaaggtagtatcacaaattaagagaacacgtggcacagacacaagaagacttgggtttgaatctcggctgggacatttactaattgtgtgacctgaagtcaccctgtgtgtgaggctcttcttgcattgctataaagatacccgagactcggtaatttataaagaaaagaggtttaattggctcagcattctgcaggctttacaggaagcatggtgttggcatctgcttggctgctggggaggcctcagaagcctccaatattccacttaagaccatggcggaagacaaagaggaagaaggcatgtcacatggtgaaagcaggagcaaggcagagagtgaggagggagatgccacacacttgtgtgtgtgtgtgtgtgtatgtgtggaaacggagtcttactctgtcacccaggctggagggcagtggcgtgatctcggctcactgcaacctctgcctccccggttcaagcagttcttcttctgcctcagcctcctgagtatctgggattataggcgcctaccaccatgcctggctaattttgtatttttagtagagacggggttttgctatgttggccaagctggttgtgaactcctgacctcaagtgatctacccaccttggcgtcccaaagtgctgagattacaggtgtgagccgccactcccagccagatgccacacgtttttaagagaccaaatctcgtgcaaactcagagtgagatatcacttatccccaaggagatggcccaagccactcatgaaggatctgctcccatgaccaaacatctctcacctggccccacctccagttcccaattgggaattacattcagtatgagatttgggcagggacaaatatccaaactatggcaccctgtaaattctctaagtctgttccttcatttgtaaaattcgcatcaagtatactacttgcctgtctcacagcctggtcagaaggattatgatcagtgaaaattatttgcaaaccgaattgctcaaagagaataaagctatgatatcatgatttgcttaaaaaatgttgactagattgctattcagtctttatgcccattatactccgcttttagtaatacacttaaaatttcctatcattactgccttttatcttctatgctgatattctgtggttatcacctatataggaactatgttttaacagtcactgatatttgacaatacttctatagaagttgtaagaaatatgtgtgtttggtattaatattgtgcattcatttggtaaaatcatcaatgttttagatctcttgttccatcaaaacatcccagcaataagagaaggcattgttggtaggactgtttatagataacagctcattccagggagtaaaagtgcaatgttgttaagaagcataaagaatgcaaccatagcatggagcttgatgcttctgggtttaaattcttatttgccaagatttatgtccacctcaaaggtaataataatatctacctcaaaggacagctgggagaattagtgacctgtaagcaaagcagtcaggacagcatcaaacacagatgttatctgttcagtacaggaagccttttcttattgttgatttctatagtgatagaaacaacttatagataacatggtagccccttttattctgcctatgtcttgggaaattttctgggtcctagcattgtattcctgagcctcagttatgttcttcttagcagcttgtgatagataaataataattacagcaatagaaaatgaataatcatggttacttggattgaggagctgtgatgtgccaagcccatgcttggtcccaaatgaaataatttatcatgattcagagcaggcttcctcgctagatgccagcatttccccattacagttgaaagcactgaggttcagggaggttaacagacttgtctactctaaccccaaagccatgagctttccgtgtaacacttaatcttgtgctcagagccacagggcacgtgagctgtcaggaccttgcctcctcctgggagctgtgctcattctcttgtcccccactttgcttgatcagaagacatctttcctcctgacccttcagaaccaagatggttacacctccctttgcagacgtggactattctgcaaattaatatcctttatttattgtcttttctagtacaggcatatcttggagttattgcaggctcagttccagatcactgcaataaagtgaatatcacaataaagcaagtcacacacattttttgtttcctagtgcatagaaaagttatgtttatattatactgtagtctgttaagtgagcaatagcattatgtcttaaaaaatgtatctaccttaattaaaaaatacattattgctaaaagtactgatgatcatctgagccttcaatgaggcataatctttttgctagtggagggtctttcctcaatatggatggttgctgactaatcagggtggtagtttctgaaggtttgggtgactgtggcaatttcctaaaataagacaatgaaatttgccacatcagttgactttgcttttcgcaaaagatttctctatagcatgggatgctgttggatagcattttacccatagtagaacttctttcaaaattggagtcaatcctctcaaaccttgtcagtgcgttatcaactatgttaatataatattctaaatcatttgttgtcatttcaacagtggtcacagcatcttcatcacaagtagatttcatctcaagaaaccactttctttgcttacccataggaagcaactgctcatccgttcaagtgtgatcatgagattgcagcaattcagtcatgtcctcaggctccacttctaattctagttgttctttccaccacatctgaggtgacttcttccattgaagtgttgaacccctcaaagtcacccttgaggtttagaaacaacttcttccaagctcctgttaatattaatactttcacttcctcccatgaatcacaaatgttcttaatggcatctggaatagtgacccctttccattgactttgaccagacccattagaggaataattatatatggcagctatagcatcacaaaatctattccgtgtataataagacatgaaagttaaaatgactccttgacccatgggctgcaaaatggatgtcatgttagaagatatgaaaacagcattcatcccatgtacgtctccatcagagctcatgggtgatcaagtgcattgtcaaatgagcagtaatatttagaaaggaatcctttttttctgagaagtaggtctcaacagtgggcttaaaatattcagtaaaccatactgtaaatagatgtggtatcatccaggctttgttgttccatttgtagagcacaggcagagtaggtttagcatgattcttaagggccctaggatggtaaatgagcattggctttaacttaaacttgctagcagcatgagcccgtaacacaagagtcagcctgtcctttgacaccagacattgacttctcctcttcagctatgaaagtcctagatggcatctgcttccaatagaaggccatttcatctacattgaaaatctgtggtttagtgttgtcaccctcatcaatgactttagctagatcttctggataatgtgctacagcttctacatcagcacttgctgcttcgctttgtacttttatgttatgaagatggctacttttcttaaacctcatgaaccaacctctgctagcttcagacttttcttctgcagcttcctcacctccctcagccttcatagaattgaagaaagttagggtcttgctctgcactaggcttggtttaagggaatatcatggctggtttgatcttctatccagaccactcaagttagtttaatattctatccagaccactaacactttctccatatcagcaataaagccgtttcactttcctatcattcatgtgttcactggagtagcacttttaatttccttcaataacttttcctttgcatttacaacttggctgtttggtataagaggcctagctttcgaactgtcttggcttttgacatgccttcctcactgtgcttaataatttccggcttttaatttaaggtgagaggcttgcaactcttcctttcacttgaatacttaaaggccattgtatggttatcatttgttctaatttcaatattgtgtgtcttagggagtagggaggcccagtgccagggagagagatggctgtcttatatggacacagttcatagcaccccaaaacaattacaagagtaacatcaaagatcactcatcacagatcaccataacggttgtaataataatgaaaaagtttgaaatgttgcaggaattaccaaaatggcacagagacatgaagtaagtgcatgctgtaagataaatggcactgacagacttgctgaagggagggttgccacaaaccttcaatttgtaaaactttagttcagtatctgtgaagcccaataatgtgaagtgccttattaagctgggtacgcctttattaagaaaatacgttacacctttgtttctatattatgatcattggaatctctggggtttatccctactgcttgcttaattcttaaatgcaatacttttgtattcttcattatttccttgttattatttttaagctgaaacattttggggttttgtttgttcgttttgttatgttttagtgggggaatcttgctccattgtccaggctggagtgcagtagcatgatcatagctcactgcagcctcaaattccttggctcaagcgatcctcccacctcagtctcctgagtagctgggacttagaggtggtgtgccaccacacgcagctgatttttttttattttctatagagcagggtctcactatcttgcacaagttggtctcaaactcctgggcccaagcagtcctcccaccttggcttcccaaagtgctagaactacaggcatgaggtaccacacccagcccttgttaattgtttagccatataattttgagaacttgaagaacttaaacgaaattgttttagaatattggattattttaatcaaattaatcagtgtttttctgctggtatgtatgttctttttcctttcaccatttttattagtctccaaagaatcaataaattaaggatcagtgcttttgaggtacttataagtggctttttaattgttccctttttatttattggagaaatgcagactgcaggagcatcttaaaccttcagggctaaatgcacttttgtcacagttttcaaaccttttgaaaaggctctatctgtggctaaaattgtttagggaaagcaactgacttctaataattttcctttattcattgaggtacacataggatcaaaatgtcattgagtggtaaaacttcagcctgctttttatagaatttgtttttattattacttactgttgctgaatcgctacagtgagtgttagcaaaaggtgccagatcccttactatcaccaccaccactacccccaccccacctgcttttaagtgagttttattgtattaaaaaataatactctggattcctttactgccagaaaacaaagatcatttttattaatgttgcttctaggatgacaatgtcagtcatctctttgaaaattcattttggaaactaagtttgttctttaagaacctttgaaaagaagctttaaaaatggcagaggaagataataataatagagtagatgtatttgagcttttatacaatgaaacttaatttaactttccctcaaactccatttcagacttgcttttgtgcatgaaaatatgctgcctagccttccctcccctacttttcacattttcttttcttcaaagtaatctcttctgaaggattctctgcatgggatcagacctccattctcattcccaggcccccagtgctgagggcggcaagcccagggcgcctgtgggagggtgtacagggaggctgctatagacagggaaggtcaggaatggctctcagagccaaattccactgccagtcaccccccagaaaaaccaacaaaatacttacgtaatattttgatataactttaaggattaaaatggatatccagtgaagtactgaaaacaaaaaattatggcctttgtagcctaaggagtgattatagactcgacagagagtagttccaagtttgcctgacagtgatttggaaagagagaggagaacaaagacgaagaccatgcatgccttcaagcttctttcccggcccaccctcaggtacctccttcttcatccttacctcaggccttgtgggcgcctagaggagtcaagactaggaagcctggttttcatgctctgcaggacaggaattgaatgaggaagaccctgccattcttgtgtagctcttggggccactctggggactcctgggggcatacctgctgggacctgggcagtatgtgaggtaggacccagctcattgtcttccatcttctgtgctgatgaagggtactcacaagcaattggagtgaatggagactgtattgggatctgttaataaacatgttggcttttttttttgttgctgttgtgttatctttaattcagggagaatgttggtgactgtagcattgcaggagcagttttagggtgagaacatttgggcacttggttcaggtcagatgccctcaatgtagtagatgctagaagagattttaacgtagagattgacacatccctgggtcctgttactttgtcctttgtacaaacccttatcagatccttggcatggtagttcttcattggtgtgatgtatttctgacactcttagcctgtgcttttcaaggacggggcagtctgtgcctaattcctctttttattcttcccctgtgcctggaacaaggcctgatacgtggtgaatattgtggaaagaaaggatggaggaaacatgaatgaaataattttcttctcatttgctgatgtcacaacttgcctgatcttgtgctgagagtcataaaatattagcgcctgaagggctttagtggtcagttggtgattcaggagcaaagcaggagccagtcacctgtggacggtgattcccaagtcaatgctctctcatcagcacccccttgggcacagctgcctttctctgatagttgcatttgtattccagcccatctggcccaaagcactggaacttttcgggactgaaagattttgaattggataaaatacaaactataaaatatcattcagacaaacatacaggaacaaagctatttggtgtggctttgatagtattctctttctatttttattcaaatcattaggactatttaagagaacatacttttcataatagtaactaattttggattatactttcataatcatgtgtttatgaaattgagatgattaaattgtgttaaatttatatgaaataggaaatgcaaaggaaattgtcttcacttgttaaaagcaggagacatcacccttaaagatgttccatctaggactaatttactcgaaatgtggtgcctgttgtgaagattaatgataggtggccttttacagagcttctcagcctgagcctaatgttctagttgttctttttattatcccaaacctccataactaaagaatttttttcaccctgccctttgttcataatatgggatggtaattgagttcatatttctcacccaacctttcatctgtaattaatattttattatatcagattttatcactaactagcagagcagcagggtattgaaccgagtatgggagcatgtgcacagacacacacccacagagcaatagtaacttactgatgccaggcaagctccttgttatgagttacggctgagagaacataaaaaatgcttgtggtgccccacaaatattccacagcaatttctggccagtcttgtctatatcagagcaggacaaagagaaattaaagttgctaatatagaatattcagccccacaggtctatttatcctgtgtgatgtgttacccattgccaattgtctgtataaaactaattaccatttatcattgataatttaatcaacaggtgtgtgtccagtcagttactctcagtgttacctgaaggactctaaggaatctgagcagtaataacaaacactgaattctgatttttttccagtaattgtaatttggtgacatattttttaaaactgagtttagttttatcaggttgtttagagtattagggtgtcatttcagtaaatgctgacagatttaggaaaagacaatgtcagagcaaagaacaagaggtaaataaattcagtgtggctgcatggcattaacccttagttacacatttatttttcatgctttgcatgtaattaatattttcattttctttcatctccccccatattaatcttcaggaagctatcaatactaatatctattctttttatacatatataatggatggtttttaccaaaaattacaaatcaagccaaaagtcactactagatatgataaaatgaacaatattctaagtccctgaaatgatcagaagtgcctgttttagaggattagcaaaaacaacaatgaaagcgttacaacttttctccttctctgttctcttccttacctccctaccttctattatccaattggtaaccctctgatatcttatggtgaaaagaaatacgataaatggataacaaaaatggatttacaactcatcttgaaatgaattaggacaaaacattttaagttaatttcacatatgtatgaggcttcctctccaggaactcgaaagttaggaaaaaactaaaaacattttatcacatttgaactttcaagtctaaaaaagtagatgaaagatgttcagatgttcttttctagattatacttcatgtgctattccatataaatgcagatttttcattctccttgtaaaggccttagaattttgttgtagaaatgcctagcataaattaaactttaaattaaatttccttccataggaaagttctgatataatgatgtcacagtgttggcagattcatcctcactgtggattgtgcttttaatatcgcacatgcagtaggaagatttgatgttactttaaattccagaataatggtaggacagggctagggtggtgcaactttaataaacaaaggcagcatgggcaactcattaaaaggataatagaatttaaattcagctcactaagctagaaatttctgatcagttttctattctcagaaatttgctttttaaaactctttctagaaacaccattccaacagtgagattttcaaagctagttttgagattatgattgtggatggaaaaattttatgaaactcattagtgaagtgatgttacttgtacagatgaaaaacacatcagctataaagttctgtcaaggtactattgacctaggtgctaataatgtgttaatttccatcagggaaacagcaaattatggcaattgggcagcagataggatttagctatttttcattagcacttgggctttgataaaggggactagaaaagagctgcttgacctttcagtgcttaaattattaaagagcaaatagatttgaggtctggatgcttgaaaatctaatttgtcttgtggagcaaggatgaaaagacattttgggtttgaaattgctccagtcaacttagttctttctttaatatatctgaagatgagtggatagtagccatttaaaaagcagtatgtctggagtagagtgtataatagaacccatgccaactggctaacatggaggcctgtccaatgattgtttaattcttaaattttcacctaatcctcattaaactactgcttgaaacaaatgatttttttcatgtttgcttagatgatatttatattacaaaacaaaattttgtatcattagagaatgtcaaacattgtgttgtttaaggcaaactagagcagtgcctgacacctattaggcactcaaaaaaatttgttgaaataataaatcagtgtacacactcacccatcacacctacgagccaggttaggagagaggaatgggaagtgagagatggaggtgtggggggcacatagagacacagcgtttgattcccttaggttcattatttaattgtgggttatccaggataaactaaaacataactagcatcctcttaccataaaaccttttccttggtcattgctttctctttggctcttgagtatttgggtaatgaatacaaaataaacttcacattaaattttaataaggcaaagcatcgttgtgactatcggtgtgcttcctccctcctggtacatagaatgtgtaatatacccccaaaccaaatagaagcaacttcaggattatagcatgctttcagaaatatgtacttcacagccgaagtgtcacgagacacaacagtgactaaacctttgcccttcttcttcagaagcttgtaggacttttgaaaatagtgataaaaggacacaaaatgactatgtgctcacagaaaacatgtttttgtgcatttggagcagagcaagagaacatgaaaatgagggaacagactataagcccttgagagagactcattgagggtctgtgttttaggacacagggcatctgagagtgacctagagttcattgccttgaggagaactacatttaagtggcaaacttgagtccaggccagggtgaaggaaaagaggcaaagatgtttgcagtaggagaatctaggatcttgggacatggaaagtctaggagcagctgtgctgcttttttgtctagctgggttgtaacaggagggagctccttgcaggttgagagaggtgggaagatcacagtgctccgaggacaccagcccggtgctaaagtcactgtggagcccaggagaacgtcctccctgaaagtaattaatgattcagatatagaattgaggaatgattctgtacataccttgattcctcattccagtgaatgattcctcaatcattcattgaggaatgattcagatacagaaggaattgaggtcaaagccaacattatcgtctataactcccttgatgtgataagtgtgaatctttacaatactcaaaagaagttgactgtggaaagtcagtggagactagcttatgtgttggttgtgtctacaggagcaagtgaaaattcccttcaggccagatggtttccatcagtgccttcactggacctgtgaatgaggaatgccagcacagcctggtctgatgattaggagaactggctctgctgtcagaccacctctgccacttctgtagaataccctggtagaatggcacttcacctctacacctcagttttcacattaggaaaatgggaaagataaactctgtgtgtgttgggcacctggcctagcacttccagtatggaatatctgcaacatttttttcttcacacatatccttattttcctgctttgtctagtatatggatttcccagaagttgtttttaagttgaagttttgaaaatcatgtcatacaggaaatgaactggaaaaacgatttgaaggaagtgatgttaaaaattattatattggccaggcgcagtggctcatgcctgtaatcccagaactttgggaggccgaggcgggcggatcacgatgtcaggagattgagatcctggctaacacggtgaaaccccgtctctactaaaaatacaaaaacaaaattagccgggtgtggtggcgggcgcctgtagttccagctacttgggaggctggggtgggagaatggcgtgaacccaggaggcagagcttgcagtgagccaagatcgtgccactgcactccagcctgggtgacagagggagactccatctcaaaaaaaaaaattattttattaaatggagaatcactttgcaaagaaaataattattcttacggtttctctattttgtgagatcagtccttgtaagttgaataaaaattctagatatatgaactccatgttagagattcacttaattctctcatttcgtaggagaaaaataaaactcaaataaattaattgaaatgcatttaaaacccaagcttttagcagaattagaattagagctcagaccagtgcattgtctttacccctccaaaagcgatttcaagagaatggtcacgcttccttaggcctgtttgtttttaatggtattccaggtgagacttctttcaccgctgtcaactgtggctgtgctacagaacaggtagtatttagtcttccactttgaccttgaccctttacctttactactgtatgaatgatccactaatgtggagcattttacgtgactcaatccgatagaaagtatctgctgtttaggaaataagagttgtactcctttttttaagtttacatcactggtaatattcactttatcattgccttataaacctgctggttacctgtctacagagaaatcagtctgatattctaaaacaattgatttttatttagacagaattaccaacgaaatggcagcacacattttgtttctgtaatagaaggtgctaagtggttgtgcccacagagataggtggttctatgagtgcagattcagaggtcacatagacgagagtgtagagacaaacctttctaggcattccccccatgggtggggatagcaggcagccctcttctgtgctttttccttggcattaatgggttcttgtactgggcagctcttggttcctgggaattctggtgcctttctgatactgtaagaaaaagatccctcttcctgccagaggacttaaaatctaatctggactcagttcagggaagctgttgtcaggctttagtttttctcagcatgagaaaggtttttttccaacaaaactgcaaacaacattcatcactctggcaaatgtattaaataaataccttaattttctaaaaatctatcagttcaaggtttctgccattctcctgaggttacttcagaattcaaagacattggaagaggatgagcgggtaccagagacctactccttagtggggctgtcatccttgcaggcgtcttcagagatacccagcccattcttatatgagattcgaggggccttgttcattagttagtcttactaatcacttggaactccaaggctttggcttttgaaactataatcccttatctctgcttttcttatgcatttctttccactgactgaatacggtgagtgcaaaggaacataagaaaacataggaagataaaccttagttaacatgaatcactacacattgtgttttgtgatttgttaaaactttacttgtgttgtcattaaagaaaataatgcattgctttttaaaataaacttacagttggtataatttaattgtatttatcaggtaaactgagttaattatctgtaaaatcatcgtcagttacatgtgagaaaaacattacttctgctcacataaacagtagagattatcatattaaaaatttaaaatgatggtgaattttgtttctctcactaaatagtgttgttttgggtgagagagttctgaagaagaactgaagaaccctccctgtctttcactgagcaagtgctgcatgagagtctgttatatatcaagcacttagtatggactgcgtccagtgtgttctttattttgcgtgtcctgtgggtccatgcagttgaaggcagagtggatcagttcagttatcataaaatatcattgatggtactcttgtttttctagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggtaagttgtacagataactgtttacttaggctatttggggttgttaatgtgaacatagattaagtaaaatagtagtaaaatggaagtcatgcttttctgcatttctacttgtaaacaaatgtgattttcttctcttaaaattatttttgtctagagaaatttatggaaagaaacaaatatactcatcttttttttttttgattgggggagtttatcatcaacatgataggttttattttcagttttcctgttaccaaaagttggctggcaattctgcttagcttactattttacaggaagacagtatagctccaacacatacattcagctcatttaaaattttgtgagattcacagcatctgtcttttcagcatagtctgtcccattaaagaaatgggaactgaagaagttccacaagagtttctacttcctatactttgactaaatttggtatcttttttttttcctaagagaaaatagaaaaatgagacggaaacaaaataaaaagtgtcatttctgaatttgcttccccttcctgctcagaccaacccagaactctgataagattgtaaactctccttagacagaaggaaatgtttcgcagataccacagtgggtccctccttcgcagcataggtctaggtatcgtggtcaacttgacttttgccggtgtaaaggggggaaatctgagatgcatcatgcttctccaatactgtttgctcaggggcaaagtacagatctggtcctttactttacctccttactaaaggaggtccggggccaccaggcagagacattttatgtgtagctccttgctcatcacctggtctagaaatgcccagcactgcctgccactggagccagaaaatgtatctgagtatggttcaaagaataattgctgtgtgattaaagacacgctcagaacagtgagatccttccttatcagtgctatttaaatagaattacagatatttctatttgtcttaaagaaaacatgaataatgatttttccctctctttatttgacacaggaaaccaaaatagactgtgtccaagtggccacaaaaggtaggttgaaattgtgggatattctcctaattaatgttccttaaaagtttattttaacctatgtttcaaaactttttgaactggaacttaattgaaaataaaatgtgtgtattatatatacatatatatatatgcatgaatgcatgtatgtattaggatctgatggtaattaacattgactgactggaactcatatagatactttttaaaataagaagctatatttctgtgttccaagcagttttcaatagttacctttttcagattttttcaaatgactttaatttttatatgatctcagtacacgttttttaatccatagtgtcatgcctggtagtaccacatctagtgaatcttcatatgcaaaggaataaaatatcacccactatttttaagtagttctctagttataatagcagtagaaagtggagtctacgcgggcttttttcactggtggtgcgtgtctctctgaacctagtaaccaggttatgttgctgtggagcatctatttcccaagcctggttaaaactctctgagagaatgtgatagaggatgagctgcaaaagtgggtagggcgagttaccctgagctcccccagcatctcctgcagaagcaagtgcagacgtgtgtttgtgaacatgagctgtcatctggtcaacttgacagtgttgttttaaccgtcacatacagaaatgtataagaaatgctttgagaaatttaaaatgtcgtcttaaaatgaggcaatataaattaacactcaaagtcaaatacaatcatttagatcattggagtaaccatgaatacagtgggaagttctgtatgatttaatttagagacgatggtaaaaacacatcattaggtctgtagcagaagatttaatcaggtcatacttgatgagttgtgttggataaaataactttttgttgttgtttaactctcaggtgaacatagtttgaatataccatgatgtacatgtgcattttcaaaattctcactgaattcttattttgtgaacttacatgactcttttagtcagtgttagctcaacaaatatttcttggttgcatgttttgtgccaggcattgtgtgaggtactcacctcatttgtatcttgtttgtcctcataggcttgtagttctatatccaaaaatctatttatactaattttaaaacactcaatttttatatcatattgtacctaagtgactttatgtatagaaataaattgatatttactgaaattatagctgcttatgtgtttcataaactgccgtatgctatcagctattaattattacaggacgatgaagcccttgaaccaggtatccattgatgctcttagatctcaagattatggtccatactcaacaacaggaatttcaaaatactgctgtattacatttcacttacacttaaggtctgaaaaagtaaatcctgttccagggcccctagtttataatgcttaacgtttaacgtcacagctgaaagttttgaaatctctttcatgcgtgtgttctcatttatttcttcattactatgaaaagggaaacaggtactgctattcttatttttaagatgaggaaaaggtgtatttttggagacgaattgactcaccaaggtgactcagctgataatctgggggtcaaggcctgcactcctagccccagtgtttctttcaccattgctcatggctcgtcacccagcagcacctctggccagtgacagtattgtgtagtgtaagcatcagacctcctcttggtgaggattgagtcactgcccaatttactgtgaaaacaacaaaatatctgtcatcatgctcatttacatagttaaataattatataaataacacactagtaaatgtggaaacctgacaagtttgctgttttcacaatagattgaattagatagtgatttggatcattttcttccatcagctagatttcatcaatattgtaatttgtttttcaattcaccaaaggatgattaagcaatcagatgacctgattgactaaatattccccactcctattttctgagtcatttgcaaacatttacacagcaacaaactctatccaaagaacctcttttggggaaagagggacacattttaatatttcctgcataacattgtcattctgtttcataaaatcacagcacaagaggaaaccttggaagatattctccctccaggcaaaactacactgttttgtgctattttattaagttctacatggacggattcatcaaccctcctttcagcacagtgtaatgtttcaccaccttttagtcagaaaatgtgtccctattgatactagaaattctcttgcaacatgggaagccattccatcttgactacatagtcaaaacagagaaataggaagatctaataactgttgataccacagagtaaagatgtttaaaatgtagaagagttcaaacatcctgagtgtgtgttgccacatactgctcacagtgcgatggcttaattgagttttcagatacagaattgctttcctaagcaacattttgaatgtacaaagatttcaatgttctcctgaaacaactgttgacaagtatctttatagagaaagtatggaggtggatttgttttcactaagagctagcttataatttaaagtaagggtatgtctcttaaaaatatatttcatactatttataaatttaatgcagtgattattttaatcatattccaaagacatattttgacactcatcatcttaaatataaacttcataaaagttagacaggaaaaaacctaagctgtattattatatatctccatacgtgtgggggattgcctatatttttatgcatcctcttcgtttatgcacctagatgaatttcctataggtacaagttaactataggcaaactcatcacagaatattctctcttgagttaaaagataaagacaccataaaccagggtatacgtgatgtttatgtgttacctgcccaattcaagggattgtttttaattgtatagtggagtgaatagagtagcttttaaatatttcttaaaatctatgaaattgtatttttcattaacattcacatttttatagttggatttttttatgaccatttggtccaactgtgttttagtgattagtgtatgtgttttctttagcttttatattcaccatggtggtctcatggtaactagtagggtggaaactctttgcagctagttttagaaggcttcattgatgatcaattctaaacttgtagggtacactaaaaaatccaaatgtgttattagtaagttaatttcttatattgaatgaggtctattcattctaattgatgtaacaatcagtttaaagtatgcacattatattaatcttccataaaataagattttttcataatatgttagcaccgcatgtttgtccttggcagtatagccatttgggagctttcctgttgttcatttaaaaattatttgagtgcctccttgatttataaaagtgctttggggtttttttgggttttgatatatggggagcagtcatatatgttaatttgatcctctccttgctgttatttgactattgtctagctcaagcttgtacaacccatggcccttgggccacatgcagccccggatggctttgaatgcttcccagcacgaatttttaagctttcttaaatcattatgagatttggctgggcatggtggctcacgcctgtaatcccagcactttgggaggctgaaacaagaggaccacctgaggtcaggagttcaagaccagcctggccaacatggcgaaaccccgtctctactaaaaatacaaaaattagccgggcgcagtggtgggtgcctttaatcccagctactttcaaggctgaggcaggagaatcacttgaccccgggaggcagaggttgcagtgagctgagattgcaccattgcattccagaccagaagacagagtgacattccatctcaaaaaaaaaaaaatatatatatatatatatatatgagatttatacatgggcttttttttttaagctcatcagctgttgttagtgtattttacatgtggcccaagacacttcttcttcttccagggtggcccagggaagtcaaaagattggacacccctggtctagctagaagtcaaagcaaaaacttcacgtaaacacatgctgaattattttccaaaactattagaaaaatcagactgtaagccttaaacaaaaagaaaacaaagcatttttcaatgttatattttaagggactttttcatgaaaaagttattcatttcactgtttttgtaagtaacattttatttaagttaaatttgtaatggaatgtgaatatggcttattggaagaccttgaggaaactttgaaggatttccattgtcctgatataatttctagattcagaaatttgaatgtttctttttttaatcactaagctttttgagaagtttctacagactgtttttctgttcactgttttgttcaatgaaataccatcctttgtaggccataatggtacagaatgaaagagcgctgataaaagaactgaaaagaatgtctgttgagatgtaaagctaattaagattccgtttaatttctcatattctctacatgagaaaaccaattatatagcaagaccactcatatatgctaatctgctgttatttaggctttggattttgaaataggaacattaacattcatcgttcagcattttatagagaaaatgtacttttttcatgtctgaaatagtctttataatgtacatcatgagtatattaaggccccctgagaagttcctaaagaaaagaatccggaaaaaccctatgctttccaaatttatttgatccgaattcattttttaaggaacactggagtcatgcaaaatgcagttaggtaaatgctggctcaacaagcttccaggagatcccgctgcacgtaactgagatgaccatttagaagtctgatccacagggaccttacatttatcagcaccagatattgtcttcaaagtgtaggattggaatttctgtctttattccaattttatactttgaagacaatatctggagctgataaatcctttatcttttttcattataaaagagaatatcaccaaacttagtgataattctcttttataatgcatctttattgatattttaagttagaggtcagcaaactttttatgttaagggccagataataaatatttgaggccttgtgggccatatggtctctgtcacaactacgcaggtctgctcttgctgggcaagagcagccataggcaatacattaacaattaagcatgtgttccaataaaactttatttgcaaaagcaggtggtaggcctgctggcccatttgaagataaagtatagcataatcaaattttttcctcatgactaaaaataatagttacaaataaacactttacaaagcagaacatagagatcatataaaaatccttcctggtatttataatatactttttacatggtagacttagcttctgattatagtttgagttcctttttatttgtgaatacctggctgactgacatagctattttcgagtaactttttgttcatattgtttacctttttggatattaggtgctctgtttctctttttctttttctttctttctttctttttttttttttttcttgagacagtgtcttcctctgttgctcaggctggagtgtagtggcgcgatctctgctcactattgcaacctctgcctcctgtgttcaagcagtcctcctgcctcagcctcccaagtagctgggactacaggcgcaagctaccacgctagactaatttttgtaatttttttagagatggggtttcaccatgttattcatttgatcttaaactcctgagctcaagcgatccacccacctcagcctcccaaagtgctgggattactggtgtgaaccacggcacctggcctgctctgtttttctataaaacaatttcatttttctcaaaaggagaacaggtcagactctcctacagataatgcggaactgcataggagtattggttggagcaacagtagtctatgaccaaacaaaaatgttatgtgtataaaacttggaattggtaccaactttgtaaccatcttagaaataacattttactgtgtacagcttattataacagtattcaaaattgcataatacgtcatattaagaaaattatctctgtaatgcgttaatgcactgggagctgcctattctctgaccaaactgttagtttgttaatctcacttaacaaaactagaatatgttcattaataatgtgtgaaagactgttacaccatttttaactcagttgctgcagttgtctagttgtaagcagcactgcttgcatggtgcagagggatatttcaaaatattatgcagcagcagttttgggtttaattgtctgcagatggtagatgatctattttccttactcgctgccacatttctaatagtacccaggctgttccatgtaaattagtaatctttcatgtaagcctgtccttaattttccaatatttttttgcatcattttccagctgtatcatgttagaactgatgttttaattttctattttttttaaatatctgtgtgtcattaatgttaaccacttaaacacaactgctgagctgtgcaggcaaactaagaagccagcctggtctgcttcaagactcttaatcatttctttgttcacatgttaaccatgataactatagcaaaggcaattcgtagtttctattcttttccaaccaatacttggagatgcattttttattctcttaaagtgaaaaaataaagttcctgaatggaaagctgcatgaaatttagatatcagagaaatttttctacataaaaacgtttttagtgaaagagtgtaatattcttctttacaaaagggatttagtaagaagagaaaacattgtgatttcaacaatagaatgttgaaaaacctaatacgttctaaaagcctaaagtttggatcaccagaattaacaatgaatctttcagcaccacactcaatttcaattggaaacactgctcagtcttcacctttatttaggatgaatgtttttggttttgttttcctttttttcttcttcagttgatctatccaagatctcagccaaaccttgcaactgtgtcatagttagaaatccaactgcctgactagagcttgtttaagggaaaagaattcagaatattcagcaccttgctatgttttttttttctttttttccttttctttttgttgttgttagaacaaagttgagacaatttgatatactgatggggattcttcttgctagcctagcttcagtctggcttttttttccctcatgcatgctgacctggaaatcctcctttgccttagctgcgataatcgtgactcagcttacaacaccttacattcgcatcgcccccgctgcaggcgacggccaactaacaggtcagatgttcaagtatagacgagtcatcttgcccatttcccactcatttttctcagctctgtttcccctctacatttcctcctttgcttaaggcctgtttacaatgtttcagacccttggtacagacctttgctcgtattaaattaagtgacatgcttggcctcttctgtgtgcacatttatatccatgcattaagtacaactccactgcatgttttcattgtgtgtttggtctgttggtatgtttctttctagactaatgttatatagaaatgaaatttgctggacttgaaatagcaataacatcaaacagggtttccaacaaaatacataaagatatattcctagttttccaaattagtctaaaatggtattcagatttgagggtgcaagagatttattttttaccttgcctggtctagtttgcacatacatttagctatacacaatcttggctgccagtagtattaaacgaagccccccaaaggtgtttagggtggcagtgttctaacagctttgtgtgtatgtacaatagttgcagagctgattgcattccttatagatccttgtttcaaagcatagtgtttatataaatcatgcagtggcatatctgcaagtcaaatgctttgaataatttaggaaagtttagaaaaattgaatggcttagagtcatggagttgaactgtgcttccttataccaagagaagtgagcttgttcactcttccctctaaagccttatagacatctctatacattcatataggaaaagagtccagtaaattacttcagattgaaggtgagtagttagtgaactccaaaagacaaacttttttgcttcagcaaaggcaagtcattgtcaagatttctaacatgattacctgggcaggactcaaaattctggtttcagaagcacctgcttacagtctaggcctgatgaaagccaagtaagaagcagaaactactttctatatgattttcactccagcaattgttttttgtgtgtgaaactaggcaatgtcccctaacatttaagaaaatggtaaagcttaactcatggtagtaaattacaaatgtttaagttgttctgtgaacttattattttggacagtaaagaaaactaagcctcaggaaaattgtagactgatgttataaggtaaagaaatgtaaaataattctatttccttctccactggaattctgtacatattttcagttttaaagctatcaatttattgacagttctgttgcccttgcctgcaagtttcttttaagagtatttcttttcctgattgaagttctacttgttacagactcttcctgctcctgaacttctgaagtgttcttcccacaagtaaaagtatttgagggacagtgcctttcttaataagtcctcccctctaaaaccttgacctttcaggactggcctgtggcactctgtgtagggttaggagtccatcttgaaggttattgggatccttcagcaactctgaccacccattgtgtctgagctggccccagactcatcagtacattgttaaaaatgggttgttcccaccttcataaaacaagtacttacgaaatataattcagtagtccttttaccaagctttacctataatccactaacttcagatgaagcatgctgtttactaggaatgaagtaagcgaggcttctgaatatagttttcactctaaaactcgcctgattcagaagatacttcataaagcagcccccgtcgtaaggcatttagacacagtgagtgtcattattttggagctagtctgaaggacacacacacaactgcagtgcatggctgctattcctcctaagggctacaggtgatctacctcatttactttggtttattagggattaaaatgatggtgtatcagaataagcctcaaaaaccagtaaaaaactactcttgttctttcttcagtatttactgctggttttaatgatggttagtcttacccagataaattcacactcaaataatatttcttttgcattttccatttgcatcacccatcaacttcgatagcagtgacactgtcttttttaagggatttattcatgagtcatactgcaagcctgagacttaattcattcagtcatttatttgacatttattgagcaccttatgtgtgccaggtatgaatcgaccaactcttttcaggagttttactttgtatggttgcctagacaccttggcatcaagtacatttgcattagtaaccccaaaacctacataagtgcatactcagatgagtgaaaaattggtatcatacttatcatttagcaaagctaagaaaagacagcagttttataactgatgggaaccaaaggacctgtatttcaaaccgtttctcactgtggtaaacagcctaggaagtggtcggtgtgacagctctgaacattttctatctgtgacccattcaaccgttgtgtttaatagatcaatcctgtcccttccagaagccaatagaagatataggaggtatacattctgaagtcttcagccattttttgttcattttgttctaactgtgctgacatcttgcccctaaaaatcctatttgatgctatacttgcactgggaagcttttgtgagatgatgagtcctttgccttgctgtccctgttgtactggtacgtggtgcttgctggttaggtttcccttggtgtaggtgggccctcccctacttgtctaccaccaatgaaaacaagaaccttggtgatctgaccccagcacctaggactgtgccaggcatgatagccactcaggaggctgaggcaggagaattgcttgaacccgggaggcagaggttacagtgagctgagatcaagctactgcactccagcctgggtgacagagtgagactctgtctcaaaaaaaaaaaaaaaagtgctcataaatatttcttgactgagttcattgaacggcccagttgtcaggagggttccagagaaggaatttgtggaatgctaggacatttcatgagcagtcctgtcattgcactagggagtgttgcttaaacttcttgaccccaatcaatgataagaaatacataactacccagtactgtatatacacatatacatacatgtacatttaactgtaatgaaaacttttagaaccgtacttccaacactactcactgcaaacataagatataccctgatttttgtattctgttctacattattctttttcatttttttaaaaaaaattctggttgctgccttctaaattgatttcatttcccgttaatgagttgtcatccacaatttttaaaaaaatgctttgctaagttactaactagatttaggagatagtaaaggggagtggaatgtctgattggaatgaaggttctgtctacctcagaaatcctactctaaagagtacacacagagtaagttctagaaattggaaatgcccctagtctctttcttccttttatctcgcgattcactgttcataatacagaaatgatttgggaagaaagtagaaagctatacatggtaggaatttctctttaaaaactttttatttttcacatatatctaggctttttaaattaagatatctttgtttatgatttaataacccagccaaccctgacatgctgtggagaatgctatatgtgtgtgtatacatatatatatatatatatatatatatatatatatatatatatatatatatattttaaatcagtagacctttccattgcaaataaaacaaatcctaggtgtttcaactcacaaaagcatgaaacagcattgtctgtctgtcttgttcccagtgtagcccacaggcacccaggaagtgtttcaaattgtttgctgaatgactgaatgaataacagttgatgacctgtcttactaaatttattcctaggtattgtatagctttcatttattattgtgagtaaattttgattgaggggaggaatattttgaaattggtttattttgtcttcttttgactgattttatgttactttatgcaagattacaaaatatctctttttaatatgtatatatatataaatttaataagcttttccattgcaaataaaacaaaccaatggtttttcaacccacttacaaaagcataatttcgatcacccatttcttttggcaagagccataaaaaggttgaatgttaattgattttctaagagaatgacccagccactcccaccaacattatctgttttcctcctactctgctgactgtctgtccatttctctacttcccaccagtcagatcccatttcacatcctaagtcctctttatcttcagtaaaccgtggcagagctaagatgtaggtagataatgtctgtccttctggggacccaaggttctctatttgtaagatgaagatataactgattggatcttagccacactgagtagcaaggaggacagtatatggcttgaagatggtgggattgtttactgaacattagcttagttagtagcagtaacagcaggtacaaaggtccggtggtgtgatgaagcatggtcagatatgaagaattgcagaaaggtcatcatggctggagagcagagagcgaaaaggatgtgtggggtgagcagtaaggtgatacaggcagagcaaggccaactgtgaccgtgtaccttacattaaggactttggtcttgatcccaggaggagtgggaaacaattggagtgttttaggagagacagaaaggatcagttttgcactgtgtactccaagccacactagaaacattggagaagagatgaaaaaggccaaaagaccaaaagtaaaactataagaaatggaagactgtccaacacactggaaaaaaaagaacagagtaagtagatgtgaatagaagaggtaaaagccaggaattaatacagtaagtactggtcatggggaatggatcagctgcagccagcatggaggagcacatgctagggaacttaagggacagggtcagccatatcaaaggaatgcttagaatcccttccaggggccatattttatatatctttaaactttcctcagcctgccactcagtgcttggcacatgaacggcactcagagtccagctgtattgtttttttttttttttttgatgggatgaagttatttgtaaaagataaaattcccttgaagggtgaactaattttcacactgctttttaaaaaaaataacatccttgccacagtggcacttccacctgtgactgcagtcagggtgaatgtggtttcaggaggggcaactggaccaagagctacacagaccccctccagttagccttccttcagacggtgcatacagtttagctctgacagaaaccaaagttgcagctttctgtccctgaaatatgtagctttagggagctgtcctgtgagcactatcctctactactagagaagctatcattcattcattcattcattcactcattcattgtttccatcgatgcgctttcaccccctaggagagctggccctaccatgagctctacataagagaggaggaacattcatggaagtgtagggtatgctctttgctctgcaggaacttatatttagtgcctttgttaagaccaacataaacagttcaataaatgctccacttccataagcttaccaacaccttgaactatttgtaatagtggtaagtgggtaatgaactaagttaacatatactcagttgcactcgaaaacgtactatctctatgataccagagtcattttcagtgtcagaagcttcaatttaaccttttgagagaattttggataaaaattaagggaagaaaatgcctcctttagatttctttgtaaataaaagatggctaaactcttcatttaagcagataaccaactgattgaaagtagtggctaacttaaaactaccattttccaactaactaggtatcttactttttgtcaaatgtagtattctgtaaatataagatgattaacaattcacacacactgttgtgggcatttcatattaaatggcagagggggatatcagtgctatgtgtttcagctacggaagttaatatagagggttggtgtgaggagaatttgagatttttgagattttcagcatctctttcaagggctgcttgaggattctgaaatttcctttctggctagaaagaatgtaaaatgagggtaaaattttattctttctgcaataccagctgactgcattttaatgggctatagtgtcactgttgatttattgccctttttgttcttttatgtgttatatttgtcattttgctgtggcagtttcatctataaaacagtatagttacaagaaaatggtgagaggatacaggcatgccatgagggatgctgttgcttttttcttgtcattttttggaatggaatactgagtcaaatgtcaagtatttgatttcagaaacaatatattttaaaatctctatattgcactgaaatagtattattttccatttgtattatgtaaacttaagaatttctatgtaaaagattttcaatgtataaaaacaatttaattttttgataccattttgtggttttcttttctatcagcagtgtgatgaaggaaaccaaaacaatattttatactgtcttttgtttgcttaaggcatagagctttctggcttgaatggcatatattgaaatttcatattttaggaaacctaacttttaattttgacgttaatttggtgtattacgcatatccaaaaagaatactgaaaagaaagttttgagctcaaaattagccaagagtttggtaaaagatacgaaatactatgaaaaagaaagtactttcagtttaaaaaacacttgaagatttttgcatgaaagattttatattgatagtgaaattgttcttgcctttttgataaggaaatatattatttcaatttttaagtaaaattaaaccagttcattcttgatgttaataaaaatgagaaaggctgaatgttttttaagtatttatcaaagctgaataacaatatctgtgtcactagttctttatctttactctggtgactagcatggaactagacacatagttgctgttccctggctgtactgttgatagataccaattgtgatattttgattttcatccatttatttattttaggaaattattactacaatttaaagtataaggaatcaatattcagtctaacagttttcagtctaaagatcccagtgatgtcccttagcatctgtaggcaaatggctgtgttgtactgctgtgtgattaacgttgtggttgactttggatttaggctctcttgtacataaacacttttagattactattattataaaatacctagtatttgtgagagttctttgaaaatatttatggttgtgttccaatatattagatccattcagaatggaaaggaagtcagaatttccttcatcatcataagacagcaggatgtagaggaggcaacagatcaagaaaatatcaagaattaatttagaataaatgatacccctttttgaagaaaggattcttgttttaaatactttcaccaaccttgtcaaaaaatcaagggagaagtcaggctggtgaatggaaagagaaaaagcacagtccttagaggagatgcacctcatttgccctttcagcaatatcagtgtgaaacgtgttcttccatgtctccaatgggctgagagtgaggcccaaagtcttttaaaagttgtcttctaagattctatcatgttaaaaatatcacctacctccccattctgcaacatgcacatactacttttctacttttaggattgctgctgttgtttttaatgtgaaaggatcttggatttggcgttcatttctgattatttctcaagtcatggcttttccagcttagctaccctatattcttgaaataacctctctctgtctggggaggttgtccttaggaaaaggggaggagaggtcgctctccatggtggaactgttgagtgagagccgttgtccagctgctgtcccatctcaaatgcttgttgactggaaagcctgggctccatgaaaccgcaaggccaagcatggtgcatcttctgggagcatcactttccttgatgataaataatgcaaaaacgtttttgtcaaaaattgatgtattgtggaatgaaatgcaacatttgcatgctttattagaaagatcaaaagtcttaaaagaaagatcgacagtcttaataaaaatgtcaagcttgcagtgggccacctaagataaagctgagcttcctgctggaatttgttctctctccttcccttaatggtacagatgataggaaagtgtacctcaggggtagactccagatcattttcaaacccacatggcccacttcattggcagttttctaacatgttagataggaatctggacttaacagtcccctaactgtgattttaaaagggaaattcacacaggaactctggaacccaatgcacacagtttagaaagcatgtacacagcaagtagtgggttcaagtccaggcttcttggggaaatctcttgatctctcaacatctcagcttccatatctgtaaaacagggagaatactatttctttacctcatagttagtggtgagacatcgagtgcaaaaatgcacgtagagtagagcacaaacctggctccaagggaaggcagtggaaatagcagttgctggtgcttctcatgtggctttgttgttgttactctaatataggattgttttatggcccatgaggctttcaagatgactcagtaattaatccaggccactgccagtcccaagttgacactgcagctcttcagagacattcaaaattgaacttctgggaaaatgaatggatttcttgatagtatgtagggtattatttacttgaacaccatgtggatgctgtggtctccaggagcaccgaagcaagagagggacattattattctgtcacatgtgaagacctgtgatgagtctcccactgatgatattttccatttacctgtctttgggataaaagcagcatcagcatgacccaggctgttaccttgctgttggcaatgataagcaatgctggtgttggtgatgctgatgaataaagttactgcattttcaaatacagctattttatttcaagcagtaatagcccaaaacagagcataacctattttatacttccctgccacccagcacactgaatagaacaccaggctccctttcttggccatttgaggttcctttgtccctcagcgtccttagtttagatgaggatgcctttctttgtgtttatatttcaacagcatcagttctcaagagagcatgaggggatgcactttaatagaactctattatatggattatagatatcttatgtaataaccttttcagacactaagtatgaaagtagacaaatataaagctatttgtaagggaatgagaagtcttacttagaagcagggcttagccacgaattttcttcaacatgctgtttttctgtttagaggaataaataactgtctctgagaaacaatgtttgaaaataaacttggcacctgcctaggagttaataaatggcatctgcttagtatatcgatcagtatctctgatgagcttttccatttgctctagtaaatatccaagcaatgcatcactttagcagtgtaactgatgttcagtttaatatgtgtaatttacttattggtgttgctaatgatgcagttattaattatggcttattattaattataacatagtttattcaagttggagctcttagtcaaaacacatactggcataccaacttttgtctgagattttgtgtaggtgttgtccttacagtgatttaatttggtattttttactcaggattttatgtaatacctcttcacagtaaacatgataaacaaaagtctttgtgattgtagtaccaattcagtgggttctccttatatgtctttgaataatttctttagatattggtatatgtttatgtacaaatgcacacacgtgcacataggtaaagacagcatcaaagtgagttgcatgtgtcttttagccagtttagggacttaataaagggaattatttatatttctgccttacttctatgagtaacaaagtccgaaaatgctcccatggtaggatcataggactgcaatagccattttgttaaataaaattacttttaatagtttgaatcctactaattatcttattagacatttctctgttttttactttctgaagagccccagaccattgtaattaatatacagcagaaattttggctagtttaaagacttctaaaacaaactccatatacaatcatgacaaattacctatatctatttaatcattgcaagtattgagtttataacactttattcttgacagatactcactttgtgtctctctgatatgtacctagttaacgttctagtcattgttggatatatatttcacagcgttgagtgctgaagatataacgttttgccactagtatttatttccatgctcttacttcctgttagtctctttttatcattgatgaaagtttggccagcaaattttctggtaaggattttgtcttagtctgttttctgcagctgtaacagaataccacaaatcaggtcatttataaacaataaaaatttatttgactcatggttctggaggctgggcaatccaagagcattttgctggtatctggtagggtcatctcatgacagaaggcagaagcaagcaagagagacagagaggagaaatcagaccaaactcatccttttatcagaaacccacttccacaataatgacattaatccattcatgagaactctgacctcatgacttaatcatctcttaaggactccacctcttaatactgactcttacaatggcaactaaatttgcaacatgaattttgcagaggacattcaaaccacagtagactctcatctgtcatcaccatactaagaaaaacccttcttttcttcctggccatctcttggcatcctcagtggagctcatgttcaaacatcttccttctttcttagcatgtgagggccacaaagatgagtaagactacttttgtctcaaggaatttatgtttagtgtatgacataaagatttaccaaaataactgaacttgagtttgaaaatagttaagttctgtgcaagaggggacaagcaaggtgctctaggagttcagcaggagagagaatacttttctgcaaagcaattaggagcagtagttggaatgtgtggcctttgaagatggataggatttgaacctacacaaattgagtagggaaagctcctatgcagcaggagcaaaggccttgggaagggaaatattgagggtttggggaaactgggcatttccgtttggtgtatttcagaaaggagggtggcataatattaggaaagggggttggagttagctcatggaaggccttttgaaataatcatttagaagctcttggatttgattttgtttttttaaatgaaagagtgacttgattggagctattatttaggaagatccatacggctgcactatgtcaaagacactggctaaggtatctacttgggagtcaggcataaaaatccagaagagaaatagatggcagtgagaataaagaaaaaaatatgtagcatttttagacttgttagagattgggaaggacagtaataactgacctctctagtgtcagatgacaattctttaacccaagggcggaataaacctcctttgtaatttattccagtttcatggactgaatacaaccaaaattcatttacttgctcttttactgaatactgactacattgtgcatagacaggggaaagcctctctcagcctttctctgtacaaacttgaactcctgcttttacacttatatgttcaaaaatatttttctccatctatacacagaccactcatggttattgttctctttacaaatgcttcttgtgtcttttacaatatccgttcagtaaaggcttgtcaaatgcccaccgtgttaaagagactgttaatcactagacagcaaaggtggtaagaaatgatctttactcttgggaagctccgatggcaggtcacctgcttgccttctcctgcattagataaatgaccctagttccttttatccttcttcgtagtccttcttttttacctcgttgatcatttgtgcttcttttctttgattccttttcctcatccacatgatgactagtatatcatgctccaggattatgtgcatgccattactctcatacatttcagaattgtattgatcatattaccagatctttcttttctgcactttggccaggaagtcctttctcctcttgtttttctttcggaattattagttccttattgaattgttcattctttcctttttcattctttcctttttcattcttttgttaggccctcctctttacaactgaccaagatcacttttaacttgagtcttgtattccatagcatgagcaataaccacttgagttttctgtattatattggggaatgctgtagtgcaatgaaataggagtcagcttcacagtcagacaccctgggttcagagtatagcaccattccttctctttcactgacttaggacaagctgtttatcttgatggcttctgttgcttcagtttcctcatttgtaaactggtattaattatacttcatggtataatattaaataaaaattatataagttacccagcatataaagtaggtcttcaaaaagattagttttcttccttcctatcttatttagtagcacccaggcagttgatcaatatactttaaattcctttacaattcagagtgtcttccaatctctacatactggggctagtcataaatgaggatttgattccaccacgtttgcctcttcattgtataaaaggatcttttcaaatagtgcaatcaatgatggaaattggatcgctgagaaagtaagatattattatattaggagatgttttaaggataacaacacaattacattttttttctcattttgccatagtctgaaaaacttccccactcatactttggagccatagttctagagttggttttttctccatgttgtgtagggaatccccaaaagtgttacatagattcctgggtcctacctcagacctttgatccagaatccacggggaacccagccatctgcatgtttcaaagctctccaaatgattcttcacccagcctgagttttaaacttcctataattggagaccctctgttttagaatatattaaacacaacgccacaataaatataagccatatttattaaagccatttattgtttgaggaactattgtgtgtttactaaatgagagtctggagagtacatgacttccactctctcctaagaccgtgtgagtcctcatcacaattctaaaaggccatcttttgtgtgtgtagttcttaggccctgtgaaagtcatgtcacacatctcatgcaatttgctaggctctacattttttgagcctcagaaatactgatacttctagcaagcatacagaatagactaggtatacttactttttgatgagatggtgaatgacaaatttcagacagcaggaaaagctctaagtggtttttgcaaacaacaactactttgtgtaggaagctgtggtgatcctttctcccacaggaaaaaatgttaagaggtaaacacgaggtctagaccatgacctaaaatacaaatctggaagaaattttgagagacagtaggtttccattttaatgccttcaaagtttagtttcaagcaaatggttggaaacttccattctgaactacatcaccttcaagaatcatctgttttggaagcagccacccccacttcctttcttgattattcacttatgtgaaagttgcacacagttgataacttattattgacagtttgtttccctattttattacttgataatgatttgagaaattcaaatggaaaaaataaaactatttcatcaaaatagtaagagcagtaataattctcttggacttttagtgtccagatgataagtgataaggctttgatagatcatcttctccacagggcgtcagccacatcaataaatgaggcagtaactgtcatgaaattagaacaaaaataaaaaaaagattgatttttttagagaagatatatatcaaacaatccattatctcagtcttatatgaaaaattatgtttctgattattacttgtacattgtatatgctctgtttgccctacactggaaattagggacagaagaagagttataaattcaaaagcataatcaggttacaaagaatacacaaaatgtgactgtagattattccaggaatagtgattgacttcgcattcccaggaagaaaaacaataatatgtaatttaaatgaaaaatctaggaggtgttttgtgattatgtataatgtgaagaaggaacagctggaaaaaactaaacaagactgcaaaggattttaattctctgggcaacaagacctgaatgaactgtctcacaatgatctttaaaacaaggatgttgctgtttttaagaaaaagtatagaaatttacctctgcatatgttcacacacacacaaaaggaaaattaattaaaatagagtattccatgaaagtcattaaaatgctagcacaaagtgatggagtactgaatttaaattttagattatcttttgggaccagtgctctttgaaacgcacttgaaggaacaatatttttacatatttccactgcttccattttattttctacttttagctcttctccctgtcgcatctcttaaggtttttcagcctcctcagcttttcttttcagcagttcccattgttactgtccttagccccttttttcttcctttctccccaaaataccaagagtggctttgtggtatttggtttgccaccgaaaccttttgcatgtggtgtgaatggggtagtttgttgctcaggttcaattcagacattgaacccaacacacagccccagctggccatgtagtcccagagccattgtgggtgttgtcacctgtacacagctgactgtgcctctgtgagtctcttgtgtcctgctcgttccagccacccttgcaattcaggcaggggaggctccaggcctgggtggggcagtagccttcccatggctccccaacttccttcccttcccttcttcagtgagcctgcgtattgctgcccagttgttctcaaggtactgttctgttattttctgtggttccttatttactaaatttaatctgggctgtcctacccagtgagcaacacccatcccaccataaagcctcagttccaaatcctcttcccaatcacccccagcccctgctccagaccctgcccttgaagctagtatgtgactccagaggcccctttgttctggcttatgaggcactcttcccacccagcgttgaagccttcccggtccttccagcccattcattatcgcagcctctgacaaggagccctccctcatcccctccactcttccccagctggactctgtagcttacctgtgacacttaaggcttctggccttatttactgtggtcaactccctgaaggaagaggcacatactcaactctaattcccctgcagagccttgttccagtaccttgagcacaaaacgtactaaataaggggctgctaattcggaggctgtggaagccaacatgagccacacatatgaacaggacagtgctggcccacgttcacggcttcatcccttatatttagagggaacgtcaagtgtcacagggatgcttctgtatctctgatctgaacactggtcacacccctccccaatgtaagtctgagtggggatcaccccctacctttttttttttccctcctcttccccttcttcatcctaactaggaggagtgaagagacggcccagggctctgcatgctcttggatacagccacagccccacttcccaccctcactgttggctcgtggccatcaggattgctctcactggcccaccttccccttctctctcacgccttagcccccttccaaccctgtcttctgtgtccttggaactcctggttggctaccagcagatcccacccatgcccagcctgggacatccctcccttccctcttctagacaacttcaaaactttttggcctgagatttctcacacctccgttctggtcctcagtctcccctcatcttcttggttcctttttccctgggaaaatgaagccatcaaaagagacctttcaaatgctctgctcccagaccagcgcatctgccaagagcctgtgcattgctgcgtgtgtggctttctgctgttcctctgggtgaaacatcagccctcgtggttctgcgcgctggtctcacctcccgcctctgcaagggcttccctccagcaggcagctcctttccctcccgcatcatcaacttgccctctctatggtatcattagcattcgcattcagagatgctgtcatttctcccatcttaagaaaaaaagactgtttcgtgatccctttcttcctctctggctgctccgtgcggatgctccctgtgtctgtattcgcctggacatccgcctccatgtggctgagttccatcctccttgacccgccattgtttcccttgttcacttcctaagtgtcccccggccgactcatgactgtaatcaccatcttttttatgacaacctcaaatttatcttctacacccagatctctcccctgtatatccatccaactgcctacttgctatctcttttgtatgtcaaatatctcaaacctcattggtccaaaactaaactcttggtctgcccacccacccctccaaacctgctcctcctgcagttctcgccctgtcagttagtagcagctgtgtctgtccagtgactcctgccagaaatctggttgttatcctaacacactcgacatccagttcatcggcaaaactgatggctggactgtcacagcgtgtctcaagtttgatggcatcttgccacctgcactgctaccttctcactccaagccatgagtgtcttccctgcatcttcgtaatagcctcgtaactgaggtccctgcctccaccgtggcccgctacagcctgcagtacacacggctgccgggatagtgttgttgaatataagccagatcaagttcctcctctgctcagaatcctcccaaggcttctcaagcagagagagtccttccagctatctaaggaggtgtccccaccctaaaattatgcttcaccttctccgcagttcaccgcactccagtcacactcagtatttcagtctcatttgcaccttttccctttttctcctccctggatgtcactctcccactccctttcctctttcaggtctctgctcgaatgttattttctcagtaattccttctccaatcccccatcctaatagctgccttgccttcaccccccagcccactccccttgatttttctctacagctagcctggccagacactgcctacaatattggtttaccttggtgtctgtcttccccacaaggatttaagttccatgaggtcagaagtttttgttttgtccatctgctcaccactgtattccttaaacagtgcttggcaagcagttagctactcaataaatgcttgttgaataaatgaagaatattgctggatttttttcctccacattcaaggtcaacctcgtactagtcaccaccgtgcaaagttctgcagctgagctgtccctgcggctcttcctaaccctgccactcccctccctttgggaaagcttcccgttcactcggggtgaaagcagcccgtgctgtgggcagcatggtcagtagctctgggcaccactgacagccttcatggccttctgggcttgtacccttggatcttctgggaaaatttgtgcagccagttcagtagtcaaaattgggcccagacctcaagccagtggctgagtacatcgtgttctcagcctggcttgctgctgttatttaatttaatgttgaacactgggccaaagtggaattgttttctgccaagttgaaaaccagctaaatactgcattggttaatcattccatttgttttgagtttttttgtttgtttgtttgtttgtttgttttacatactagatgttataactgaaatcttaatgcaatttgactggaataccactcttttttattttcttggccattataaaaataataaccagcgttatcactaggagtcagtagactgggcatctgtgaggattatgctctatgattttagcagtctcttaatctccctgtaatatttagcttattcaccagtgcaatgaatacgatacagtagcaggcctagataatatccactgataaatggacacatgcaagtttattctcttcaaaaggaactaaatgcacactgctgtcctaacagaatacacacaagaagagaaaatgccttttaataagcaattaaaatttatacgaaaaaaaggaaaagtttataccatgagaaacctggcaagaaaataacaagaccgagggggaaatagaatgaaaacaactcttttgccaagcagtttagaaattatactgttaaattcatagatttgggtgaggaaaaataaacaaccatcagttgcaaccatgttctgtcaaaaatatcccctgtccaaggcccgctgacaggtcataaccagaaccacatgttcccaaagcaataaaagaggagagaggagcatcctatttaaggagagcctaaagatgttcatttcaggcagggatagagggacagggcacaggcaggaaagcaggaacttcctgggcaaggggtctggagtcagtgacacccacccatcaggttatccgagggctgtttgtgtttacactgatgcttctgcagagtcctaaacccaaacacccgactcaaccggatggccactcccaggcagccctcccaccttttctgagtcactgtcccatttagcgtggttgctaccgtcatcacgttgcaactgtgtcaggccaagatagaacatttcattcccttgacctgcaatgtgaaatgagttaaaagtcagtgctaagaaatgataatactgagcttccacaggctgcatagcaatgtgcatgctgcttcctaaaggggatgaaaggctgcaggtaaccacccctccttggcccaaagcagaatagtcattcatcagttcccacagagccagaccctcctctactgagtgttcacaatgtatgcattacatgtgtgctatttttatattaaaatgtcttaaggtaaataagtttttctaaacattttttcccaagtgttgcatttagtgacataacttagttacaaaacataccttaactcatctatttaggaaatatacatggagagccagctatctataactagtgagataaatggaatggctttccagtatgtcaacatttggaagaataaaaccaatttgattttattttaaaaatttgttttaattggacacaaaatcaaaatggaaaaacagacttttttcagtttcgtgaatttcaaatgttacttctttttgtatagattgcttatttaacttaaaaaaattttgtttatccacatacacattttatctttaggtttttcttagcaatttgtttaatgtgacaatttcctcccagtcagccacctggtgatatgttccaatagaatattggagtggtgtatttcagatgtaattaccataaaggataattaacattaataccttaaagatttaactgaacaactagtttgagggatattcattgaatcaaaatagcaggacttattctcgacattgtcagaaataaaattgacctgtagaggcttcttcagaagggtttttatttcataaggtgtgttttttgcatcatggctgctgctgttgcggctctcaaatgattggaatatgctttgtcatggaaacactgacgagcttccaatttgcttcttccctgaccttgactcacttcctggggtcagtctaatgactacagccatgttcagaatgcagggcctcatgtataaaatctcaccaggaataactttggaaagaaacatcatttacgtgttcccaaaggacacaaaaaaacagatggaaggtgatatctggcactccctctttctcagtgataactcattttagagtttgtcctcctggtcttgggggctcagacacagtgacaactaaggttttcgtgagtcaggtgacgtaggagtggaaaacctcatgacagagtggaaagagctggtttacaaacactccgatttaattacatttttaccaacacaaaaagaaaattctaaggaggaaaatttggacataaaattcctccattcggaatgacctgtcacctagtaagggtggtgtggctcagagcatcatcacattctgattttaaaagtacaagcccttttacaaaggagtctttttagggaattgaacattgcattcctaatatttttcatcctgaatgcacttagcagaggaaacgtatatttcatcagacatggatttgacattccattacattgtagtaaacgggacaaacatgtctcatgttttagacatgagaaaggggagctaagacagccaccaccactgtaagaccctggttatctcatttaaacagattttaaatgtgggtgccagtggtgtgatcatcagccgcttccactttgtgaataaattgcttagaaggagtcttttgcctaccagatgtgacctagatttagatttccaaaggcagggggaaaaaactctattgtgttaaaaaacaattgctggtaaaaatgcatggtaaatgagcttatctcagttttccaggtgtttggactaatatgttatggaattactgcttcgtttatgaaaaataactgaggaaaatgttccagcaaatcaaatttggataaaggcttagggatagctattgtgctgttagtaagtttttaaatggcagaaagagcaggagccaatagagataataaaataatatttttctaaaaaaaaaatgtttgagaagagtctcatagaaaagggtcaggcatgggtgtgctatccagcttgtatatggtttagtaaaatattgaagaacaatgtgaacaattacgctgctttcagtgcatatgaaagctgtttaaaaaatcaaagcttgtctgtctgctggctctgataagtcttattactctgttaaatgcagcgaaattttttaaactgtggcatctttattctctcttacctacagtctctcctttttcatttcctttcatcttcaggagctgccactccgaaaccagtcccagaacccgagaaacagacagaccatacagttaaaattgctggagtcatcgcgggcatcttgctgttcgtgattatatttcttggagttgtgttggtaatgaagaaaaggtgagctcctagctgttgccaaagatacagttatatcccattgtttgctggaatgttttgtgtgtgtgaaaattctcagttactgaactggctttgataacccagacacatctgtgactctgtgattgttaacatttttcatcatgtggcatggaaggttatgggacaaaaatttagagtaaatggctatgattctgtgtgaatacgcaaagcatatcatatcagaataaccatcctgtgtcttcccacacagtggcagataaagctctgcaaaatcttagaagccacttattcaccaggaaatgtttagtactgatttccaacatactaagacatttggtaatcacaaagatatgagaagactttactttttattatagtgaggatgatgatgatgacagattttatggggcctgtgttatatgtaggcaccgtgctagggaaggtcatcagcacaacatccatgagaaagagaacccgcaaaaacagcccgacagaaaaatgcagcgcgggagcagctcgtgttagaacaaatcacagagcaagtggtgtggctgggcaccgtggctcatgcctgtaatccccgcattttgggaggtggaggcaggtgaatcatttgatcactttatcccaggagttcgagaccagcctgggcaacatgacaaaaccctgtctctacaataaatacaaaaatttgttgggcgtggtggcacacacctgtagtctcagctactggtgaggctgagatgggaggatcactttgagctatgatcactccatggcactccagcctgggcaacagggcaaaaccctgtctccaaaaacaaacaaacaaacaaagttgtgtgttacaagagccaagggatagtctgggggagagaaaaacagatatggccataataagtgatcctcacctcccatacttgaaaactatgcagtgtcttgttttgtggaaacaagcaaaaacttgcttaataataaaatcttcgatttatgtaaaaatcaatacaaaaatatagatactaagaattgatggcataaagtttcccaaattgagggaatatgtggatcttgttcttttctctattgtttcgaaacagttgtagtcatgcattgagagtgagttcatggatgggagaaggtaaaggtggagaggttggcagagtgaagactagaaactctgatctggtcatggaaggaggttgaccttgggcctgagactgttgatggcctttgagtaggtggtaacatgatctcatttttaggaatataactctaacgttaggattggacacagtgaggaggggagagagctcaaatcaggaagaccagtagaaggaagagaaagagcaactttagaaacagttaagagttaaattttagtagccatttggagagagaagggacaatatagaaagacttagaatagttcctggtttgggcaagttagtggagatatttctgttcaccaaaatgtggaacataggaactacaaaatggggtgggggcactaaaaatggagagttcagctttgcacattttttttctttttctttattatattttaagttctgaggtacatgtgcagaatgagcagttttgttacataggtatacacgtgccatggtggtttgctttacccatcatcccatcacctatattaggtatttctcctaatgctatccctcccttaccgccctaccccctgacaggccccagggtgtgatgttcccctccctgtgtccatgcattgtcattgttcaactcccacatatgaatgagaacatgcagtgtttgcttttctgttcttgtgatagtttgctgagaatgatggtttccagcttcatccatgtccctgcagaggacatgaactcatccttttttatggctgcatagtattccatggtgcgtatgtgccacattttctttatccagtctgttttctttatcaattgatggtcatttaggttggttccaagtctttgctattgcgaatagtgccacgataaacatacctatacatgtatctttatggtagaacaatttataatcctttgggtatattcccagtaatgggattgttggatcaaatggtatttgtagttctaggtccttgaggaatcaccacaccgtcttccacaatggttgaactaatttacagttccaccaacagtgtaaaagtgttcctgtttctctgcatattctcaagcatctgttgtttcctgactttttatttctttcttttcttttttttttttttttttgagatggagttgtttgctctttttgcccaggctggcatgcaatggcatgatcccagctcgctgcaacctccgcctcccaggttcaagcaattatcctgcctcagcctcctcagtagctggaattacagatgcatgccaccacgctaatttttgtatttttagtagagacagggtttctccatgttggtcaagctggtctcaaactcccaatcttgtgatccgcctgcttggcctcccaaagtgctgggattacaggcgtgagccaccgtgcccagccttcctgacttttaatgatcgctattctaactggcataatatggtatctcattgtggttttcatttgcatttctctaacgaccggtgatgataagcatttttttatatgttggttggctgcataaatgtcttcttttgagaagtgtctgttcatatcctttgcccactttttaatgggattgttttttttttcttgtaaatttgtttaagttctttgtaggttctggatattagccctttgtcagatggatagattgcaaaaattttctcccattcttaggctgtctgttcactctgatgatagtttcttttgctgtgcagaagctctttagtttaattagatctcatttgtcaattttggcatttgttgccattgcttttggtgttttagacatgaaatctttgtccatgcctgtgctctgaatggtattgcctaggttttcttctaggatttttgtggttttaggtcttatgtttaagtctttaatccatcttgagttgatttttgtatcaggtgtaaggaaggggtccagtttcagttttctgcatatggctagctatttccaacaccatttattaaatagggaatcttttccccattgcttgtttttgtcaggtttggcaaagatcagatggttctagatgtgtggtgttatttctgaggcctatgttctgttccattggcctatatatccgttttgataccagtaccatgctgttttggttactgtagccttgtagtatagtttgaagtcaggtagcatgatgcctccagttttgttctttttacttagattgtcttggctatgtgggctcttttttggttccatatgaagttaaagtagttttttccaattctatgaagaacgtcaatggtagcttgatggagatagcattgaatttataaattactttgggcagtctggccattttcacaatcttaattcttcctatccatgagcatagaatgtttttccagttgtttgtgtcctctcttatttccttgagcagtggtttgtagttatccttgaagaggtccttcacatcccttgtaaattgtattcctagatattttattctctctatagcaattgcgaatgggagttcactcatgatttggctctctgtttgtctgttattggtgtataggaatgcttgttatttttgcgttgattttgtatcctgagactttgctgaagttacttatcagcttaaggaggttaggggctgagacgatggggttttctaaatgcacaatcatgtcttctgcaaagagataatttgacttcctctcttcctgtttgaataccctttatttctttctcttgcctgattgctctggccagaacttccaatactatgttaaataggagtgagtgagagaggacatccttgtcttgtgccagtttttaaagggagtgcttccaacttttgcccattcactatgatattggctgtgggtttgtcataaatagctcttattatttcgggttgtgttccaccgatacctagcttattcagtttttagcatggagggctgttgaattttgtcaaagaccttttctgcatctattgagataatcatgtggtttttgtcattggttctgtttatgtgatgggttacgtttattgatttgtgtatgttgaaccagccttgcatcccagggatgaaactgacttcattgtggtggataagctttttaatgtgttgctggattcagtttgccagtattttattgaggattttcgcatcgaagttcatcagggatattggcctgaaattttctttttttgttgttgttgtctctgccaggttttggtatcaggatgatgttggcctcataaaatgagttagggaggattctctctttttctgttgtttggaatagtttgagaaggcatggtaccagctcctctttgtacctctggtaaaattcagctgtgaatccatctggtcctggaccttttctcgttggtaggctattaattactgcctcaatttcagaacttgttatcagtctgttcagggatttgacttcttcctggtttagacttgggagggtgtatgtgtccaggaatttattcatttcttctagattttctagtttatttgcatagaggtgtttatagtattctctgatggtaatttgtatttctgtgggatcagtggtgatatcccctatatctttttttattacacatctatttgatcttctttcttttcttcgttattagtctggctcgtggtctagctattttgttgatcttttcagaaaaccagttcctggatttattgatttttttgaagggtttttcgtgtctgtatgtccttcagttctgctctgatcttagttatctcttgtcttctgctagcttttgaatttgtttgttgttgcttctctagttcttttcattttgattttagggtatcaactttcgatctttcctgctttctcttgtgggcctttagtgctataaattttccactacacattgctttaaatgtgtcccagagattctggtacgttgtgtcttcattctcattggtttcaaagaacatctttatttctgccttcatttcattatttacccagtagtcattcaggagcaggttgttcagtttccctgtagttgtgctgatttgattgagtttcttaatcctgagttctagtatgattgcactgtggtctgagagactgtttgttatgatttcctttcttttgaatttgctgaggagagttttacttcaaattttgtggtcaattttaaaataagtgtgatgaggtgaaaagaagaatgcatattctgttgatttggggtggagagttccgtggatgtctcttaggtccactttttccagagctgagttcaagtcctgaatatccttgttaattttctgtctaattgatctgtctaatattgacagtggggtgttaaagtctcccacaattattatgtgggaatctaagtctctttgtaagtctctaagaacttgctttatgaatctgggtgctcctgtgttgggggcatatatatttagcatagttagctcttcttgttgcattgatccctttaccattatgtaatgcccttctttgtctcttttgatctttgttggtttaaagtctgttttatcagagactaggattgtaactcctgatttttttcgctttccatttgcttggtaaatattctccatccatttattttgagccgtgtgcatctttgcacatgagatgggtctcctgaatacagcacactgatgggtcttgactctatccaatttgccagtctgtgtcttttaattggagcatttagcccatttacatgtaaggttaatattgttatatgtgaatttgatcctgtcattatgatgatagctggttattttgcccgttagttcatataatttcttcatagtgttgatggtctttacaatttggtatgtttttgcagtggctggtaccggttgttccttttcatgtttagtgcttccttcaggagctcttgtaaggcaggcctggtggtgacaaaatctctcagcatttgcttgtctgtaatggattttatttctccttcactatgaagcttagtttggcgggatgtgaaattccgggttgaaaattcttttctttaagaatgttgaatattgggccccactctcttctgacttgtagggtttctgcagagatatttactgttagtctgaggggcttcccttgtgagtaatctgacctttctctctggctgcccttaacattttttccttcatttcaaccttggtgagtctgacgattatgtcttggggttgctgttctcaagcagtatctttgtggtgttctctgtatttcctgaaattgaatgttagcctgtcttgctagattggggaagttctcctggataatatcctcaagagtgttttccaacttggttccattctcctcgtcactttcaggtacaccaatcagacatagatttggtcttttcacatagtcccatatttcttggaggctttgttagttcctttttattctttttttctctaatcttgtcttctcactttatttcattaagttgatcttcagtctctgacatccttttttctgcttgattgattcggctattgatacttgtgtatgcttcacaaagttctcgtgctgtgcttttcagctctatgaggtcatttatgttcttctctaaactgattattctagttagcaatttgtctaaccttttctcaaggttcttagcttccttgcattgggttagaacatgctcctttagcttggaggagtttgttattaccgaccttgtgaagcctacttctgtcacttcgtcaactcattctccaatcaattttgttcccttgctggcgaggaattatgatcctttggaggagaagagacattctggttttggaattttcaggctttttgcgctggtttctccccatctttatggatttatctacctttggtctttgatgttggtgaccttcagatggggtctttgagtggatgtgctattcctttctgtttgttagttttccttctaacagtctggcccctctgctgcaggtctgctgtagttttctggaggtccgctccagaccttgtttgcctgggtatcaccagcggagacagcagaccagcaaagattgctgcctgttccttcctctggaagcttcataccagaggggcaaccacgagatgccgctcagagctctcctgtatgaggtgtctgtcggcccctactgggaggtgtctcctagtcaggatacacgggggtcagggacccacttgaggaggcactctgtcccttatcagagcttcaacactgtgctggtagatctgctgttctcttcagagctgccaggtagggacatttaagtctgctgaagctgcgcccacagctgccctttcccccaggtgcttcgtcccagggaggtggggattttatctacaagtctctgactggggctgctgcctttttttcagagatgccctgctcaggaaggagaaatctggcagtctgaccacagtggccttgctgagctgcagtggactccacccagttcgaacttcttggtggctttgtttatactatgaggggaaaaccgcctactcaagcctcagcaatggcaggcaccccaccgcccccccccgccccccaccaagctggggcatctcaggtcaatctcagactactgctgtgctggctgcaagaatttcaagccaatggatctaagtttgctgggctccatgagggtgggacccactgaggcagaccacttggttccctggtttcagcacccctttccagaggagtgaatgattctgtctcacttgcgttccaggagccactggggtatggaaaaaaaaaaaaaaaaaaaactcctggagctagttcggtgtctgcccaaacagccatcttgttttgtgcttgaaacccggggccctggtggggttaggcgccagaggggatcccctggtctgtgggttgtgaagaccatgggaaaagcgcagtatctgagctggagtgcagggttcctcaggctcagtccctcacggcttcccttgggtagggaaagaaattccccgaccccttgcacttcccgggtgagatgacaccccaccctgcttcggctcgccctccatgggctgcacccactgtccaaccagtcccaatttgatgaaccatatacctcagttggaaatgcagaaatcacccaccttctgtgttgatctcgctgggagctgcagaccggagctgttcctattcagccatcttgccagcaatcccagctttgcacattttaagttcaatactcctttaaaattaagtggagatgttcactgggaggttgaatatgctactgtggactagaaataataatttccatagtctgaaagtcatcaacatttctggagctgaagccataggtttggaagaggctcctcagagtttttgtagagtgagaagaaggaatatcaaggatgaaggtaaaaccgttggcaacagcaatatttcagggcgagttaatattccagtatagatacatgcatctactccttttctgagtctccctccatttatggttctgttctagtcaagccccaggacaaaccgttgctctgtcacagctgtgcgcatccctggtctttggtccccaccattacaactgtttttccccacttgtcatgtgccgtttatctctttttctacccatcgtgtgattcctatctttatttttcattcattatttattttcattccattcctctctacccctcttttctttacccttctttacctatttctctctttatttcctttttcctccatatttcccatatttccttttttctttctctttttcttatgcctcacctcttttttttttttttttttttttttgagatagggtctcgttctgttaccaggctgaagtgcaatggcacgatctgagctcactgcaacctccgcctcctgggttcaagcagttcttctgcctcagcctcccaagtagctgggaatataggctcacaccaccaagcccagctaatttttgtatttttagtagagacagggtttcaccatgttagccaggatggtcttgatctcctgacctcgtgatccccctgcctcagcctcccaaagtgctaggattacaggcatgagccactgcgcctggcctttcctggatgttcttcgtccattccccacctcaatgtgtatgtagatagcttatttttggcaccagtagtttgtactttttaaaaacatatgacccagtgtaagtcctaaggaacaataggcccttccatgcctggacatccaaactaaacattttgaagaggtttatttttaattccgggaatatggtggatatattttgtcatctggcaagttctctgtgaggaatagcctgcaactactaatccagttgcccttgtgaccctagctaaatgtcaactaatcctccaagggtctatttctgcaatattaattcatgattctacctgggtctctctggtagtcgttgaggttatgttataaattatgcattgaagagatgcctttggtaacacgtggccttaatgcaactttagactaaatgccaacaagtcatgtcagatttacatgattatttactagataataatcttaaaagggttgtcttcacagcatgtgccactttgggatttgctttttctgaaaaatagagtatattctctgtcagatgaattagccagtataccatgctcagaaatacaaaacttgctattatctttagacttgagcagtcttgtacaaactatcatattccatagaaattcttaaaacgtctaattgtccaggactttttaccaaatttcaagtctaaatttgaaaggtagtgtttttaagcagaaaagttaaagcataacattaatcatagaaaaattgttggggtgttattgataggtaatcaccacattgtttggttagaagaacactgaacttagatgtggaattcctagatctgtattttaactgactttgtgattctgaacttctctggccctagtttcctcttttgtaagttgagaaaactcaactagatgatctctgaagaccttctcaattccaaaatgtcaggtttcctggtaggtagtagccactggtgacactactacgcatttgctattctagaagtaccgcatgtgttttgttactgtgtttccctacttaaacctctgcagcagctcttccccaggctctctcagttcagttcaagcccagaggtgatggctgatgagtggtttatcttccagctacatgttttcgaccttcacacaggaggccctcaattaaaagggaagccgtagggaaatggaaaaaggaatgagagagagggaaggaaaggaactgcctcgggtgtggatttcaatatattattagttgttactgtcagttagaagcaaatgctgtgaaactttgcactcattcctgtgtggactggttagcctatgtttcctctaccgcagcattctgagtcgtccacctcaaatatgtgctgttggtcataaagacagactgggcccaagagacagtgtgggtgaaacaaattcattcattccttctagaaataaaatgggaagtctgtcctacagaggatgagccagccgccatcgtctgtacttgtcacatgccaggccagctcgcctgctagcttgggagcaggaggacagcaaattcaaacactggaaaattgcttgacattttattgggaggcattgtcaattattagctaagattgttttgtcttctgaagaattggccctctataaaaaaatagttgtggaaggtgggcttttaacagaaaatgtaaagtctgttcagttcatactaattagtacatggaattatttaacatataggcaataatggctaaaaactgacatgaccatcagctttattttaggatgttttacaaacctatcacaaagcaacaactaattttttgttcatgtatattaattcatttggcctttacctggactaatatcatctgaaaccttcttttctttgaaacattttatgaaatgtatacacttatttttactttattatgtaagcaaagcaattttttattttccgtcccacaaattatgtgttcctttaaagatttgacattttgatgcagcaaatgttaagaaaaggtgtgagataaatgtctacaaaataaatgttttatacagaaccacggggcaatgtactctcaaaattaatataaaataacttgaataggacatattttttttaccaggtttcatccatgtataattagatatatttgtataaatgaaaatacctgtatttttaacatttttcataaggaataatgtatctcaataacatgtttgacagaacttagtatgtaagcactatcaattttaccatgattaattatatttacgattgtttctaaaatagctatagatctttcaggaatttgagaacatttgtattaattatagtaatattcctgtctcagccactgtggtacatagaaatcacagaagttgcagctattgaaaataattaaagagttaggcattctggggcaaaatagcaagtggtagctattatattacataaatacctgttataggtaaatataactattttaattctgaaacactatacctccatctcctttccataacacatttaaacagatgtacattttgcaaatgcagcatattatcaaatatttggcacccattctattatatttaaacaatgctagcactaccaagaaaaatcacaataaaaatgggaagtttttctgaagacaacatgaaacaaaaaagataagagggaaaatttgatgaaagccccattttcaaagagatgcctgcagcatgcagccggaggcaagttgacattaactatagttcccccggcctatccatttacatgtgaggtagtttctttccactgtaagtaagtgtgacttctgtgtggaaaatagcttaggtctggatgcattattcaaagttttatttcaaaatcacctttcctgagactacactgagaaagtcacacatagatgtttctttgtgacaattatttaaaatatgtggctttaatatgcagtcctataagtatgaaccagatgctgagatcttgcctagcacatactttggcatgcttggaacaggccatatgtgcacacaaacatgtatggatgttttatctcagtctatcaattagctgccgtccttcaggtttccagataattgaatagggttgaggtacaagggtaagttgaacaaattgacttttgtaaaggcctcttctgagctggactttatatgattactgtaacagttcctaaagtaacccctatttcttgactcaacctaatgggaactctttttaaagaagattttattttaaaaaaagagtgtggggaacatagctaccaatttttcatcttataggaggaaagtgtcagagaatgataagagtcatggctttagaatctgacgaacctgattttacaccacaactctttactttgtggcactgtaaatttaaatgagttacttaacacctctgaactattttgcacatgtgagatgtgacgatgatgataatgtgtactgcataggggatgcggtaaaaattagatggtatatgtacatagttggtctttgatagataatagcttaagaacccagcagttggagaacttgtcccagggcacgtaggtagtccgtgggagggcctagtctaagtcagtgcatctgacttttaactgccctgctaccctggctcaggcaagtaaaactcaaacatgcaccttgctctgtaaagctcaggtactctttataattagctgacaacaccgtgcagtcatcagcttgttgcagtttaccattgctttaagtctataaatatttgaaattctgccagcatgtcttattcttttctttgagccatcattgcagaatagctaaataaatgcttttttcgtatcctcctttgcagaagcatttttagaattcttttgaatagctgtattttgtgtcatttgttgattcctgagtttacttctgataactctcaatggtgaggatgctgtatcctcttgtctggtttactgaacaagagaatcttgttaagttttagaggaagccataaagcaggggagcattagctgcacctttcctcctcagagacaaatgctggggtcttccgtggtgaaagtggagaccctggggacagctgccttatgcccacaccttggttccgtggcttactggctgtgtgatcttagacaagccacctagctcggtgtccctcagtttccccagctattccaagggcataataatagttcttacatcataaaatgttatgacaagaaaacaagttgatacctttaaagtgctggccccagtaaatattaactctattgataatatgcattatacaccagtatacaagctgtagctgcctctctggtttcaatgctcatggcttgcgtgcctcgaagtctttgtgtccggacatgggagaagaccaaggaacggagctgtctccccttgagagggggtcctctctccttttcccatggagagcatcatttctttgtacccaaagaaacacacgggatgggtctttaattatgaagctagctaggaacacagctagctggaatgagacagctcattttctccttaccttaaggccatgccttggtgaaggtgccagagctgatagcacaaagtaaaatcattcttcagccatgctcagccactagtattccttatgcccaggctcctactcagtcaagtggagagccggattataggaaaaattgttctctgcagataagtaaaccaaaggtcctggggcatcaatactaccatgcttggggaacgtcctctaaaccccaaatgcttctgagtgggcatggcattggcattaaatgcaaatactttgggtattaaaaccttccagacccagacgcagcaaggtgccaagtggtctgccacctggggtgggaacagaaggacagcatcactgtcttcggtgtgcataaaggccttgtcatgtatctgtgtggactccctgagcctctcctcagtgctgcttgttcaccttccacagttgcaggaggtcgaaggccctgtggccaggcaccagccctgaacttgcaccacattcagcagggctgaattctcaccagccatctcagggcacaattttcctactgattcctcatttgaatgcctggtaactccactcatttttaacctctatctattagcatagcttattaaaactggttctatctgtgtctcttaattcctaaactcaagccctagacttcttaaaagggtattgagagagggctgcataattactactaaaattgatcattcttcacagttgatgtctcaagatggagtgtgttgacattcccagtcccacccaagtgcttcatgatctttactgggtgtgtgttttgattcatgttgatgtgacttcactttctagttcataagagcgttaaaaactgagcatatttttcttgggatgatcgtttaaacttgtatcttggttatcgaatccaggaattcaaacctaataataccacttttccaactctttccagttttgttttatattaataagtaaaacaatgaagagtatgaggaaagaaatatatgcattaagaaaaaaatagtccaatttctaacctgacttatttgggcaatgtattagtccatttttgtgttactataaacgaatacctgagagtgggtaatttataaagaaaagaggtttaactggcttatggttctgcaggctttacaagcatggtgccagcatctgttcagcttctggtgaggcctcaggaagcttccaatcatggaggaaggcaaagcacaagcaggcgtgtcccatggcaagagcaggagcacgagagcgagcgggagggtgtctcagactttgaaacaaccaaatttcatgtgaactgagtaggaactcactcaccaccaaagggatggtgttaaaccattcaaaagggatccatccctaccattcagacacctcccacccagcccacctccactgttggaaatcacattgcaacatgagatgtgggggacaaagatcctgcaaaccatgtcaagcaagattcatgacacctcttcttctaacataaatctaaatttctttttaacagggaaatggtttacctctggaatctttaatttagattcatttatagaaaattacataaaattaatttttaagaaggatacagaggcgccactgtgttgattgagaaaggaatattttggatggatctcagcattataagatgtagtattatattaagtactatattttcttgaatagtaatataaattttgcctggtatccttacagagtgtgctttttaaagtaaataaagcttcactggatcccctggaagatgttcttatcattgttatattcatatgtgccgtttgcttatggcactgctgtggtggaactaaagtgaaactgtttttatgagttttactgcaagtaaaaatggattcatttattaaatcccaacatactatttctttgtaaaaacaaaacaaaatttgacaaaactgtagtccatgttatcgtgtctaaagatggcccagtgttcattccggtgtttattatgtttctgtgatgacttaggcagcacctgcctgagtaccagaattccaatttggacacctgggatttagtgctttgcttactgtgtccctcccgacagtgccgacagtacgctctcctgcattcacagtcctgaatgatctgggtaccatatgtcttttctattagatcctttttaatcatcttcaacatcctattcttacatctagtctagtgttttccatagaagacatggagtataccgtcagtaaagaaaaatactcttctttcatgcaagccctttagtgcagcactggactttgaacagctttgctttttaaaaaaaaaatttcagggatgtaagtttcataatattataagatgttttaatttttctgtagtgtagatattataatggacagactccctacgtgtagtagtatgaatttgttaaagtttgaataataattatttgaattaaaaatttaatatattaaaatagttgaaatgaataggagtacctttaaattcagatacagcttaattcaaaagaaaaatgggctcatcactatcatttatttaaacgatcatttatttttaagccacctttgaaatattttttataaatcgtgtattccattgcatttttataaccaacatcaattgagattaacaagtcctttgttcaaaaaaacgaataaacctccttaagatgaaatttttttaagggaagtcagggagaactttattctttttatgtattttctatttatttatttattggagatagggacttgctctgttaaccaggctggagcacagtgacacaagctcgctgcagcctcaaactcctgggctcaagtgatcccccgtctcaacctcccaagtagctaggactgcagacatgcgccaccacgcccagaaaattttggggttttgttgttgttgttgttgtagagacagggtgttgccatgctgcccaggctgatcttgaactcagggcctcaagtgatcctcctgcgtaagcctcccaaagttctgggattacaggcactgaaccactatgcctagccaggatgaattcttcttatactgtgggcatcttaagttaaaatatctagtttttcaagtcttctattcagtggttttataacagaaatatctagacttccgtcttcagtggctaggctgcagcctagtaatttattcaggacttagcatttccaggcagctcttctcgctgttagctgtctcactgcatcattgtatggtattattcctccaagggtgtttgataagcatctgtgataaacattgattcattgttcccattgccagaaagaaagcattaattaataagaacaaattcaggaaaaggccgcttagtgtaagtgcctagttattgggagctatcaaaatgttctttgttctttatccttttacctgatttctataaaagcctgagttgtgggtttggagtcagtggtcagaatttgaagaaattggccactctctaaagatatgttcagctatcaatgactaattcttaggtttaacttttattaaaaaggaaaggaagaaaatctcagaaatatattaagatcttcaaaatgaagaggtgacatagcattcactgaaaatattaacttggaagctgtcatgcaggagtggtgttggctccttgggggacacttggggatgcctgagggtgtctttgctgagaattaccttattgtaattgcatctgttggttgcagttttgtagtcacaattgtcaagatttttctttaataatttgtcaggctaaggttgactctgagttcagatcctaaaggtcatagaagggttaaaatcataactgcctaggggggccagtagagttgacctgtgtatggatgagctcctggtgcagagagtgtggtgagaaggcacccactgtccagcttcaggcaagtatattacagtgtcacaaatcttcccatctcccctgagggaagggagaaatcttgatttctttactaagtgttctaactttttggttggcaatgaatcactttttaaagtatgtgttggccaaataaaatagatatccagtcacccgcatgtgattcttaattgtatttttaagataaaccaagcaggagacatttaaaaatcttctgtcacttacatgtctctggctacacatgttgtcttataccaaccaggaaaggacaacggatcatttcctggtcgtgctacccctttacccacgtgctcattcataccctgtgatgcatgcaaatggcaccactggcctgcatcctacttcgtgataactggttcttgctcagaaatccaagagaacttaggcatcagttatcttgtaggtgatatggccagatggtttggaataagtgtgcctcccatttctaattagagctcatccctgtgttctgcactgggattgctgttgactcctgttatttcttgctaatccaagctggaattcctctggactcttgttgagcctcagatagcaatatctgttagaatactttttctcataagactacagttaaattttgtggggtttttttcttttttttttttttcctacggagtttcactcttgttgcccaagctggagtgcaatggcgccatctcggctcactacaacctctgcctcctgggttcaagcaattctcctgcctcagcctcctgagtatctaggattacaggcacatgccaccacgcccagctaattttttacatttttagtacaaacagggtttcaccatgttagccaggctggccttgaactcctgacctcaggtgatccgcccaccttggcttcccaaagtgctgggattatgggcatgagctaccgcgcctggcctaaattaaattttgtaaattctgtttacatgaatggtctttctggactttgaaaacaactccgccagtgtaggaaagaggaatgggtggccctggctgtgcccacttctgcagatggttcccaggagggaagccagcccaccccagcatggctcctcaccctgagcactgagtgctggggaccacccgctacctcctcaacacaggtgaccaaggccggagacccagagatcatctaagaacaaggctgttgctaacacgtggctgatgatttctttatgtacccttttatgccgggtttgaggagtaagatttatctgagaataagtacatagcatatttccctatgtatccattcctctctccaccccatacacacatctttacgtgtgtttcaggaggtggggagggaataaaaatttaaacagtctccagggccctgaagtttctaaactgctaagtgtccaatccacagcctggcgagctgatgtggtcttggcatcaggctgcagttgtaaaaatgctctgctgcttctccaaacaaacactggagccctcagggcacatctaacagagccagccgtcagccacacacctgccctcagccagctctagcgccttcctgcaaccagtgtccacacgccccacgacagctagctcccaaggactgagccaatccactttcactccttggcaggcaattgctcaagtgcctgagctgaacaggcttagcttcaggatcagtttaattttctgctgtcctaattgctgtgctggtgcctggacttaaacaacctattcatttgaatctccaaacaacttcctattcatttgaatctccaaacaacttctaactcatgttccaaaacttcctaacttctaaagttgtgattttttttttaacctggaactttcaggatgctagcctgattttctaaattttgcctgactctagattaagtctagcttgtcgaatgttcttcaagaaacacactcaccattcctcagcttgccagtggtgaggtccagtctctttcaccgtataattagcgggaagtgtcccctgccctccttagccaatacccaggctgttagccatgtctctcaagggaagtctgccaagcacagaggacaatattttaccaaaggaacacagcataaataaatgttcttatcctgtgtacctttttcacttttatgatcaacactgatataaagaacaacaatagcattaaaattaactgaagttatgagtacctaagtagaatgataattcattatgtgaagagggtggttgattaatgagcaccattaacaagttcatagtttcagtggtcaaaattacagatctgattatgtgcagtgtaacatgctccattgattttcaagtactttttcctaacaccaacaattatttaaataccatgtgttctatgacttacacaattttgagttctcaaaaacatctttaattactatcctgaccactgtgttagctttagcactttttagttaaatcgaggacactagcaatcatttctctttcagatgttatactgctaattttagtgataatacgtgaagaacttgcaaccattaaaccagagctgtgtgcaagtaacaatctagttaagccagggtaaatgaaatagccattatgaaagatccataagttaagagagcaactaagaagaatagaagaaaagaaatcgagttttagattctaaaatgttgtttagtatcataagttgacctcactggatgagactgtgttagccaagaagtctcttgcttagttaattttgtgatttggcaaatacagtctgtaaaacatttttctttaacagcatgcagtccctttttaagtgtgcattcagtgaaaaaggttctatgctgggacccaaaaatgcagccctaccgccattatttacaaaaatatatttctaggtatatgtccaaaagaaatgaaaacagggactcaaacaaatatttgtatacctctgttcatgcagtattattcatgatagctgaaagttagaagcaaccaagtgtcctttgacagaagagtggataaacaaaaatgtggtctatccatacaacggagtactattcagtcttaaaaaggaaggaaatcctgacacatgctacaacatggatcagccttgaggacatcatgctacatgaaataagccagtcacaggaagacaaatactgtatcattccacttatataagtacctagagtagtcaaattcatagagacagaaagtagtatggtagctgccaggggcttggggaagaaggcaatgaggaattgatgtttaatggctagagagtttcagtttgagatgaaaaattagcgagacagacagtggtgatagttgcacaactatgtgcatgactcaatgccactgaattatacacttaaaaatagttaaaatggtaaattttaagttatatattttattacaataaatatcttctaaggccaggcgcagtggcacatgcctaatcccagcactttgggaggccaaggtgggcggatcactaggtcaaaagaccgaaaccatcctggccatcctggttgagtggaaaccccgtctccactaaaaatacaaaaattagctgagtacggtggcacacacctgtaatcccagctactcgggaggctgaggcaggagaattgcttgaacccaggaggcagaggttgcagtaagcggagatcacgccactgcactcctgcgtggtgacagagcaagactccatctcaaaaaaaaaaaaaaaagaaagaaagaaagaaatgttctaatactggtagagtgatttagacaggttttgaattcttggcaccgctcatcattctaatcaatggtcagcctctgagcattggagcactcagtggtacttgtacacttggcttgtcatcaagtgtttcccttttagactgttaggccaaggatggctaagaaagttactgtccagccgatagcaagagaatatttatgttgttggtacatgtctaccagagaccacagaaatgcacaaagctacatttgaagcatgtcaccggcagtattccagcattattactgacagtggtgacagtgagaaaaccaaactgccttgaaaaaacacctcctgaattgttaccacaataccccagagttaggcagcgtgtaccgccaaaacactggtgatgcccagattcttgcagtctcaagtgaagaaagcaatatgttctgctgcattatttttaggcaccagagagtgaaatatgggtagtgtcaggccagtcgcttccatggctatcaatttttgatcttctttactagtaacagtgagggtggcacaaattatccatggacagaataggaatgtgcccagcattctggaagcttatagtgcttcaaatcaaatccacacagctccccacgtgcagaattgtgcagttccccccttatgggcttgattttttttaaatgtaagaaaagatattcagcatttgctacctaacacttagggctcgggtccctctcagttgaatgaagctctaattatgcatcttgacttattctgtagtttctaagtagcctttccattcagggtattcttgtggctgtctgtgaactagaaactcacagagggcaggagccatggcttgatcatgtttgtctctcccattcctaaagcagactaagcacatgataaatgtttattgatccactgcagaaatgagtgaataaacgcagatcctatctatgggagtgccttggtgccttgcctactgtgtggtttctcctcccagctctgagaagtggcttggcggactccaacctatgcgctttacgtcattactgaggcaaggaacaagtcatactcttgcttcccacttctccctgcaacccgctttccctgggctgcagcctcttttctgtaattgaagtcaccttgaagaagaccatgcccagagcatagaattttgcctctctccccatgtgaggaccatatatgtttatatttattatgtgtgacatctgtaaggaacctattacagagcccttccttccttcaaacaagtttattaaccagcagagataataatgaccaaatgaaaaataaaagccagatttaccttgcataatctaaattaataataacacatccatgaacaaatgtcttgccacttgtattatttattacttatttggtgatgatgatgacagctaatatatattaagtgttaagcatctgcctcttactaagccctgctgtaagctttttacgagtattatcactgtttcgctttgtaatgactctgtagcacatattctgttgtcctgttttacactcaaggaaaccaagactgagcaaactaagttgcttaaagttgcatggtcagtaagcaactgaaccaaggggtaaagccaggctgctggtctccagagcttccactctgagccattatgatactttggttgaaataaaatagacctaggcaaagatagacacaagatctacctgttgagctggaaagaaagcagctgaaaattctgtgacttgaattattatgatactcatatctctcccttcacccagttaataaaagaagcaccctgcaaagccaagtgtgcaggctctaagctactcttggacacaggctctgctcacttaaggtcaggaagcagagaggagacctgggtgcctctggctcctttggaagctcctttagcatatgaagcatctaagtaggcttgaaatatgccacaaatgaatggtcatcttcacgcaccaatagttttcaagcctccatggtatgtgtgcatgttgtaaaatccacattggtgcagcagcctgtcttacccacatgcggtgactctttccctcctcctatctggtaccacatggcattaggccagagactcccacaaacaaagcctgttgttgctttgtgtacacttcattgtcacaggggaccaggctccacacttctcagcatcactcttagtggtttggctcaccttggtgactcaggagtcacagttaacatcatttccaacccacagcaaagactgggacttgaaatttcttctgtgttcttattacttcttccattgtcacttgttagattctgagagaagcaaataaggctgcccgtctgtggatggagcaggctccagcgcccttttcattgtagttgtacctctgaggactaatgaggagtcacttgcttgtgttcttggaagcatctgtggtccaaaggcaggaattctcaactctggactgaaaagatgccatgcagcaggaggaattgcactttagcaagtgaaatattgtgggcttgtgaacccttccttcagaaacagacacggttagtatgtggctctgatatgggagcagttggtgaagatgaatgtgatacagcagttcctgttctttgcccctgatgatgcagtgtggcacctgatgctgagataagtattatcttccagcgatgtcgcgaagtggcatgttaagcctttatggtgatttgttgcaccttgccattttggctggcattagagctctaaactcattttcttcccagctttctgcccttgcttgtgtattcccagtggtatttctcattagcattatcttctgttaagcaggaaatggtctctgcttctcaaccctggacaatgctgagtatgtttctagcgctcagttaaaaatatttactggcattagtatgccttttttcatgtatttcaatattattttactttacgacagtattagtattagtctgaaaagtagttcctgaaagttgttaagtatttttacataaatttgacaaggacgtattttcatttttaatcacagctaatcttagttttataccaaaccatttggttttcacattaaaccttgcagctccagaccactttatagccaaaccaagtaataggaaactggcagggccttataacatcgtttgtaattgttacaaaatatgctttgaaatatcatcataaatatgtaaaattaaagttagcaaaaataagtgtatagactacatttggagcctgtgatacccctgattttaatttttttctctctctcactagcaaatttgctaaatttgttaatttgtagactgtttcttcttaatttgtgagaaaaataagttagttccatattcacttttcttaaaataactgttttctaaagttctgtttataagtggaatcaacactaaattatttgtgttactagaggagaaaagagatccaactaaaacaatagataatcacaaattgtttagatactaaaaaagtgctgaattttgtggaacaaagctgatttatggaccatctactcctttcttactataaattgtatggagcaggatttaaccatctcaaacctacatagtgacaagtatctttgcaatggaatgcccctcactgggccttatcatggtgtgttcacacctttacttatagcacagactccatgccatggtagatagtttatgaagacgagtttttgctcacccataatccagattcactataatattatgcatgtaagttctgcctagactcaatggaagaagttaaattaaatatattgccttcctgtttgactttggaattaaatttctctataaatatcttatcacgctcctaggagatagtttccttagataaagaaatcttgtgagtgaaaggaaggaaaatgaaggtggaaaaggataaatgtcatcgatatagcacaatgagaaacaccacacctagcaagaagagacccgagtcctattttctccaaccattgtatattcattttctttctcttccgctcgaaaagtgaatttaaaaggtcctatagcagtatatcacagacacatgttaacaaatggctgcccaaaaagttacatcttcaaaaataccatgttgatttgggcaaaaaaaaaaaaaatgcttatcaaattagtaagacaaaaccttttgctttttgtggcagcagttgtgggggtgaaggaaaataaaaataataagtctaaaagtaataggtctacttcccctgttgccgagtacactctctgaacacttcataaagtgtacctccatgtagccttttcagatagcagtgatttagacatagaaacaacattatcagtaacaaggaagaaaaaaaccttaattgtctaattgatggctattatgagattccgtataattcatggaattggtaagaatttcacccaaggcaagaatttagcatggtgtatgcgtgtacttttatttagtcttcaggaatcacatggattgattgctgatgagactattttttaactaccaagcatatatattcatatatgctcaatggatacaaattttccaagatgttatttttttcttaatgttgggtccattttttcttctgtaagtactcatttctgaaacaacagtgtaagtaatttggaaacatgatttagtatgcaagtattcactttacactcctgtcttttggaatgcatttgatgcacatatttgttcaaactaaataaggcaaagaatttaaagagctagaaagagtcttggagttcatctcttgctaacctctcattttatagatgaaaaaacagaaacccagataggttcgatgcttctgttgggtgaggggaaaacccacagctgtgaatcctaatttacagtttctgcacacatttctttaatgtgacttttttgatgactgcttaacagagtgatgtcagctatgctaaagtcctgacatgtcagtgacaatacaaggaccacacgatgaatttgaggatatctgtatttttctggtacagctaggtgggctcttttaagacagaagtcttaatctgtgagagcctcccgaaatctagagaaagttctcagccaagaaaaggtcccggtgtgattgatggctgtgctggccgcacagttatagtcagttacagtccttgctccttcaaactatcaagcagtaaatttgtaaatgagctgagcgtttgttgttattaaagcttcattttaccattctctctgtgcaacaagcacttaacattgtacttgctcaagggttaaaaaaaaaaaaaaaagcatccctaaattatatataggtagtcttgggcctataggtaatctctttggggcttttaaaagaaatatacaaagattttcctacctttctgtgtattcttacaaataaatgttaagactcatggcctggggaaggaggagaaactcattaagggagcaaattgcagggagattcctgaagaatcagtctctgagccagtccaggcactttaattttgtctggccctggcattattattgtaactgagtagaaggccatgagatcatagcctctccatagctcccgatagccatcaaaggtgactggcttctattacttttgaagtgacaaccacatttgaagatggtatagactgaccactgattgtcaaaactagtccaaaataaaaccattcatccatacttacttctgccacataacttgcagatgccctgcagcaaaaataaattagctctaaattttctgttgagcacagtcttccgatggggcctctgtgtgaatgttcttcagtcattttgctgagggctaagagatgagggtaagacccttgggctataggagtagctaaaaactgaaatattcccaaggaaagattctacattagattcatggataattaaggcaaaacacaaatctcattcattctggacctaaataaccttttcctgctagagaactttttttaaaaagttgcagtgtttactgtctgaggaaggcttataaaggttatgcttcttgcatccagaatgtgcagaaattctacagctataaatgtctcagcagcaaatgggctgtgtggcatgctacagccacagcctgctaggtaatttacgttgctcagggactgtagtttttcaatagattgaactgttagttttcaggaggatttaatgaaatattgaaccagatgccactggtctgccatagatgtgggactatgagaaatgaggaaatgtcactctgtaaacagcttggacctctgtgagtaggggaaaaaattgtgtccttagtgaaagagaatcacaaccaagagaaaacatggcagtttgggggtaaatgtgtttgtttctatgtccatgtcctgtgttcatttaaaatgggaggctgggtctaggacggagatccagaaaaattgtctgaatctggagaaagctaaatagaggctgagatttttccgagtctttcttgttgtccagtggtaatcctctgaatggccctatacagatgctcctggacttttgataggattatggtccagtcaacccatcataagtaagaaatgcagttattgcacctaccctacccaacttcataggttagcctagcctcccttaaatgtgctcagaacacttaggttagcctaagtgttggggaaaatcatctaacacaaaacctattttataataaagtgtggaatatctcatttaacttattgaatactgtgccgaaagtgaaaaacagaatggttgtatggatactcgaagtacagtttctactgaatgcggatagctttagcaccattgtaaagtcggaaaatcataagtcagggaccgtctacaattgcttttgctgtattctcgttttcagcaatataaagacatacccgatactgagcagtttacaaaagaaagaggtttaatggactcacagttctacgtggctggggaggcctcacaattatggcggaaggtgagaaaggtggcaaagatacagataaagcactgttcctgaataacatttcaagtcttgacctttttttttttttttttttataactttacagacttacctattccctgcaactcattcagggtatagatgatcttgttttatggtcttgctgcaattcatagcctgttagtagctgtgtcttcaatgtactgggaaatttatctttgtacaggaaggcactgtttcaagacccagagctgtgttcctcaatagtccaaggaacctgtctcagaatcatccgggtacttacaacagtgcatacttctttgtcataccccaggcatattgaatcagaatgcaggatggaggaatctatacaagttcccccagtgatagggatcctcactgatgtttaacaaccactgctccagaggggtgggccagctgccgacatttcttgtgtcctaattgtgaggaaggttcttaaccatagaatgttaatgtaaacacaagaaaaaaaaaaaagaaaaaaaaaacttctgcttaacctcagcccatttgaagcagaaagaaaattgcagggaaacccaaatctgtggtcctgattctgctgttgctttaagatcatctcaccagcaaacaccatggtttggtctcgaaagggtcccagatgaactaactcacctggcactgtaattaattgtaccagagtatgatgatgcatgaaacaatgttcactgtgtgtatgtatgtatatctacttacatatacacacaaacacatatgtttttcttgtgcttatttaagttttcatctttcttaataaggaactgtactcagttcagggattaggagtggtagagagacatattgattcattcaaagaatacttgagatgactacttactcaaagccctaagctaggtgccgagtattatagtctaagtggaaccattaaccatgtacctagacaattttagattgaaaatgataaaacaccataggatgtgtgggtaaaggcttcacaagctcagagggaaaactggctttcagttggaagaatttggcaagaaggtggtggcaattatgttgaaattttcagatataatggtaatgatatatatgctgttggaacaagtattagcatatgaatgattattattttcacaatatttcttaacacttggtaaaaccagcagagcatctattttgctgtgttagaatcgggccagggtcagacaaataatatgagtcaatttataaaacaaataaaagattaaatatgactttggaagtaaactcgtaactgcccagtgggttcttgctgcctgctgcacagataaaaccaattcactgagactgtggcattgcaataaagaaagagcacaattgacacgaggtcggctatgccatgtaggagacagagttattattcaaatcaatctctccaaacatttagaggctggggtgtttcaagaatagcttggcaggccagagagtctgcttctgggtagggccacaggatctgttggtgggtctgtgtggggcatgggttgccagcaatgcaaaaacttcaaaagacatctcaaaaggccaatcttaggatggatgtggtggctcacccctgtaatcccagcactctgggaggccgaggtgggtggatcacttgaggtcaggagttcaagaccagcctggccaacatggcaaaaccccatctctattaaaaatacagaagttagcctgtgtggtggtgtcgcccataatcccagctactctggaagctgaggcaggagaatctcttgacctgggaagcagaggttgcagtgagctgagatcacgccactgcactccagtctgagcaacagagcgagactctgtctcaaaaaaaaaaaaaaggccaatcttagattttacaatagtggtgttatccacaggagtaaagggaagttgcaaatcttgtcacctccagaataatggctggtaaccattttcctttacactttagcagaattctggctcttcatccccctaacctggtggtctttcattagctttacaaaggtggtttagttttggggaagggttattatcatttaaactataaaagaaatgtctcccaaagttagcttggcctaagtctaggaataattaaggacagtttacagcttaaaggcaatatgggggttggttagctaagatctctttcactgtcatagtttcctcactgttataatttttgcaaaggcagtttaaaaccaaaagatcagagcaaagacatatgggtttgaggttttacaatgtaagaattgtaatatattatagttgatttgatgaaagaattatcaaccaagcagtataagcacaatactgaccaagtgtggaggattattgagctcagaaatagtcatgcagtaagaggcgagggaaatctatagggaaagtgcaatttgctgtctcttattaaaataaaaatatgccttgctacctgagtaagaatgcacatactttttttaaaaaaaatctttgtcatatgactgcctattactgtttgaatcataacctccattgctgctttcattcaaaagaagccattaaattcacagacttcctgcatgtgcccagtgtgtgaaagctttaattaaatctacaagtagagccttaaaagaacaagaatcaaattaattgcaacatggtccacgcatttgtctctctgacagtccctgtgctttggagaaaaggcaatctgtgcactcttatctgaattagtaaactcaatatcactttccattagcatggccagttgctgccatgtgtcttctggctgacactgtttacatgctaatgccctcacaaatagagtctgttccaactggtttgctataggattctggagcactaaatccaggaggtggaatatgctgtcttctgctttctgcatcactggcttttgtgagttctctagattgagcttcgtaattagactgcagactaattaaggaaaattcaccacatgcaaatagagcaaaaggatttgctgctaattatggttcttatgccatagtcaagacaaattaatttgtaatattattattcaactttttggtggcctgcaatagtgtaaaataaggaagtgatgtttgtgcttaaggaagacttctacaactggagtgaataaatattcaccccatgaggaaattagaggtaaaatctgtatatttgaggttttagacaaaaaagactccacaattcctatataagcttcagtgtataattactttgtttttatttttgttttatatccagaaggtactgtttcttaatatgtcaatgctataatataatcacaccggcaatctagaaatacctacttcccaactttcagcatttaaatgggagtttaattcaacagtgtatgattttcttgtttttaaaggcttcacctatgaatcccttaggccaaatgtttaaagctaatgaactgtagctcgttatattctgcttatatgagggaaatagcctgaagcagggtggcctggcttagtgtgctgagtccagtaggcatcttgaaggtaatttcgttggttgcacatagtttagaattataacaaggatttctgccttgaaacattacgtattttagcgtgagaattgtctcaccggcagagaattaggttttcttgctgaaaatgtaaagcagatttatttatgaactgtctgccccatgctgctgttttctgacttgcttctcattccttagacgctgaagcctaaagaacaagcatgtgctcttcttatgactaaaaagtggttcagaaagcagcattttaagagttaaaggctttgcattgctaactgagagaagcagtattcacaaagtattaaaaattaaagatttagtccatctaatgtcaaattgggaaatttaaaaatttatgagcttatattgttaatagtttcctgagggaaaattcatccagtatttggagcgattaatgaattgcttgttgtatggcagtataatagagagagagagagagagagagagtacagttagacataatatcgaagttatttttggaaacaagctaacaaagaaggctgtgtaatctctatctactgcaatctcaaaaaataggccgaatagccatctattgccagtgatttcagagggatgtgcctgaaggcagggagttggatctggtgacttcttaagtcctttccacatctctcattcccttaattattcatcaaatataaacacagacaatgtgattttctttattcacaatgtccctgtgtgaaaaaatatatgtatacatatgtaggattcagtactccttttatagaacattgctgtcaactattaagcttaacccaaaagaaagttctctgttaataagagaaccaaagtgcacatcatccccaacaggatggcaatttatgatgtattttgatcgtccacatgacttgcaggagagtctggaagaaaggtcatgggaagattaactgcaggcgcacccggttggtactgaagcaggattttgctctgattagcaaagcactgaaggccagtcagggaaaaagatcaaggtcagtgaccttccagaagggaagtcaacctcggcaataataaaggctgccactctgtcaggactccagtctcatgcagagttggtgactaatatccttcactctagcttgaaagccctgttgacagtttagttctaattatttgtggatcagattgagcagaaatacatctgcttcttttctatcttgtcttttgaccctccttttttctgcccttttaaaaaatgtgcactgatttctcaattatgtttttacttttttcatatttcttctgtcaaccccattttctcctgcctttctgaggggatgtgttttcttattacttgttcaaatactgatgccttttggaaaaagctaaatgacttaagtattttttaacctttataaaagtatgagaagcatattcttagaatcacagtgtacactttctcagccaaccattcaaccaataaagtaagtagtttctttagtaattctttgcagtttccacacctctttgtttattcattcaacacattttttgagaacctactgttaaaataaaaactttagacaaattaaatttagcagagtttaattgagcaaagaatgattcacaaatctggcagccctcagaaccagaagaggttcacagagttccccttcacaatgcgagacagaaggcaggtacagaaaggctgggctggttacagcagtgtttcccttatttgaaagtgatctgattagttggttcctgtgattgacggaagctcagctgctgtgattggctaaggcttgttatacttgttacaaaagtatactcctcttagcagcagcaaatcagtaagtgttgggagcaacctcaattcttgcctcctcagaagaaagaattcaacccaggggcataaggctgagtgagagaatgaggcaagttttagagcaggaatgaaagtttattgaaaagctttggagcagggaggaaagtaaatagagtacatttggaaaagggccaagtaggcaacttgagagggtcaagtgcacggtttgaccttagatctggggttgtacatattggcatgcttccagggtcttgtgtctcttctcccctgattcttcccttgggatgagctgtttgtatgcacagtggcctaccagcactggggaggggctgtattcacagtgtgtttactggagttgtgcacatgctcacttaagacatttttcccttagcagttgaacaattctagaaggtcatataccagttaaactctgccactttgcctcttagtgtgcatgcttgagcccacttgccccactcctgagatcttattgggaagctgctgatcaccagtttcagatgttgggtgcatggagttgctagccgattctagtatgtgcctagaattagaatattaatccaaatttttacattacccaccctctcgtttcttctgagctatagccagagatcattggtttgttcacaggaataagcaaggttagtctaaattgcagacaaaaactcaaaaagaactgatgagactagaatcttttaacaggtttgccgtcattcttgaaacacaatttttctccctccaatctccattttcattaaaaacaaatcatgataggactgatttgtttgcaaaataagctttagtcttgttatacttggcctgattatttgcataaatcacagcaagaataattatttgccacataggctccttttaaaattggctttgatgggctgggcacggtggctcatgcctgtagtctcagcactttgggaggccgaggcaggtggatgaactgaggtcaggagtttgagaccagcctggccaacatggtgaaacctcgtctctactaaaaatacaaaaaaaactagctgggcatggtggtatgtgcctgtaatcccagctactcgggaagctaagacaggagaatcactagaacctgggaggtggaggttgcagtgagccaagatcgcatcactgccctccagcctgggcaacagatcaagactccgtctcaaaaataataataataataaaataaaaaataaatttggctttgatggaactttgttccattaggatctcagataaaatgttttaaagccataagcctagctgtgggtttgtaccatcaaatacctgtatgagttgggtacattcctcacctcttaaggtcccaagataacttggtgctcctaggcctgtgagaaagtgatattctttacttaccacaggtcaggaacactgtacagggactgcatacagaaggtatgaggccagctttcccaagggacttttattatctctataagtcagatttgattccttaaaggaaagcatgccattccattcaaagccttggtaaaacaaccagtttctccaattgtgtcctgctgcgaaagaagtcagattattactgcacttatgcaaataatgtaagttaactttttcttgccacaagttaagaatacacaaaaatagtttccaaattctggagaaatcaggtacagagaaacaaatatgctccaaattttgtttgtaggaatatactttactcaattgttaaaagctctaaatggaaggattatttcagtcttctattagttcagtccatacatttaactcctgttctacttgatattcatgacacaccattcttggactttctgacttgtcctaaatatccctcttttttttttttcttttcttttttttttttagatggcgccttgctctgtcaccagactggagtgtagtggtgcaatctcagctcactgcaacctccgcctcccaggttcaagcaattctcctgcctcagtctcccaggtagctgggactacaggcatgagccaccacacccagctaatttttgtaattttagtagagaacgggtttcaccatgttggccaggatggtcttgatctcttgacctcgtgatcttcccgcctcagcttcctaaagtgctgggattacaggcatgagccactgtgcccggcctaaatatccctctttttaaacaaccagtcattttactttaggacaacaatttaccatacaagatcctttctcatataaaatctattttctttataaccttccttaccaaaaatacctctttacctttataacctttgaattagacaacagtcattttccttctattaggaagtgatggtttgtactacatgttgctgtgtgagtcctgtgtagggaaagcaaatgtggaggttatctacgtactgtgactgctaatgtgagccacccgttggggtgacctgaaaaatcagcttggaagagcagaaccacagtggccaagaggaattgttctaggggttgattagtaagcaggagagtgaaagggaggggaaaaaaaacatgtatggaggttgaacacctgcagccaaagaaggcaaggtgtagaggtgtcttaccactggggaatgtatcagagtcatgtggcatcaaagtatattaccactagagaatatatccaagtcatgcagcaccaaagtttgttagaagtagcaaatctgtaaggatctgcagcaacctcagttcttgcctcctcagaagaaagaatttgaccaaggagcataagacagagggagtgactgtggcaacttttagagcaccagtgaaagtttattaaaaagctttagagcagaaacaaaaggaaatagagtacacttggaaaagggtcaagcgggcaacttgagagagtcaagtgcatgttttgacctttgacttggggttttatacattggcatgcttccaggtcttgcattacttctccctgattcttcccttggggtgggctgttcgaatgcgcagtggcctgccggcacttgggaggggctgcatgtacactgtgtttatgggagttgtatgcatgctcacctgagctttcttcccttaccggttcattattcctagaggaaggtcatataccagttaaactccaccattttgcctcttagtgcacatgcttgagcccacttgcccaaatcctgagatcttattaggaagctgctgatcaccagtttcaggttttttctgtctactgggagactgccattcccatgtgccacctatgaccaattattattttagtgagacatttaactacttcctgaccatcacctgatggtcgactgatgttcttagtttgatggcgggtgggggggccctctcctgccctacttgtgtctgactagctacctactgtgacactcctgagttaggctttcagttaatttactgctaagttcagttgcagttggttaggaaaggactcaagtatggaggcatactcaagccaaatttagtttagttaactacatgtccgacactgttctagacattgcagatatagccatgaacaaaacaaacagaaatctttgcccttctggagatttgaaagctatgtcagatgttttactctgagcgatcatcaaggaggaaaaagtgagaattgagagtgattccatctttctccaagtgtaccccgtcttttttattttgggtaatgttggttaaattaacacagtctgctaaaaccaggccatagaaagcgtggcaattgctggaggcaacttctgaggagcccactttggtgggcagagtggcttctgctgagcctatcacagagggcggcgacctctgcggatcacgcacatcagagcctcactggaagcctgtgttcctctggaagtagacgagctatccatcctgagactgaggggcgaaaaaggaaatgagcctgaaccagactccacggaccaaacaaatgaccaagtgccagaaagccttctgtcttgggcaactgtacttctgccggagttaatagcattttctgctgcttgtgcatcttagaagagtaaaatcgttttgtgaactatttccacccatgacttctcatgacactcagttgaatcagacaagctgagggtctctgagggaagatgaatccgcatcaggctttccccagcttaacagttcagaacccacttttccttcatcggtgctggcagtgttgcaaagataattctcagctcttgagccctttaaaatatttagctttttaatacgtgaaaaaaaaaaataccttaaaaaagaaaaagtggaactcaaaggaaaccccttcttttaaatataatggttcaattttaagatgaagatgagtagcatttgttgggggtctttaattacgctggtctgtggcttaccttaggagctagctgcctttgatgctttcagttcttattctaatttaactatttttttcctatgccattattgtaccatgaaaggaaactccctcataaacccatcatattgttcactgtagagaagcagcgtgtgaatatgtttatagttgctgaatatattcaaaaatgtcttttttatatgattatggtcctgaatgtttatttttatttattttattttattttttactttagcttcagagggtacgtgtgcaggtttgttacttgggtatattgcatgatgctgaggtttgggcttctagtaatcccatcatccaagtggcaaacatagtatccaataggtagttttccagcccttgctccacaccctccctcctcaagactctcgtatatctcatgtattttgaaataatggagacattacgcaagctaaacttgagttcattttaaatattttaagctaaagtgacctgtcatgaatgtcacactagtgatagtacccttttctcttgcacttatttgttgctaagctgacttccaaatcggaattacctaaaggacttttcagatatatagatgtctagcccacactttgaattgcccaaatagagaataaacaggaatctttatttttagaaagcatcatagttcctacttggggaccactattgcactctactcaaaaatacatactgcagctgtaaaatcactatgattaaattataactttgatcgctttcttgtctttggaaaactaatacatgtttattataaaatcttgactcatagcagaaaagtgccaagaaaaaagtaaaataatctatcatctttccctgcccccaagtgctgtgactgctctgatgaccctcttttcgtatagcactgtgagtgtgcacgggtatgcatctgtcagtctgtctccctgttggagggagaacagtgctctatgtgcgtttcatagcccattgtttttcgcgcagtgtgtcacaaatcttgccacaccaagagttgtatttaacgatgtactgttaataatccccccagactcagctacagttaaggttgtagtcacacagcacttataattagataagtttacttttgtttcaaaactttctttgttttcattgtaagtcatggacttcctcgtttccaaaacctaaacaaaataaaccatagcttctaaatggatttagacattaaaagccttctcaagtatgtcacttttttttcttgattaaaaatatttaactcttacaagttatttaaatatggctaaattctgttatggctaaaatcctaattttttattttatttccaaagatttgatgctgtgactttcttatcagaatcaccattgttgctcataatataatcaatcgggagagacaaaaaagaggcaggaaagcggtgaacttgtgatgcgatgacataaaggaagagaagctaatgctgtgttgtttgtcctgcaatatctgcttcattttgctttcagcagaggtttcctggctgctttttcctcctttctttgcccttctcctccttcgttcattctccaggagcctcgtacggaatctcattcatcctcagcaggaatatatgtattgagtcacattccaggcaccgtgttaaccaatgggaggaataaaatagttaaccaatgggaggaataaaataaagtaggaggaataaaatggaataatcaatgggaggaatgaaatagtcaaagttgccaccctcatgaagctgtcagttttggggagactaaaaataaacaggtagacaaagggtattatgtggtgtttacatcctcaacctcagaggtgatttgtcccaagtctaggtggaaccggcctgccacttgggccccaggctgtctccagctcaggaaatctgacatggggcacaggtggccaattctggcccatgagtagaagtccactctgggtctgtgaaggatgacttagacttctgtgttctatccctgtctttatgctgatctcccaagatactggaatgaccaggcaaccactttgaacttgaatttccctgtactgcatcctcttcctcatcccaaagttcctgcccaggtccacacccacactgccaccctaaccagaagatcttctgtcccacctgctccctccgtttctttgcacagacacagtattcaagcaggcaagttcatggcctgccctgctgaagtggacaatctttggtcttgagctccagcattttgccattctggagcacgaataaatctgtttcaagtttatttcatcttctctgtttcactgattggtttgatgtgttttatcctgctgcaactatgtaaaaggaaagggatgtgctgtttttgaaagtcagagggtaaagtcccactgactttaatgataagtccattaaaaagatctgtcctgagagtcttggataccctgtcctctgtgccttcagaggagacgagtgagatgagtgaggttgcacagaccccactggactgttgggtggagaagagaaggggagcctcggcccgagcccatatcataggctgaaacatagatgtaatgctaagaacaagtgacgaaggtttaatgacttattttactttaatatataccaagaagctaaggaagacaatttgccctaatctataacactggcctaaagctgaacaaatgcctatgctgaacaaatatcatttttaggaaaaagttatatgaggatttgccctatgtatttaggatttatttttgatgtttaaccttttttagatttttttcagttcttaaatttttaaaagttgtcacctaccacatgagtgttagtaaagagtgctgagtgagagcgtccctttgtcctagtcctctggtcctaggtccaggctagcctcacagatagcagttgcccaggtaagacacctgaaagggtcttgccacgggccttgaattctaatgcagactttcaaaggataccactttctttcaccaagtataatctaactatcttgttggttttctttttttaagagtaataagttagttgctgtagttttgagatatattaacagcaaatgtactttgccaatgagtagacaatggtatattttacatgcaaagatagaattaaacccactaatttcatctgattactaattgttaaaaaaaataaaaaaaaaagatagtttctatccttctatccatgccaaatactttcaaaatttgtacatgaccatccagacatccatctctcctgtagggctcagctctctgtcctctagggtaaggctggctgggtattcttgcaccctgtgctgtgcaggccacacttcaccaggccccccaggagccccaccaggaggcaccgcatgatctccatattctacacgcgtaaactgagacacagaagctgatcaccttgctcggggtcctgtgactagtaggagtggggctggggtcgcgagccaggcagtgtggtgtttgggcctctgccctgaccagcctgcctcctggtagttgtctccctattcaggtttgtcactagacattaccgtctggcacagggcctggcaggtcagtggcctcaggtggctctgggtctgtggccaccgtacagagcgatttgaactgttcatctctatgacccgtctttgtgtgtcttgttaatagatgtttcccagggagtatatgagttgcataaaaacatatgttccttttgtgaaaagtttctctaggcaggcatatggaatagagtgtgaaaatcatgtgaccactggaggcctagtgccttcacctgaagaggcaaaattcctgggtaacaagaatctacagaggaaaaacaaaataaaatacataggtactatgttaacgtataaatgaaatgtgtctcccaatgttgccccttacctcctccatacacagtcctgttccccagggggaaatctggtttctaaatctggaaaaggaagtatatttacttctatttgttatttgttggacattttgtgaagagataggaaagaaatattatgcagaatatctcatttgtaaaaagagagatacacagaaggtttttaagaataaaaagtattggaggctgaggcaggcagatcacgaggtcaagagatcaagaccatcctggccaacatggtgaaaccccgtctctaataaaaatacaaaaactagctgggcgtggtggcgggcacctgtagtcccagctactagggagcctgaggcaggagaatcactagaacctggaaggcgaaggttgcagtgagcggagatcgtgccactgcactccagcctgggcaacagagcgatactccatctcaaaaaaaaaaaaaaaaaaaagaatgaaaagtattttgtttctttgtaagctgaatcaccccatcttgatggtctgtgactttttatttagcttaatatgtatgagggctctttccatgttaaccaggatatattgatctacctcaactttagctgtagcttcgtattttaacattccttttttgacagaaatgtgggcaactgccaggattttcttctgctttgtttctgctttcagagcaacagttgccctgcactcttgtgcatggccctcaaagctgttctttcttgccagctctcacctcattttccacatagcactaagatttgaaccaaggctgagagactccaccatgtctgtccagccactgtgttgcactcatgtgtcaggcacagcgcaaggtgacatgggggaaactgaggcagaggcattcctgcccttctaggccttacatttgaggttcaaagacatctagatactaataaaataatcacaaatttaaatgtacaaatgcactgtgacacaggtaacagaggagtgacgtgcatggttctgtctgcaagctcataatagagagattgacttagagtgggcaaggagggcctcccttgggaagattttttttttttttttgagacagagtctcgctctgttgtgcaggctggagtgcagtggcttgatcttggcgcactgcaacctccacctcccagatacagcaattctcgtctgtcagcctcccgagtagttgggattacaggcgcatgccaccacgctgggcaaatttttgtatttttagcagagaagggttttcaccatgttggccaggcaggtctcgaactcctggctgcaagtgacccaccctcctcggcctttcaaagtcctaggattacaggtgtgagccaccatgcccaaccaaaggatttgtgtgatagctacaagcgaaaaggagttaatgagatgaactgggaggtggagcattctgtgctgtggaagcaacatctgtcttgggtctgtggtgggagggaatatggtgcatctaggggctggagaaaggccagcaagagagcagccactggtagagcgggcaaagcctggtgggcaaggcggtggcagacgtgggctgggcctgaactgcctggtgcctttaggtcaggtggaagagtttccatgccatcttaagtagcgtagaaacctctattgtgttttaagtaagggcatgatgtgatcaaatttgtgttcaaagtgctctctggtaacagtgtggacagcacggaggccagtatggcttcagagagatcagcagaaaaacgttagcaagagtaggtgagagcctagactaagttggcaacagaagagatggagatttaagaggtgaagttaacgggacttggatagagccagctgtacaggaggaatagcagtgacggcaaccatggggtctggaaccttggcccaccatagagtgtacaggctttgagttggtttcatgagattaccacatgttttttaggaattgctttaaccttgaagagcagttccactgggcacatcaaataatacatcttgctcattccattcgccttttggagattggtatgcagatggcaactgcaaatgcttatattaaacatcgtatttttttctgtttctttccagtcattcttaaaagcatacaagcttctcattccatgagctaaaaacatatttcattccataaacagaagaaactatgtcagaaattgtaggctcctaaatctcacaaatgaggtaaacatacattaattgtttctcagatatttatggagaggcagaaaggaaatgttcagtagtatctcacttttaaaaggtaaaacaaaacaaaaatccagaagcacatagttcagcgtaaagctaatcacagttgtgcataaaatttgaataccatgtagtcagaggaaaggctcctcccatactgtggacaaaggatgtacacagctgaaacctttagtccttccctgtggcagcagccaacattttgctgcattctgcagtactgaaccaactcatcattttgaagcaagctccctgggaaatatgtaagtgaataatgctgctctgtgatgaatcacggactgaacacttcctgtatgtaacaggtggtgcgttaccatgatgtccgagaaaatgtccagctgaaatactagccccacaccgtgacgaaacgcacatagagctcaggctcagacctattgcctgtgcccagccctggaaagacagtgaccaagtaatgccctggtcatttaaatttgctaagcagcaaatgacttattggtgaagaccatcaagttgatggttttattgtaaaatttttgttagtttcactgtaactagattaaagagcaaaatataattttcttaaaatgaggggctgtgcttcagaagaacctaaagaggcttttgtgtgtgtgttgggggtgggggagttatgtttaatacagagatccagactccaccccagacctaagacctacctgacatcaccagagatgatgtaaaagcatgttatttgaaattttatggcataaatataagtcataagccactggattattaagataacagtggccacattcaaccagtttttcagaaaatacttttccaaagatggctgagtataaattatttttgtatgtttttcattcatagatctcagggttgaggctgggcgtggtggctcacacctgtaatcctagcactttgggaggccgtggcaggaggatcacctgagcccagaattcatagcctgggcaatatgacaagaccccatctctacaaaaaataaattagccaggcatggtggtgtgcacctgtggtcccagctactcaggaggctgaggcaggatcacttaagtctgaggctgaggcttcagtgagccatgctggcaccactgtactccaatctgggtaagagcaagactcgtctcaaaaaaaaaaaaaaaaggtctcagggttgaaaggtaaatgaagaaaacatcccctgtttttggagagatcagctcacggggggttctgctacttctgagtggtaaggggaagggcatactgatgtccttctctgtccactctgcatctccatggacaggtgctttgtcaccctgttccaccttataaaagcaaaaatgttcccactgagaattaagcctattttgttttatcctcagcccaaagcgaaataaagccatagaaagtttttgggatgatttatcaatgcctgaattggcatccttcagagctgatatgtgggctctttattcgtttattccctgggggtggagtataggggaaggtggcttacctgagtgaggagcctggggttggcactgcccacaggtctccctcctcagctggcctggcatatccagggaagacttccatctggaatacctgagtgactgctgggttacccatcactggagactttaaagagccctcttttaaaatccaacaagatagtgttcgtcagtttattttattgacgtataatttgtttgcatttaaaattcttagaaatacatcagtctttctctgcagtcacttttttactttacttacttaaaaattaaaataatgctatatgttaaacatatattcaataccaactctctaagaccgagttatcttttttacttgtagagtactttttaaattgtttaaatgacttataacaactatatatatttatggtgtacaatataatgttttgatatatgtatgcattgtgaaactgctcaatcaagctaattatgcttattttttgtggtgagaacacttaaaatctaccctcagcaattttcaaatgtacaatgtagtgttattaactaaagtcaccatgatgtacagtaaatctcttgaaattattcttcttgtctaactgaaattttgtgtcctttgaccaacatcattccagcctccctccccacacagcctctggtaaccacctatcttctccctgcttctatgagcttgagtttttacacattccacatatatgtgaggtcatgaggcatttgtctttctgtgcctgtcttcacttagcgtgatgtcctctaagttcacccatattgtcacaaatgacagaatttcctttaatttatcccatttttgtaaatgatagcacagttatagctgctcacgtcactttttgagtagttgttctagtcttccttccctttcagaaagacagagataatacaatctgttcaagaatcagtgactaaattaattttatttaaatattgtatgttttatttcaccctgtttggaaataataaatctatgttctgtttatctgtagtaatttcatataaaatacagttaatttaatagataagttagatttcaaatacatagataaattagatttcaaatacataaatgttaaaagtaatatacaagatgatggttttattgagtgaagatagttgtaattcagagaatatatgtggggaaatacaaaaaacaacattgtcatggccaatttttttcctgatattattactagaatgactttcctcttaataaaaaaaattgtgtgttggggaggagtgaatgttggtgggataggtcataccttagcagttacagacttgcataggaaagattaattaatatcttatcagctggaagcctgctgcctgctaaggacacagctgggaaattgggtgagcctctggagaagtctgtctaaaaaggagttaccaggaagaaggggttggaggaatggggatgggcacagagtaggaaagggaaccttaagttggcagggttggtgagaaaagctgcagtcacacagagcctgttttatgggcttgcccagccagccaaggatactcaccctgagccacctatggcctcagccttggtaatgtgccctgcaaactcttaatatgggccatatcatttgatacttagtttaaggcagagattggcggaacacagacacgtctgaggggcctagggagcacatacttgagtactgcacggctacagaggaggtgggaaaggacttctctgaacaggagtggggtgatttccagagacggtgacacgcaggagaagcatctcttcttcatagaaagatgccagctaataaatgtggaagaggcaagggaataggaaaccaccatgctgaaaaggcctgagaaatacaaggtgcaaatgactgtacatggagccaagccttctgtgtaacgaaaaagggggtatgagtaagtgtatgtgtatgtctgtcacctgtgtcacacaaatgcatgtgcacacacatccccccaacacacacacacccaagaaggataaacccaaagcaatggaaaatggctgcctatggggatgagtgagcaggggaatggggaggagggaataaaggtgagagctgcacaggagactcctctgactacattttttaatacagttttgactttagaaccaaatgtttttcatatcccagaaataaatagaatatatgaaacaagctcaccctgagattgtatatagatggaagcagatgaatctgactatgtagcaaattgacagtattaccaacctacagggaaaaaaagatttcaagtaacttctgaacacatatcattttctatatattcttgtaggatgtagtctaaggacaaaaaactgaaatgaaatcttaagctttatttagatttattttattattaataatattgatattattattctaaacttattttacatatagtaggactaagtaaataagccaatatattaatgtaattaagaatctaagttatcactgtaagaaagatgcagatactttgtttaaaagtaaggaaaatctctgtaatattaaatttgaattggaaatagtacaaaatcatatcaatattcgcacacatattctaggctttattcatgggaatgagctagaagctatgaaacttcagtagcagtgagcatgtattacaactagatcttgctttctaaataccactccccaataaaagaaaccaggacttcctggagaaattgctaatgaattttagatcttggtcagggataaaccagttgaacctatagcattttatgccaaaatcaaggttgtactcaaagactaatgagattatgtcaaaagaacacaagagcctgcatgaaagggctcccacaggccaaatttgggacaatttgatcacccaaagaatattgacaggaattgattataacacattgaattttttaataaatatatgcatctatggtaaacttaaaaaaatcaaaaatactgaaaataaatagaaaggatgggggatgtttttccttacagcatactgtaatgccaggaaataaatgtagaaatgataagattagagaatgactattttgcaaaggccaatataagatctaataataagaattgtcagtgtttgccaaaatgaccaggtaagagatattctgggagtcacaatattcacatgaccttcaagtgtcacctatagattacttaatttcttttttatgatggaaaactgagccttaacaacaaatagaagaatctagtagtcaacaccttgctcaaatttagcaaagccagtagtgatacagcttcacattatgtccttgagcttggatgtaggaaagaaaaagcagctacagaaagcatgtgggggacagttggatatattgaatgtaggcttcccattaagtgatattgtaaaatcatttttcttagttgtgataacattattgtggttatataggagatccatgctgaagtcatatttagggatagaaataatatctaaaactaagttgcaaatggttaggggaaattctatgtaagatatagatagagagatattgagaaacagcaagagaaagccaatgttaacaactgctggaaccaggcaaagggtattcaggtgtgtgttatactgctcctttgcctttactgtggaggggaggatgttcaaaatgagaagctgtggtgaagaaagctatcaaggggcagtaatacagcttcattttctcttccaggtgcttacaaattgattatgtgtaattttaattcttctttccaattttatactttccagtataaaagtcaacaaaatgtctgtaactcccaaagccctttaaaaaatatgattaaatgacagcataagggttttcttccccagtgagctatggtcagctgtaatgaacatcaactgtcctgtagcctgtggccagatgccctccccacaggggcctctcgcgcagactcagggagctttggtcacctgggcccaacaagtgtggagcagagagcagaacacagtagtgagtgcacagctggcagccttctgctttgattaagatgcagaaagtgttgagggacccagggcttcctgagttagagagactgtgggccacaggccaaggcttaaagagaaagagctgcccctgtctctactccaggcacagtggctgtagggacagcacccaggccactctgctatgtgtcgctgaaccttggcctgtcttcttaaagtactgtgtgttttccaaattgtttcagacacactgggtcttcaatttccagttctcatggatgctgtattaagaaacgcaccagaccatattaatctgacatggctgatttgggttgacattgactgttttatcttcgtgacactctgtaatgtcacactcctacaaagatcctccttgtcagacagggggccttgagaggccatcgtgaaaccaaattttctctccagacatctgtcctttaatcttttcccccttattttatgtgtctaaacaccacagttcaaaatatgtttagaatctttaatttggttctaaaactttaatgccatctcctcttcttatcatttctgtcttcatccccttcatctcccttggtagcttgactatttcaaaagctggttgtatccataatggttttgtagtaaatgtggtagcttatggtagctgagaacactggttattttagccaattgagttttgagttggtgggaaagaaatcatggccgaggtgttcaaaaccaagagctgatatgtggaaaacaagcattaaaacagtgtcactagaaagtgacggcggtggaaagttgtccatagagtaactctgctttcagggctccgtgtgaggactgagggggcaccctgaaatccacactggaaacaggcaggcccctttatgaataggagctccagctccatccatggtagctgtgcgtgctcattcattaggccttactggtttgttgtgagtgcagtatcagcatgatttatggcataggcagcctggaaataacatgagcagcacatagcacagccgtggctgtattcatccaacatatcctgtctgttcaaaggaaatgtagaaatctacttcttaatgacattttgtgctgctttttaatttttcttgcttttgaaatactgcattgttcagtactcctgtttgggagtcacttagagtgacgcagtgtcagtcagcccaagacttggtggttatctctgttttgtcagatctgagctgcactcgcctcttttattcttgtaaggattgggcatacaaacgtttcttctcaggaatcaaagaaggctctcatgagaaactgcctccccagcacctgagggccccaccatcccaaggcaggactctacatgcaaacagcatccaccctgaggacaacattctgcacagaaacctctcaaaactacagaattgtcatccacactttggccaggagtactgggaagtagctagaatggagttgagtcaattctcagctcttagaagttctttttttttttttttttttttttaaataatgttctgggaaagctagttacagaggcctttcacaaggacttcattggctacctgtaacctctggcctaagtatgtatttgcttcgtggttccatctcacatgaaattagtataaggtgaacccagtgatggctgcctttaacaagggttagcaactgttaggatggatgtgtggattgactcagccagcaccaccattttgaatgggttagtgaacagtaaaaaagaaatataaaatcctattactagttatctacccaaaggaaaagaaagcgctattcacaatagcaaagatgtggaatcaacctcgtatgcatcagtggatgattgtataaagaaagtatggtatctgtacactatgggatactatttagccattaaagactgaaagaagtcatgtctttgcagcagcatgaaggaactagaggccattattttaagtgaaacaccttagacacaaaaagtcaaataccacctgttctcacttacaagtgggagctaaataatgtgtacatttgggcatagagggtggaataatagacattggagactccagttagtggaagagtgagcgtcgggtgaagaagaaattccttaatgggtacagtgtacactgttcaggtgatggttacactgaaagcccagactccaccgctatgcagtatacccatgtaacaaaaatacacttgtaccattaaatgttatacaaataaaaaataaagacaaaaaaatcaatcctcacatcatatgagaaaaaatgaaaagaacacagctgactccttatctaaacttaggtaaaattatcgttactagttagttggtattcctttccactcaagcactctgaccagctggctagaggtaacaatctttcagaaaggtcttaaagaactaaaatgactgagcacctgcttctatccaatgagccatcccctagagtgtgaaccgtaatttggcttggatatagctggcagtgaggaagttttgtaggattatcttgcctcagcatttcttaagaactcggggagtggggcctgtcaccttaatccctttcagaagttccaaggtaagcctgccttaggctgccttagatcaggaaaaggtcatcactacagatgtaacaagagctgtcagatgcttgcttttattttcaggtgaagtcctatacctctgttccttagtgctattactgttagagagatgggaacaggagagagtggaatgagcagtgtttacctccttgaaggaaagtgctatgccaatacaaggaggtgctgcgcaggtcagcagtgcgccagcatactggtttcgtacaactcagaaactatcctgtttgcacatagcatttgctgaaaatattcagctgtctaggactagtgcccagtagagagattggcagaaaaacactcattttagctggctttcaaattatttttcaaattcaacacgaagtcagttaaggaagaccattagattatgtcaaaaagcagtttggaaaacatttatcatttgtagggagcccagcactgacgtttctaaattgtgtgtgacgttgacatgttcccatatgtcacgatatgttccttacttcccttgttatgagcttgggttagaagtcactgttcttttgaaccttgatgtcacctcagggcagtttgctagcactcagaaattcaaaattgcctaaagtgcgtggtgggatgtctatctgtatcataccgtgggcaaacgtctgacttgaaggcatcaaacaggcaaacggaagaaccatgaaggatgctaagttttgactgtgtctgggtagccaattgggagtgtattatgtagaaagccaaataaatgcttatttcaagcacttcaaggtaaaggacaatatttaactctggtttgttttgagagattagagtagtttatgcccataagaaatattcagaaatagttgttgagtgtgtgagtgaacagcagggcattaaataacattatagtcatggtctttatgagcgttaggccaatgttctatgtaatgaggtaaattatttaaggttcttataatgtgttattttaggtaaggatgttgctatttactcagtgttttttcacggaagatagtgtgctctacagattccgtgtcactaagctaagcatctatgaagcattattgataatcactcagttgactattacatacaaatttcaatgtggtcatcaactcttaaatttctttatagttaaaggataggaaaactgacaaaaaatgttactttttatcacttagtagaatttcatgagtcactagtttagaactttcatttccattcacaggacaaggttaaaagaaacagaattaagaagttgcttaggagtaggcttttctgtttattgggagtcggtattggacattcataaatttataatctgcattatgtttcagcgatacgttaatgctgagttcataggattaatcaggccacatgctgtcctgtggcttcactaatatactcctcagtcacatcagcactttctctttcacaccacacacaaaaagccttacggagcagtgggtaagcagtcctaacaggcaaatgttcacacatagtgaaagagaagtttagtttttctgtcatggttgctgaacaagataatattctctaattctttgataggaaaatagagccaaggcatttgactgccgacacactctcattggaactccatgcaggacttcaccagtcattagaagctcattccaggaatcccagcctcgaagggatcatggagaaggtgggatggagtgacctgagtctgatgggtagaaacagccacccttgctctctcccaccttcttctgtgtggacactctgcctctggaatttttagtaactgggtacctgttggaagattagttccttttgctaggctatgaactagagggagggtgtgcattcatttcactaaagtaaaattttgccttttctttgttgttagacaggatcttactcccatcatcctggctggagtgttgtggcacaaacatggctcactgcagcctcgacttcccaggcccaggtgatcctcccacctcagcctcccaagtagctgggacctacagacgtgtaccactatacctggctaacttttgtgtttttttgtagagacagggttttgccatgttgcccaggctggtctcaaactcctaggctaaagcgatctgcctaccttggcctgccaaagtgctgtgattacaggcatgaaccatcacacccggccaaaattttgccgctgatttttagaaattgaattattattttagactgaagttgtatctttttaaaatgaaagccatacctccgtatttctaagaaatcagatgggatcatcatcccatcaggtattcactgagctcctgcttgtgctccactgtctgctcagtgctggttctgtattgcggagaggatctaaacagaaagtaatccaaagggctacatctgtctttcttaatgacgaaccgacggctttccaccttacccttttggctacaaccagtgggattgactgctgtcttattgactctgtttatctagatatggtggacatattgcccagttagatgggctaagataccgatagccccccaaaatgccagattccagaataaatgaaatcactcagtcattaaggtgatatatttaactgggctggctgggctaatttgtccatgttaccaattattattgagcagacaaactcaggtaatgatggcagcaaaagcccatctggggcctgagactagaggaggaggaggctggccagaccctcctcagatgcgcagaggacagcttcaggataaggagagatcagatcatgcctgctccatctcggcgggctcatcttctctcgcccccatctgcatggtcctcttgattttcttcataataataacactgaaatcctttgagtgctaacattactgtaagtgtcagctgtttatgctgttatatgccttaagttatttcagccttaccacatgcagtgaaggagacactagtattatccttatgttgcagctgaggaaactgaagtgtggagtttaagtaactggcccaaggtaacagatgcagtgatcagaggagcagggacccacagccaggcactgtgacgcagagcctgcgctcctcactcatatcctgcttcaggcttcacaggtcttgggaagaaaaagagaacgtttacaccctgaataacattgcaaaaggatagtgcgctgtgtctgccggtcagcagagctctttgatgatattagtaggagacacctaagcaaagtaaagttgaggtcagtgtagctccataacaaaagatagggaatgctctaggtctcctcaagaaaaatctacaccatggttttctgttttcacctacagcttagttgcccaggaagattcatttattatttatttaagtaatacatcacagggacaagattcattgaagtgaaggtatttcacttccaactgtcctacagggaaacaatgagcctaaataaatcctacaaattctccctggagagggagcagtgattgattcatttttgcatctgtcaaatgcctctatagtccaaagagtgcgttttgttccctcccttaacaagattctcttacctttgttttgttcaggctttattggcgctgtgtgtataaataagattacaatgaatagaaattaacactgtatcccagttttctgagtcaaagccccaattccaaacagaaaaaaaaaatcttgttgttaaataatatatgggtattatttgtcacatatgataaatattgctactcatgcccaaaaagagactttacaactgtccttgtgctagacgaatgactggtctacaggctacagactattcacagagctttggggaagccctgaaactcacctgatagcagtgtccttgggactgaatataaacttctacagttacaaggccttaagaggttacaaagtagagcaagtttggggacttcaaaagcagtgcctgggatggcagacatcattgccgtggtgcaggggcctctctatgatcccatcgctgtgcccccaccgagacccaggtggacagtttggaggtggggagggagctgggatgtgactcagcagtcatgtggggcaaaaccagggtgggggcacgaccctgctagattagcctgaaggtggggcaaatgactggcaccttgtcacaagacattgttgtttttacgcatttgacttgatttcacccttcaggctcagggctggccctgtgaggcctttccactgcattcagttgttctttcttgaatgttagagggaggaagttggagtctctgttctggggaactgaacacaccgcacgcagcccatctggcctgtgccgtgacccacgcagcacaaatcactagttccagcggcgacaacactaacatttatacatcatgcaagttgtagtcttttattttaacttaaactttttattttcaaataatttcaaactcacaaaaagttataaaaatagtacaaaaaattgccatataccttttacccagattccccaattattaaaatttcacatttgtgtgtttctgtatatgtgtgagaaagtaaaaaacacgaagcctttttactcctaaatacctgggagtaattcctaaaagataaaacatatattcctttacataactgcaatacataaattataatgttcaataatttaataaagtatatttgtgttactctaaatggtaaaataagttttttctcctattaattaatatgattaataatactatgacatggagattagaaaaattaagatttaaggccaggcacgatggctcccgcctgtaatcccagcactttgggaagctgaggcagacagatcacctgagatcaggagttcaagaccagactggccaacatagcaaaaccctgtctctactaaaaatacaaaaattagccaggcatggtggtgcgcacctgtagccccagctactcgggaagctgaggcaggagaattgcttaaacctgggaggcggaggttgcagtgagccaacatcgtgccactgcaccccagcctgggcaacagagcaagactccgtctccaaaaacaaaaaagaaaagatttaaaaactaaaatataatcttcggttttacatatatattaatgattgtttctttttcaggtgataatttttttaaatatgtgaatggctcattagtacttgtgtccttttaaaaacacttatgaataccacagcaaaattaggttgtggtgctattactatatctatttattagtctgctcaggcttccataacaaaatacgatagactgggtggcttaaacaatgcacatgaatttttcacggttctggaggccagaagtctaagatcacggtgctgaccaattcgtttcctgctgagggctctctccctggtgtgtggatgaccaccttcttgctgtgccctctcgtagaagagagttctcttcctcttctaataaggacaccaatcctatcagattaggacccaccctaaagacctcatttaattctaattacctcctagataccccatctctaactataatcacattgaggatagggattcgacatatgaattttggaggggcacaattcagtccatagtgcacagtccgtcatttcatttcaacatcattggagaacaccttcaagcacatgatacctcctttgatgtgttttgctgtttaaaggcgtggtgaacccttgacagaaacattatcatggattcttctccacatgtttactgacttcattgtgcttttcaagttttcttcctccttaaacaacataaaacattttggaaaaagtactggaatattaaatgtgttgttcaaatttgatgctgatgcttgaatttcaaggcaaggcacatcatgggcttgaccttcatgtcttcagactcacagagcttccagtttctcagactggattattataagatctcatacgagttattttgagggaagggaatggaaaataaagattaaccagaaatcaaattccattttcccagccctcccttggcaatgcctagtggtcacatttcaaaatattatacaaacctattttacagtaaatagacatgttttgaagtggtgctagaaagaagaggggcgtctctgccatattctagttatcatatttctgttcattctctgctcagtgtgggcccagaggactgaaaaacagtcagtaagcacctctactttttgcctatggcatgcagaaatttctccatatgcaaaaaagtggggagaggggagaaagattaagatgtttctgtctggtttcagtcacatttttagttctttcccactttcatttgttctctgattttttttttttaatggtaagaaattggcaggtttctcacggaactgcctgtgtttaccatactactgataattcttgtaaactgtctaccatctcagttccttacctcatcgcagctttttatttctttacagatcaagaccatcatccttttaagcatttttctccttgactctgtctcgattgtcctgttctctctcacctcctaggcaattaccttatcttaataaaatataattgggccggtagacgtttctttctatttgaaaagcctcccagcctagcctgtggactgatctccctgccagccagtgtataggtctccacaggcctcctcttcttccatgaagggactgctaaactcagctcaggcagcatagggctatgattgctttcccattcatcaccccgaaaaatgagtttgcactttaatttataaatataaaatatattttcttggttacggcgaatcaaactgaattatatttgtgcaattactgagttacatgaccgaatgtatatctacgtagttgagattattcttgggaaatgcaaggagggactcccatctgattcagttatatggagcagctctagggtagcaccattctgggctttgagggtaacacgatgtaactggtattgtatacattaacattagtagagttccttggctgtttaaaatagctagaaatcagagaagtatgatacaaactactacggactgaatttctgggtatgtgttgtattaaaagaaaacaacaacacaaatttcggaagtttttgtagaacaactggctttcattctttaaaaaggttggtgtcattaaaggaagaaatgctggggattgttttaggttaaagaaacatgatgacttaatgtggtgcttgatccttgattcttgagcaaaatgaaaagtttaaaagacattgggaaaatttggaagatgtagatatgcatatatattagataatatttttgtatcaatgttgtatttcttgagagtagtaatactgcagttatatggaagaattccttgttcttaggtgatacatgctaaagtattgggggaaattgtcataatgtcttcaactttcaaacggtttggcaaaataagtgtatatatgtatgtatgtctatagtgtgtgtgtgagaaagtaaacacacacacacatgcatagtgaaaaatagaagttgcaaagattcatttttgtcattccttatttcttctaatcgagtaaaagttttctaaattagctttcctactaataaataaaatatttttcttatgctcggtcaggaaagctaaatgggagaggcaagcccacctaagtccttccctgtcaaggagggggtagaaaatacatcgtaacagtacacccagcgacctccagagtcactggttccatatgtgcaggattcacctaagccacatgccaaccacaagatggttttctctgagacttcttggaaaaataaacccaagaaattcaaatcacttgatgtcaaaggatctaaacagagattgcagactttagctgtgtagctctctggtttgtgagcagaatgagattgggggtggggaattgcactcattattgaacacctcttctgcttgcagtttcagcagcagcagcctagcttccccctaaatgtgacacttcttacttgtcatcacttaccatactttgggaggtattttatcctcttctttatgtgtgtgtgttcagttgtgtggggaagtgaattgagtcttaacattttgaagtaaaataggcttgttttctttttaaatccctctagtcatttagtgaaatactctgataaggttttattaatgaaatataaatagaaggaagattcgttttgaaagcacagtgccatcttagaaaacaccaaaagaggaaagaaaaaaaaaatgaagactgtaccttgatgtcagagctttgggggagaaactgattccaccttgaagggagatgacccaagcttgacagctgcctccacaaggagtcctattagcaaaagaaggggagccatgtgctaggagggccattttctctgttcttcgcatcactgaggagtgttcagcaatcacacttggacttgatacagaaaatgactgcattgagagcccttcttcataagtaagccatatatggtaactaaaaaaacaaaaacaaaaaaaaaacaaaaacaaaaaccctaacacttcccatcacaaaaccaatttttttgaggattaccaggctcgtgttttctctctagtatgtcagggtttgtgatacttctggtcagagtgtggaaagagtttgggctatcagcacaggccatattctgtttgcttcatatgcatttggagacatgaaatgatattttactggttaagtttccgctaagtgcttagattttctttattgcgtttctcttacactgttaaacaaaatattgtgtggctaaatgatttcagcctatctaatttgcttgacaattagacagtcgttctagccttaggaacaaaatatgttcatcataaaaaaattaagaatgtgatctaaagttcaaagctgaaatattaaaacattaataaatagaaagctttaagaactattcactcagtatgcaaagaaacagtcatttctcgctgctctaaattctattcctgcacataaaaggaaaatatatcaagtttaacaattcaatacaaaaaaaaaccctgcaatgtgagttctccaaacaaacatccctattatccctacatacaggtatagccttaggttatatttttatgatttcatttttgaggtatatacaaaacatgcatatggttttcatcactagaaataaactacactgagtcctttgggtttgctttctttatttctttattatatgtttaattgatcacgtactttataactttcagtattttgacattttagagtacagcaatgtgctgtattgctgtaatccacatatagttatatttggaatgatacgttatgcttgagttagaaaaataatttgacacatccactacccataacacatgttcagtggatatcatgcctgccagaaatatttccatttacacactgctagctctcatacataattacttacttgttcatctcaggacatagtgtcagattgtactatgtaatataaaataatcttatctagttgcataatgaattttattatctgagagttgtttatatttgatggcattttccctcttagagaaaatgaattttaatgagagaaaaattgctaacgtttttaaagccagcactcacattttggcattacagcatatttggagtgcccggtgattaggatcactgttctttggtggcagcgtgtgaggtctgtgaaatgtgggaaatggtctgtaacctaatggatctcataagaactatacatattgaaaggtgattaatttaaaataagggatgagttgaggataatgattgctttggagttgagcgaaaagagaggttactatgaaccaaaagagaagatgcatgaagatgaacaaaatgtgaagatgcaccaagaaatggctattgtagtagtagaagcagagagaaatgcagagtgagatgagggggagagagaagactggaggcacaaaaagactttatcaaggctgaatttttattttattttattttattttgagacggagtcttgcactgtcgcccaggctggagtgcagtcgcgccatctcggctcactgcaagctccgcttcctgggttcacaccattctcctgcctcagcctcccgagtagctacaggcgcccgccaccacatccagctaattttttgtacttttagtagagacggggtttcaccatgttagccagaatggtctcgatctcctgacctcatcatctgcccgcctcagcctcccaaagtgctgggattacagtcgtgaaccaccgcgcctggccctgaatgttttaataagcaacaaatgactgatgttcctaaagtaatccattcaaattcacatactttaatagaaaaataggcaaaggacatgaaccatcagtttataaaagaggagatgcagatgatcaatatatgtattaaaggctgcacaacttcattaataagcaacaaaatggaaattttcaaagtaaaatgctaggtatcacatcatattgacaacttttgaaatcccattagggtacagtgaaaagggcatccttgtgtgtggtgacagagagagactctgcttcaaaaaaaaggggttggcggggtggaaattgagacacagggagagaatgtgaagagacacggggagaaggctgcgggaggacagaggcagagattggaggggtcctgccacaacccagggaacatctgggccaccagaagctgaaagaacaaggaagggtccttcctctacaggtttcagagggggcatggctctaccagcatctggatttgggatttctgggctctggaactgtgagataataaatttctctggttctgatccgcccaatttagggtactttttacagcagccctaggaaattagcacagaatccaagtgggacagccgaggtcatgggtggatatgaaactgtagagttcaaaggagagatctggactagagaaataaaatttggagttttcaccggatgatatttcaccagaatagaaattggtacagttttgtggggaagcaatttatagcttgcaccactactcaaacatgagtctcaggtaaattaatatacttagaatttcttctaagggaattttccaatgcagtgatttatagataggattgatggtcacgggattatatatgacagtgaaatatttgggcactacctacgtttccaataatggtgacataaataaatgatggtgcacatttcattaagtgcggttagtcattaaatcctgtgttttcaggaaaagaattcatgacatagagaaatgatgaaataagtggtacagtaaaatccaaatgtcatttaaaataaaaatgtataaaaaagactggataggaatactctgaagtgttagcaattctgaatagtgaaataatgatttgtattttcttagatcttctctatatgttttagattttatgcaatgaaaatgaattatttttagagaaattatattacatgttcttgtattttaacaatttattgagacagaaaaaataaaataggtagagtggagtcccaaagagagggactgattttatgaatcagtaaatgccagtgttatccctggaccagcaatgaggttgctgaataaaaaagtgtatgtttgtgtgtgttagtgtgttgtaaagctaggaaaaatgtttggcagtttgaaagaaatatatctgccaacaaatattcagaaattacgtgccatattttttaaaaaagaaaactttaagcattctttatagtaggagaaacagggactaccgaggtcagaggaaatgagcagagtctagaacctcagggagcaacaaaggatgggcatggtcagcaaccataaccgtaagctgagctctttcagactcctgcaggccttggcctgatgcgtgctctcctgtgcagccacgccacttgtacacagttcattttagtgcaggcgagttatctaaatcccacagtaaacaccctcagtatgactagtgcacaggtacatgctgaatatgtgtctcttcattcatttaacaaattccacatgagcagctgtgataagccaggcaaggttctaagctttggagaacaaaattaacaaaatctctcctcttgtggggcttgctttctgatgggaggagatagaatgtaactaaaataagtagcttatttgtactatggagaaaaataaagctgggaaggtagataaggagtggggtaagtgagacttgtaagtagagtggccaggcaaggcctatttttttttttaaacagggtctcactctgtcacctaggcttaagtgcagtggcaccatcatagttcactgcagtcttgaactcctgggctcaagtgatcctcccatctcagcctcctgagttgggaccacaggtgtgagccaccaccctgagctaattttttaaaaaaattttgtagagacagaatctcactatgttgcccaggctggtctagaactcctggccacaggcaatcctcccaccttggccccccaaagtgttgggattacaggtgtgaatcactgcatcctgccaaggccttacttttgagcacgtgattcataaagaggaaggaagccatgaagacatcaggggaaagaaattcgaggcagagggagcagacagcagtgcatgcaggagagcataagcatgcgtgctctgggaggggacagcaaggagtccttgtggccggagcaggataagcagaggaaggagtgttggcagtttaggtctgtgctggtggggaagccagtgaagtcagatagggcataggggctgctgtaaaaggcttcagcttttattctgaatgcaatggagtcccgtcggaaggttttgaaaaaaggcgtgacattgtctgctttctactgtagaacagaagagttttctgtgcttgtctccagttccttttggaggactaagtgtggctgctgtgttaagcatagaccaagagatggcaagggaggaggcaaggacacaagcgaagagactgcaccgacagcacaggccagaggcagtgatggctggtcccgagtggtagcaggagagagatgggtgggtttcagacgtattttcaaggtaggaccaacagggtttgctgatagattgaagtgtcaagaaaaaaatcaaggatgtctctgaggttttcagcttgagcaactacaaagatggatttgccattttctgagaaggaaactacaggaaaatgaggtccgggtgggagatgaggagaaattaagaagtcgggatttgtttggggactgagaaatttgaaatgtctctgacatctgtgatggatttaattgtgtccccccaaaaagatgttgaagtcctaacccccagtacctccgaaggtgaccttatttggaaacagagtctttagggagataatcaatttaaaatgaggcaattagggtagaccctaatccaatattttataaggacaagaacagaaaaccagacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccaccatggcacaggtatacctgtgtaacaaacctgcactttctgcacatgtatcccggaacttgaagtaaaattaaaaaaaaaaaaaaaaaaaaaaaaaaaaaaggtgctcgggcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccgggaggcggagtttgccatgagcagagattgcaccactgcattccagccaaggcgacagagagagactctgcctcaaaaaaaggggttgggggtggggtggaaattgagacacagggagagaatgtgaagagacacggggagaaggctgcgggaggacagaggcagagattggaggggtcctgccacaacccaaggaacatctgggccaccagaagctgaaagaacaaggaattgtccttcccctacaggtttcagagagggcatggctctacctgcatctggattttgggtttctgggctctagaactgtgagataaatttctcttgttctgatccgcccaatttagggtactttttacagcagccctaggaaattagcacagaatccaagtgggaaagccgaggtcatgggtggatatgaaactgtagagttcaaaggagagatctggactagagaaataaaatttggagttttcaccagatgatatttaaaacaacgagactgtatgacgttctgaaggtgtatagacagtgagccctgggggaactgttgctttaaagggtttgggagttgaggaggaactagcaaagcaaactgaaggcattgccagtggtgtagaggcaaaccaggaaggatagttcccaagtaaataaagtgttctaaggagaaaggaacattcatcttgaccaaatgctactggcaggaaggaatgttcatcttgactaaatgctactggcacattatgtaaggtgaggactaaaaagtgaccattggatttagcaacatggaggtcacaagaaatccacactcatcgattcagataggatcaaaatcctcactggaacgagttccagagaaacttggagaggaattagagatggagaataagtagctctttagaagacttgggctatcgaaagcatcagagcaatgggataccaactggaggaataactggaggagagttgcacaggcaggaatagagagaattgctagggcggcctcctgcacaacaggaaggggtgaaatgtggggcatgggggagagcccgtctcagtggcacagtcatctcagcatcagaacagggtggaaggtggagaaccttggggaattggggaagcttgtgtaggtctcttcttctttttttttttttttttttttttttgtttgtttctaagacagagtctcgccctgtcgcccaggctggagtgtgtggagtgcagtggtgtgatctcggctcactgcaacctccaccttccggtttcaagtgattctcctacctcagcctcccgagtagctgggattacaggcacccgccaccacccctggctatttttttctatctttagtagagacagggtttcaccatgttagccaggctggtctcaaactcctgacctcgtgatccgcctgcctcgccctcccaaagtgctgggattacaggcgtgagccaccgtgcccagccaggtctcttctgattgactcattttcctcaatgaaacaggaagcaaggtcatcagctgagagtgaagatgtggagtgggagatctgaagacagagggggaggcatgaaattgttctgttgtggaaacgaagggtgaatggactgggaagggcagcacaactcccaggcagcatggagggctcgctggaggctgtggccatgcactcgtcagcatggctatgccagccagaggggagtggactcggtgcagggctgtgaccaggtgtcaggggtaagctggggagttgagggttttgtgagggaatgatgggcatgactggctgtagggtgagctgggtgagaagagagaccaggacagaagatgtcaagacctttgttgaatgaatgggcaaagataaaaaaaaagaaactgtcatctcaaacagttcaagtcaggactgcaaaagaggaccaggtgcctgtgcctggtaggaaggaggaccaagatggcttccaagaggaaaagtcttaaagcatgaacggaaatttggacagacagatgagcaggtgaggaatgggcaggtccaaggagagaatgttgtgtgccagtgccaccccagaggcggcaatacaggtgtggcctgcaggtaatgcacttaccaacaggcctagaaactgccttcttcattactgaggattagtaatagtaattattatttcttaattataaatttaatgctcctttgtcactcccagtgtgtgtgtatacacacacacacgagaattatgtatgtaacaatgacatatttacatatgtaagaaattataaaattatctatggctggacacagttgttcatgcctgtaatctcagtgctttgtggggggccaaggcaggaggatagcttgaagccaaaagtcagagaccaacctgggtgccatagcgagaccctgtctctgcaaaaaaatttttttaattagctgagtgtgatggtgcatgcctgtagtcccagctactcaggagcctgaggcagaaggatcacttgagcctaggatttcaaggcttcagtgagctatgactgacctctgcgctctagcctgggtgacagagtgagacctggtttctaaaaatttaactaatgtgtacattgtataaatataaaacaaaagcatattgtctgtctcctccccctacccaccacccgtctccattccaatttccttcttcagatcttatgaacattcttcctagccacctttaggccaactcctcatctgctgggtttcatgcagtattccagaagaccagcctgaaaatagagaactcaagctcttgtatgtttagtctgggttcctgccaaataacgtgcagcactgtcgagaatgatgtgacggacagagcttgatgcacagcatgatggggcaccctgtccacttgcctgtgagtcatgaacatttcatcatagggtttacagttttttgttatagatgtttaatcacaaaaataacagaggccacttacgctaagtatattctgtgaggatcattcttgcacacgaaaggtaacagcatgaccttgatatggtaaggccttggcattgcagaggagaacaggctgcagaaggtaatgtgcaatctcataaactggactccttgtcagcattcttttgatatttcacaaatgacaaaagtcatcaagagaagattccaatggttcagatatttaacggtcacccgtgtttatactacttttgaatgggtgaaactttaggatggggattagttaaatcatgctataaattcaggcccagaaaataatggagaaagaattcccaaagctactagaattctcccacaattgagatgtcagttcacacccacagagggcttctggtggtgacagttggtggaatgagagccaggatcctacagcaacagcccttcatgaagggcacatgaaagctctgaagagtgcagaaagtctcactgtggtcactggatgaaattatgacctccagtttctcagaaaactaaaagtggatccaccattcgatccagcagtcccactactgggtatgtaaccaaaggaaaataaatcattatatcaaaaagacacctgcatgcatgcgcttgtcactgcactgttcacaattgcaaagatacggaatcagcccaaatgcccatcatccgatgagtggataaataatatttatagaaatatttatataccatggactactactcagtcatagaaaagaatgaaataatgtcttttgctttaacttggatggagctggaagccattattctaaatgaagtaactcaggaatggaaaaccaaataccacatgttctcacttataagtgggagctaagctatgggtacgcaaaagcagacagaatggtataatggacattggagactcggaggggggcaggtaggggagtgagacatgaaaaactgcctattggggtacagtgtacactgttttggtggcaggtgcactaatatcccagacttcattgctatccatgtaaccaaaaaccacttgttcccctaaagctattataaaaacttgttttgcaagaaattgaaacttaaattttagaaaacttttaaaaaattatgactctggattcctataaatgtctgcttctgtttggtgttgtatctatagcaacatagtgacaatattaggtagcaatttctgaaccacagctttgaaaatttgagcaatggtgtttccaatttcatttattaaattcttttaaaaagtttagttattaccgatgatggcaaagaacatttaggtttcattaagtgagagttttttatgttatagtattctatgttttctttatctattaatgggtttttcttcttatctgcagtgaccctgtctctttgaagttttaaatccagcctaagttttcaatagttggtttgtatttctaatacgaaattcagaacatccttgatcatgattttatttatttattttgagatggagcctctctctgtcacccaggctggagtgcaatggcgcaatctcggtccactgcaacttcagcctcccaggttcaagcgattctcctacctcagcctcctgagtagcgggattacaggcacccgccaccgtgcctggctaatctttgtatttttagtagagatggggtttcaccatgttggccaggctggtctcaaactcctgacctcaagtgatctgcccccttggcctcccaaattacaggcgtgagccactgcgcctggccatccttgataatgatttaaatccacttttccataggactaagcttgactatctttgacaccattttgaccacattattaactctagcaaataggataaaatataacagtcatacttttaaaaaataccttccctacatccagaactgggtttctgaaaaataataaataggaaaattcatggttgagggacaacattgggaagcaatagcaataggtgacctgtgagaacccgaaaatagttatttcttcattccacataatacaataaaggtgaagcaccacataaacagtccgccaattgtataaacatattttaaaatagtaataacaaatattattcagtagttcgtatttaccatctcctgcttggcagaaacttttcaagaatctgccatttccaaaatttcatgaagatacttataaaagcatctcccttatttctggaaatatgcctattttcccatgtgtctgttgtgatagacaattgttcagagtcattctggttttaagactcagttattctttctctccttgccttaattctttccttaagtcctacctagtgcttttttttctttctttctttcttttctttttttttttttttttttttgagacaagatctgtcgcccaggccggagtgcagtggtatgatctcagctcactgcagcccatacccgccgggctcaagtgatcctctcatctcagtctcctgagtagctgagactacaggctcatgccactaggctcagctactttttttcgttcattttttgtagagaccaggtctccctatttttcccaggctggtcttgaactcctggactcaagggatcctcctgccttgacctcccaaagtgctgcaattacaggatcaccacaccaggcagctattgcttcttatctggttccttgagatgcagagtaaccgggctgctttgaatgaaagaaggcttggaataaccatcatttaacctatttcacttaacccagccccctgtctgtcaataaccaggtttccctagcctaagctctatctgtgattccttcctgctaaagcacaggcctaagggcctctcacaggagagtgcagttctctttctgtcttcctcctttcccttcatattaattggttttgttgcaaaaacccgtatttctttaattttttttattttttcccttcttttcatggaagtcataaaaacctggtcattctatttctaaccccggttctctctctctcttttttctttttctttaacgtttttccaacaagattgtctgtttatgcatatcctctgtatctggaattgtcccaatgacttcaaatatgtgggggtatacatttttgtgcactaaaattttgaataacaagaatttttgtttgaaagggatcatggcatcctattttaattaatctcaataacaaataacttgttcaattctagaaccacagtctgtcatatctacatataacagtaatagcagttcagatatgtaaaacttgttattgctcatcctgtaaggcgaagaaaacacattctgctgatgtctttgttttcaatactttttctctcattcattgtgatcagggtggtaatacacctgttttaatttatttttgatcatttttcctattttgttttgtttttctgaaagaccaaaactttcatttggttacccctttcaaaaattttgttttttgtttttctttcaactgttgacatactctctctgagacatatggtaacatattatttccatggggcatgcctaggcattttgtgggaaattacatgtatttcacagaagtagatgctctttttgaccaatatttttattttaaatgctattaaccaatatgctgttaatattcagcaagagtaatcaagtaactcgtccagtgaagctgatgggattcttgagagagtgcaaggtttccctctctggagaatctgttgaaggagggtttttgcatatatgctggtttaaaggaaatggaggtgttgaactttagaaccatgttgcttatggaaatagcttcgcgtagagtaactcttagtccattttgaaaccctcttccctagaaatttctatctctttcatttaatactgtggcaaggttaataatatttacacatactttcttctgtgttgtgagatgttagtttaagttggaacatgctggcttgtcattttctaaagtgaatcagtttatctttggtttagcctgaaattgcagcagagagtacgcatcctcctgggatctgaatgtaaaataactgaaacagattgaagttggcagtgactaatgaagtcttgcgcataagtcggcaagtcagtaggtttctgcgtatcaagaaggaagagcagaggaacccgagcccctggggtctaggcatttcttccttcttccccctgtgcccagctctgatggaggaggggaatttaaccacagatattccacctacattctttctaaagacatcaaattcctagtatacaaattcgttacattactggtaattcccagctagcttccttgtttaacgagccgttttagctgcctaaaggtattctacatagcaattttaatcagtcatataaaattgatgaagctgagataccagggaaaattagaatggttatattgtttctttgataactccttccgcaggctggctacactgttccacctttagtgccctggaaatgactccatgtcaccaatttacatagtaaagaccactttgctcatagctgagtctcagtatgcccagtgaggctttgtgttgttttgttttgtttgtggtcagcattcatatatttccgtacatcactacacgtatacacctttacttcagaaaatgccagattaatttctttgtttctttcttgaaatgttttctttttgcacttttttttaaccattaacatggtatcagggatccatagtatcgcgttgtatttacaagattacagaaatacaatctgcttggcacatttagaaatatgttttgaaagaaattggtgtgctgttacccttcggttcagttctcccagcccgttcccacatagagagcaacaagatttgtgttttccagctcattaaactgacagcagaaattagattgtggtattaaaaactaaaaagttaaattacagctacacatgtcctttatgcagtggggcgtgtggaagatgtttgattttaatgtttgctataatggagaatttaaattacaatgtttgtcaaatctctaatctttgttacagagtggaatattaattacgcttttaactatgagaggtaaataaaatgagcatccactgcacgcccaggggtaaattgcagattaccaacaacgtgacataatgcactaaatgtcagttttgtcaaacaaatttagaagaacggttaaactattagcttcctgttgttctagggcctttcttgcagcaagcaactattgggagcagcagggacactgtgccttgtggaagactaagggagttaaattgaataagcaagatgaatggggagacagcaccacagaggcactcaattagtttataactgtctattaacttctgtaggtggttttgaataaacagcagattatctgttgcactcttgggggacaaggggagccatgggagagggtcagtgtagcgctcaaaggaaagagattttttgattctcaattgccctctgtcttctcctttcctacttttgtgcatgaagcatgggtaatggttgtcaaaaccttctacatgtttaaaacttacacgcatacaaaggagcagtgcccgccttgacatttctcttggcagttcttgcatggaacactggtgtgatgcccccaaagaataagttgaatttaggttctttggctactttttcagaacatgttcttgggaaaagagtagtaactcttggttcttagaactcaggaagataaaacctctccatgaatgatcatagccaggatttctttccagagagggctgagagtgtggagggaaactgatggagctctctgcatcatgcagtacatcctggagacttgcagggcgtgggaagtccccttgcttccagtgaaggcattgtttctagcttcagtgtttatgcaagttctaatctcctgatgcttaccttagagtacatttaggaaccagtgctctgttaatggaaaaactaaattctaaaagatttttaagaggcttattctggccaagcccggtggcttacgcctgtaatcccagcactttgggaggccgagacgggtggatcatgaggtcaggcgatcgagaccatcctggctaacatggtgaaaccccgtctctacttaaaatacaaaaaattagccgggcgtggtggaggacgcctgtagtcccagctactcgggaggctgaggcaggagaatggcgtgaacccaggaggcagaggttgcagtgagccgagatcaggccactgcactccagcctgggtgacagagcaagagtccatctcaaaaaaaaaaaaacttattctgagtcaatatgagtaaccgtggcccaaggaaaaacagtcttaagagatcctgacaaagtcaagagagtcagattacagttttctacattttggagaggaaggagttacaggcaaagacataaatcaatacatggaagatattgattagtttagcccataaaggtgggatatcttgaggtggaggcttacaagtcaatagatggattcagagattctttaatttgcaattggttaaaggaacaaaacttggtctaaaaacttggagttagcagaaaggaatgttttaagttaagataagcatgctatgtcagagtcagccacaatatgacctgcttaacaaaagcagtggcttgcaggcatgacttaacccttgccttaggtattgtttataatttgatatatcattaccacaaagagtatgtttagtcaatcttatgatctctattttaacattaatgctggtcaattattgtgcctaaactccaaaagggggcgctataacgaggtgtgtctgacctccccatcacatccaggaactcaggaaaatttttaagatttttctgagttcctcttggctacaagtcagtggggagcttaggattttcttttaccgcatggtacaatcactagatcattataaagaattgcaaattttaatgaaattgctgaagaaacatggtgagaattaaaggggaaggagataaaagattagagatgaaggaaaaaacaagaccaagaagatgtggaaactatgagtgatgacttccgaactttaaagtatttttagtgcttctgaatttatgtccttcaaactgtgtaccaacttgcttttttgagcatgcagacattacataatgcaagccatttatcagagttcttttacatagcacagaacagtcataagatactcttacttttcaacacacatacacacacatatatcccacaaagggattcatttttcttttgctattttgaaaaggctgagaaatgtatgcctccaccagcaggattggggcattctttatgtgaacctgtcccacttaaaaccagttgtcaaggagagaatcaagataaaacacagtgtgtggtgggtggatccactaagtgaggaaagcttattaggaaagagttaggaaagctgtagttcctcctgaataagactcctttgagaaaaagagccaagacttaatctaactcttgggtatctgttttgacacctgtgtctgtaattgctggtttgctttgtaataggggtgttttctttggtcatccattgaattacctttaattcaattaccattgaattacattgaatcgatgctcttaatacctaagttttctttgagctaaatgtaagcatttatgtgctgatggatgttattaaaccctacatctcctttataatcattcatgagatccatcagcatgagggcagtttcttcatcaacagactgtacaaaacccttatgaggtaagatctcagtgaacaaaatgagaataatcagatgaaataatagtcaagtgattgcccttgaaaaatagaggcacttgatacaacttagacttgaagtctctttttttttctgtttttcctcccactaaactattgcagatttgacagggtgtttattttgcaaatatgattggagggatttgtcaaggaagactaggatagcaatggtcatgaagaaaagcattatccaaattataacccaaagtttactcacccatttccctgtgttccctggcactttgtggagcctgtattgttgtcgctgtgggggttggtttcacatgccgtctatcccagtacctgtgagtttctcagaggccagggctgtcattgtcaccctgcatcccaagtacctagcccagtgctgagctcacaggggatgcttatgcaatgttgaatggattgttaaaagaaaaatgttagacaaattaaatttaacagagtttaattgagcaaggaaaaatgattagtgaatcaggcagccctcagaataagagcagattcagagagagccaatgctgccatgaggttggagaaaatttatagatagaaaaacgaaagtgacacacagaagacaaaagtgaggtacaacagctccattggttacagcctggcatttgccttgtttgaacagttgtttgcctgtgagtggatgaagtctggtgctgagtttgtctggggctcggctattgttacagaagcacactcctagctcaggttttcagtccgctgatactaaatcaagtttagcctaaaccttcctccttacatattttaattttggcctacagatttccctgtgcatagtgaactgtaacctaaacagactgtaacctaccaatgattgtgattgtgccaatcaccaagtcttggccaaaggtggccaactgctcaaactgggttcaagcaaggcaaataccacactgtacccagttcattgtttctgtacctcacttcagttttctgtatgtacctcacttttctttttctgtccataaattgtctcccaccacgtagctgcactggagtctctgagcctactttggcttgggaggctgcccaattcaagaatcattctttgctcagttaaactccattacatttaatttggctaaagattttcttttaacactgacctgctaagataagttgtggtttgtccataagaactcaagtatgcaaatatggaggttttttcaggccagattttggttgatttaacagaatgaatactggaaaagacacctttcatgggtatccagatatccaagaagaaatcacagtgctgtttaaaacaaaattaagccattagggaaagtttttgtctcatttttccctcctatctgttgagtccttaccaggtataggaactgtgctttacatgtattctcatttcattttcatcaaccccctacaaagtagatgacatgctttctctgtcaagcatatgaggaaaccaagattttacaaagtttccatctctttcataaggaaagccggaactgacagagtatgggggctggggacgggatctcttccgattgccatttactcattgaaataagttttcatctgagcggggacagagaatggttaatggaggtagaaggaggtaagagaaaagggaaaatcagttttcctaaaatgtaatgtctgtcatattattctcctgctcagcaggactttccttgtctaagaattatgtacccacttctcagctttgcctccaaggcattccacagaatgacaccagggtttcactataggcagcttatgccttatttggttttctaagcattttttgaactgggcatggtggtttgcacctttaatcccagctgatcagaaggctgagacagaaggattgcaagcccaggagttcgagaccagcttgggcaatatagtgagaccccccatctcaaaaatagataaataataggctagtgtggtggctcacacctataatcccaactctttgggaggctgagacgggcagatcaccctgaggtcaggagttcgagaccagcctggtcaacattgcgaaaccccgtctctactaagagtacaaaaattagccgggcgtggtggcacatgcctgtagtctcagctactcgagaggcttaggcaggataattgcttgaacctgggaggtggagattacagtgagccacgatcgcaccactgcactccagcctgggagacagagcgggactctgtctcaaaaataaataaataagtaataaataaaaactggttgactaattataaataaactgaaatgcatagccatgtggtagtaattctaagagtcaagagttaattcttgtgtcttatcaaaatgaaatgttaaggaaacatcaagtcagtggcctaaagttggatagattaacaaaaggcttttctattttctgttcatctaagtcaacctcaaatattacagatattttttaaagaactacttatttttaaaggactaagaattattttcaaagaagtatgtcttcaagcatcatgagcagaatgaaaggccgaatgctctccttgtgacaaagtgagtggacagacccatccgcagtgcagcatgcctatcaccagccaccagcgcagtccaaagttacatgattgaaaaagaaatttgcacctgattgaagatgctttgggctcagttttgctgtcctctccccacagaagtctaagctgttcagactgctcaagataacacttcacacagtttaggaattgtggtttatgtcgaacgccaatctatatcagctttcataacatttaatatggtggggggagtgataggtgtttgagaaattaagcaaaaccataaattttctcttggtatgtatagtatatacaaggagagctttcgagtaccttcttcctagtgttctctcttaactcttgatgtgagtgaaaagcttcatccattgcatgacacagactaggtcattgtgtttgaattccttgggttggggagaagtatggtagagtctttctcctcacttcagaaatcaaaagaaagtacagtacctgcttggtaggtattccttgaaagttgccagcacttttggctagacagctcccagataagcagatggcttctttaatgatgaaaccccacttttctacaatgctaattagttagagaaagataatttgaaagtctgctgtacattgcaggaaatgtcttttgtgtctgtgtcatttgcttctaagaatcatgcaactgccacctgagtaggctccagttttctctttttatttaaatcttgtgactcttcaatcacaagaaaaggggaaagacagtcaatgaggaaaaggagaaccctctttcaggatgaaacactcaattacaagtgcagctatatttctgttttcaaaaatcagccttattgttatgttttgaactatacatttggaacagtctcttcagtggcttcatatggcgtgtgcatctcaattcatttctctacagattgccattgagacttggaaaaaccagattgcccatttgaaagctggttctgactcagcttgtcaagccagccatcctggtcagaatgtattggggaaaaaaatgaataaaagtaacagagacctggatttttattctgatcccacacttgattcatttgtgacccagggcaagtcacataaccttttatatatgattccttatttgttatgtggcataatatggttcatccctaccttacttatttgttgaataaacccttcatcctgtagaattcccccacattccaaactcactgatgcattcttatgctgtcatttaacgcgtccctcagttatctggacttgctgtgaactggggctagcactagaggattaattgattcaactttcttattttggtaagaatttttcataagtagtgttctgtacttcctcttgcattacattaggaagcatataaggctgaacttgattagcgagttgcagttttgccaacctcatccatccattttaaagttccacatcagcccttcacttaatggttttttaagctactggtgatgattgcctgatacattattttattagggatttcaaaatggtgacatcttaattctgtcattccttctgtatttattaagtgtcattctctactcacctgctaggttactgtgaaatgcagttcatataggaaactcaagataaatgtctgaagtttattcttcttatttaccaatttcagaatgagttggtgccttaggattttgtaagatgaccagtagtgtcattatcagtgattttaacatatgtgatatgtttgaatattttagagtaattactgtttggatgttcagagtatctcacctttggccaataggagttcattcaagttgtctcttgtatttttttttttaacataaccccaaaactttggagagcttctggtacaacaggatgttcttagctcatcttctgtattgtctgccccatggctggaatcagtcatttctctaataaaccctggtttcttttactggaaaatggcatttagagaccacaatctgaccacaaggggagctcattgaagtgggtcagccgttgcttctaggctcacatcagccactttcaccatcggtagccctgctgtctgcttacctgacatgccagcagctaactcatcccctttgtctgtgttcactaagcagagaaagaccattggtaaatagtgaaatataagagaatatctttatgacctcagggtagggaacgtcctaaaatcataatagacttaattgatacatttgagtatatcaaaattataaatttctgtataccaaaagataaccataaacaaaatttcaaacaagctatagattaggagaaaacatttctaatacttatatgtcaaagtatcagtagcctaaatataatgaatttgtagacatcaacaaacaataacaacccaatagaaaaagggatataatatataaacagacaactacagagtaggaatataggctgaataacatttgaaaagatgtgaaacctcacatataatcaagtatatgcaaatcaacaaattataagatgccatcttttcacccatcagattgaggaacgtttctgtaacagatagcaaatgttggcaaatgtgtggttaaaaaaaaaatgcatcactccgttaacataacacaactttggtgatgcttttgagacttcattttaatttttgaaaaagcaatcccttctgttccccatcattcccacctagcccccaatatcccccccacacacatacatacaaacacaaataaatagcatgtaaaggccaaatcgtttgctttctacattcttattaacaagtaagaacctttcactaccagtatactcaagttctgcaatatagctagttcatcttgagatctatatctgtgaaacaagaaattcagaatcagatctaaagatttttaaagtgtgatttttatatttttcctaggagaaaaaggcattttttacaataaagtgacagttgtttaggataaattaataagaaaatgtaggcccttgttgggaagaattgttgatagatgggtgttttagaaaagccaaatggttagtcaaatgaccacagaaatgcctgtaggaaataaaatattaaaattctgaacactgtttgattatatgccttgtattagtttcctgttcctgctgtaaataaattcctacaaacctagtggcttaaagcaaaataattatcttatagttgagtaggttagaagtctgacacaggttttgcttggctaaagtcaaggtgtcagcagggctgtgttcctttctgggactctaagagagaattcatttcctggccttttttccacttctggagactacccgcattccttggcttgtggccccttcctcatctccaaaggcaggaagggtgggttgagtgctcctcacacccatcattctgacctgctgttttgcctcttaaggtgtcatgtgataacactggcccacttggataatttaggataatcttccttttttaaagttagcttattagcaacctcaattccaaccacagctttaatttcattttgccaagtaatgtaccagattggtgcaaaagtaattgcgacttttgtcgttacttttaatggcaaaaccacaattacttatgcaccaacctaataaaatatattcacaggtttcgagattagtaggtggatgccttcaggagaccattctgcccagtgaatgggatctgggccctccaaaaagagacatccttttctgggttatcattcatgcacctgaagcaacctcttttagttactgctttccatgccagttgccagggctcctgaacaaacaggaagtatttactcacacataaattaatcagcatctatgtttttaacttggaatagaaaggttttttaaaaaaaattttcatcctttgtgtttatgagatgcttggatacttaattctgcacatccaagggatcacttggattttatgaagtcagtgcttaaagtgggatccagaatatgcaattttatcaggcccccattgtcctatgtgcagacatcagtggcttgccttgtttctattacatagagacattccagaattttttagcgagtttaacaaacatcatcaagaggaaagtggaggtagtgttccaatatgacatgcattaaaaattcttctctttctcacttatatttatagtctgatagaggatcaacagtataccaatttaatcttgctgcagagtgacatttttgaaaccattaaatttccagataatgtgcacatgtggaattcagcagcataagccagctgtgagtggggacccactatcactaatgtcacttgattcccatcttgcttgactatggattgtaccagtttcatatttcttgcactgtcaccggttccagcccctctggattcatattgctgtgatgtgagaaataaaactaaacaaaatattactaaggatgacagatactacatctattatttttatggctgacttatttcagtgtttaaaaatcttcggttggtttggggaatggcgttaggcgctcacgtgagctgtgggttactcccaagtggagggtgttgtttcaggagggatctatttgcaggtggatattggagggcagaatgcctcttatgtgcaggtcttgccacactgtgtgttcagaggagcccagctgaagacacggtggaactgatctgtatggggcactcctgctccaggcccagggactgatagaaaatgagagggaaaggaggaaacagagctcacaagtttttccttggtgggaacgatatctaagggacttagggaaggtgccccagccagatatataatgagagacagtgatgattaagtgcatttcaagatcgacccaaaggcttttttccagggctgttatattgtcatatgaataacattaaattcaagttataaatgaagttgttttaaaatatgtgtatatgtgtgtgtatatgtatttatattcctctttatcatttagaaaaaatcagaaataggctgggtgtggtggctcacacctgtaatcccagcactttgggaggcgaggcaggtggatcacgaggtcaggagatcgataccatcctggccaacatggtgaaacccaaactctactaaaaaaaaaaaaaaaaaatacaaaaattagccaggtgtggtggcatacgcctgtagtcccagctacttgggaggctgaggcaggagaatcgcttgaacctgggaggtggaggttgcagtgagccgagatcacaccaccgcactccagcctggcgacacagcaagactccgtctcaaaagaaaagaaaaagaaaaagaaaaattcagaaattaaaatatatatacctatgaagtggttaggtgttttcaacttccaaggtctttttctttcaacaacttgaaaagtggtagaccataggatcaagccatgaaatgtgagagtcgtcaccaagccctgagctggaaccttcaggatcattagacatgcatcagtcagtgtccgtctgtctgtctgtcatgcctctctcttatgcacgattatgtttatcatatattttttatgatcaggaagtaaggtattaagattaatcagacaagcagaataagaacaaacaaatgtttggtgagcgcctaccacatgccaggcactttctaacaggagatgttagaacagaagaggcataaagccctgtcctcacccagctggcacgtgatgtttgcccaggagcatagtaaaatacctgttggctaagaacaaaaacagtggcttccaagtacgtaaggataatgcttactaaccagagattcttttgaaattaaagagtaggaaaatgtttccttttgatccattgaacactctacagttagaaaactttaggtactcgtgccctctccagaaagcagcaggctcttttcttaattttttagttctgaaaataaaaattatttaacatataaggatattgggtgtattttttatctcacatgttggtttagcatatgattccttgaattttgttgccataaataacatcatcatgattcttttgtttattgtaatttaattatcatctcagagtcatgcaagacatttgtgtcatggttttgaggtgatcatagatacatgtaatttcaacttgttttaaaagaaagccaatcttttccaaatatttgattttcaacttgtaagtttgagaaagactaatttttattatatttgtataatatgactattatttgaacctcttcaacatgaagtacacatggttatatatatatgtgtgtatacacacatgtaccaagagatcctgacagttacttgctgaagagatccacacacctctttgcttcttttgctctggtgcaagttcatttgcagacacctttcctcaccagtgactcatcgtgtggtgttgttaccactaggtcatctgaaataaagttgtagcctaaagcgatatgtgaataaaacccatacccgtttctcacttggtgaggtaggaagatacatatccaagtccttctgtctggtttctttttagcctatcagcctttctaagagtccttcagtctgtcatttgatataaccccatggtgtaaagaggtgaactctacaacagaggcccaacaaagataaaaaccctgacttgtcttaaaaaaaactgtttttttgtgataaatgtatgtctgttaactagtgaatgaagaacagagagtggctgggtaggtagtgtgtgccatagtttgttgtctctagagtgggcttcttaagtgatgatacagttagcgatgttagaagaacactttcacctcagtcaacagctataaagtccaagctgggaactttatggacagtgtccagacataagcaaccataagtgtagctagtgatgccaatagattccagattcccaggatcattttatctcaacatgggaaaataatgccagatgtctaaagttctctagccatgtggccatggacagcttagcaccactgtgcctcagtttccttctctggaagatagggataataatggcagtttcctcattgggcttttgtaagagttaaacgaattaatgaacataaagtgcctggcatggctaatctgaagccctacataaatttttgtaattactattttcatgttgtatttctgtcaactgttgcagtgctggttcttttgaattggaataattaaatatcagaccactatgtttctttcttaaaattttacctttaaatgcaacaggatctgctaattcttacagatccatctttaatgtgacaacctcttattcattctggtttatttaagtggatcttgtaatttggtataatatatgcattgtttgactaaaccaataataatttcatcccttctttaataaaaaataaacacttattcttgttaccagctcctactgcagcccttaattaagtctaagcacacacgtaattgtagatgccaggaccaaagagccatttaccctttcattcttagtttatatgtgatttacctttccatgagttttgctatccctgtagtatttgaaaaacaccttttctgtggccaacagtgatctttggctcagtgctaataagcatttccccagtgacaatctgttgacataacctagcatggcagggtctatcacagagggtgggggtaatcaggctctggggaaccatggcctgtgaccttgaatggcaatagaccaggactgggaggagcatccatattgaatccactgatacccatggcagacgggcccatccatcctgctcctctcccaattgccactcagtccagtttcagagcgggaaactggaggaggagtgatttcttcttccttccagccaggtggcaatttgttctcctagttggcagcaatttgtcctgcagctctcccataggacacattactgaagagttcattcttcaccatggtttctttatcggttgtgattcatacccatcataaacataataacttgccaagaggtttttcttccatttcccttatttccatttcatacttttaaacatttttactgtagaaaagaaatactcaggaaatagtagagtataataaccattcctttaatttgaattcagcgcgcatttctctcctgtcctacctttattctactttacagtttttgagctatgacagtttttctccctccaattatttttctaaacagtattgcaatgtttaataaactatttttagagcagtttttgtttcaccacataagtgagcagaaaatacggagttcccatatagttctaacacccccctgccaacacacacacacagtatcctcatttatcataatccgtgaggctctattgccacatcattatcaccaaaggctgtagttcacatcagggttcattcttcataatgcacctactatgggtttgacaactctataatgacaggcatccttcattatagtatcatataaataagatcacagcctagaacctcctctgtgctctgcctgtttatccctccctttccgttaacctttgacaatcactaatccttttactgtcttcatagtcttgcctcttccagagtgttatgtagttggaataataaaatattaggtcagtgcaaaagcaattgcattttttgccattatgtagcctttcagattgacatctttcacttagtgacacacgtttaagtttcctccatgcctgttcatggcttcatagcttattcctttgtaacactgaacaatattccattgtctaaatgtaccacagtttagccattcacctattgaaggacagcttggtttcttccaaattgtcagttatggataaagctatatgaacatctctatggaggttttgtgtgagcataagttttcaaatcctttgggtaaatagcaaggagcataactgctggatcatatgggaagaatatgttaatgttgtaggaaactgacaaactgtttttcttttttttgagatggagtctcactctgtcacccagtgacagtgcagtggtacgatcttggctcactgcaatgtccgcctcccaggctcaagccattctcctgcctcagcctcctaagtagcaagtaccagagatggggtttcaccatgttggcaaggctggtctcaaactcctgacctcaaatgatccacccacttttgtgaagctccccacgaccctatattggactgaacaaaagaggacgaacgtgggaatagaagacaaagacaaaagagtatatttggaagaaggggtcagggggcaccttgcttctagtgaacaagggccctgagctgtacacagccttccatatttattaggcaaaagagatagcaaggaggggggtggtggttgtcaggtaattgtcagtcggccatttggttcacagcaggcttgtgagactgcattcctggaacaatgggtactagatgtctcaggagataacttcaaggagtcccgcaccaggaagtgatggtcctcagcaaaccttttggcgacaggagcagtttgagtttgcccacatcctgcattcatgataaacagtttgctgtttgatcatatagcctccagtggaatgctgagctagtcacaatccctttgccggcacactacacaccttggcctcccagagtgctgggattacaggcgtaagccactgtgcctggcccaaactgtttttcaaagtggctatgtccttttgcattcctatcaacaatgaatgaggagtcttgttgctctatattcttaccagcagttggtgatgtcagtgttttttagattttggccttataacagatgtgtggtggtatcttgttgttctgatttgcattttccttataacatatggtgcagagcatctttttatatgctcgtttgctatgtgtacatctttggtgaggcatcaaggtctctggcccattttttaatcccattgtttgtgttcttattgttcagttttaagagttatttgaacattatggataccagttcattaccaggtatgtcttttacaaatattttctccaagtttatggcttctttcttgacagtgtctttcacagagcaggaatttttattggaaagatgtctatcttatcattttttttcatggattatccctttaatattttaactgaaaagtcattgccatatccaaggtcatctagattttctcctatgttatcttctaggagtttcatagttttgcattttacatttaggtctataatccattttgagttaatttttgtgaagggtgtaaggcctgtgtctagattcatttttctgcatgtggatgtctagttgttccaccaccatttgttgtccattgtagtacccttgcttctttgccagttgatcgtatttatgtaggtttctttctgttctctctcttctgtcctagtgatctgtttgtctcttatttcaccaataccacactgtcttgattactgtagctttatagtaagtctggaagtcaggtagtatcaatcttccaacttttttctaatcagtattgtgttggctattctgggtcttttgcctctccatatagaatcagtttgttattaaccctaaataagtttctaggattttgattaggattgcactgaatctatagatcaatttgggaagaattgacatgtggacaatattaaatctttcatttatttagttctttgatttctttcatcagaattttacagttttcctctatactttttgtacgtatttgttagatttatgcctaattatttcacttttggagatgctaatgtaaatggtattacgtctttaatgtcaaattacagttgctcattgctggtatataggaaagtattgacttttgtatattaacctggtatcctgcaaccttgctacatttgcttattagtactaggagctaattttgttggttctttcagatttttttacacagacagtcatgtcatctgtgaacaaagagcgtttcattcattccttcttaacctgttgatattttcattttcttgtcttatggcattagctaactgagacttccaagaggatattgaaaagtattggtgagagaggacattctggccttgatcctggtatttgtgggaaagcttttatttttgcaacattaagtataatattagctatagcgttttagtagatcttttttttatcaagttgaggggtgttcccctctattcctactttgctgaaaacatttatcaagactgggtattggattttgtcaactctttttctgcatctattaatatgaccatctgacttttcttccatagcctgtcaatgtgatggattgcattttttgagtttcaaatgttgaaccagcctcccatacctgaaatatattctacttggccatggtgtataattatttttataaattgttggattcaatttgctatactctgttgaagatttttgcatctgttttcatgagaaattatggtttgcagttttctgtttctgtaatgtcttcagttttggtattagggaaatgctggccttttagaatgagctaggaagtattctctatttatgttctgggagacatggtagagaattggtatgattgccttaaatatttggtagaatttaacagtgaaaccatctgagcctggtacttcatgttttgaaaggttattaattattgactcaattttttaatagctataggcctagtgagattgtgtgtttcttcttgtgtgagttttggcagattacacctttcaaggaactggtctatttcaaccaggtcatcaaatttgtaggtatagagttgttcgtaatattctttattatccttttaatgtccatgggatctgtaataatgtcccctctttcatttctaatatgagtaatctgtgtcttctttttttttttttttttttttttagcctggctagaggtgtatcaattttactaatcttttcaaccagtttttagttttgttaatttttttctattgacttcttgtttctgtttcattgatttctgcactaatttttttttattttcttctaccttctttagatttaattttatcttcttattttagattccgtaggtgggagcttagattattggttttagatgtttctttttgtctaatatgtgcatccagtgctacaaatttcactctaagcacctcttttgctacataccacaaattttgataagttgtattttaattttcatttggttcaaaatattttttaaatttctcttgagatttcttttttgacctgtgttttacttaacatgcatcttttatcttccaagtattagggatttttccagccattttcatgttactgatttctaatttaattccattgtagtctaacagcagacaccgtatgatttctattctttttaatttgttaagctgtgtttaatggctcatgatgcggtctatctggtgaatgtaccctgtgaacttgaatataatgtgtattctgctgctggtggatgaaggattcttaagatgtcagtaatatccagttgattgatggtgctcttgaattcagccatgtccttactgattttctgcctgctgagctgtccattactgacagaggggttgaaatctccaactatagtagtggattcatctatttctccttgcaattctatcaccttttgcctcatatattttgacactatggtataggtgcatacacgttaaaaaattttatgtcttcttgaagaattgacccttttatccttatgtaatgcttttctttatccctggtaattgtttttgctctaaagtctgctctgtctgaatttaatacagcttattccagttttcctttgattagtgttagcatggtacatttttctccatctctttacttttaatctatgtgtctttatatttaaataagtttcttgtagatcatatgtagttgagttgtgtgttttaatctgataatctgccttttaattggtttattttttatttatttttttgagatggggtcttgctatgttgcccaggctggagtgaattggtgcaatcttggttcgctgcaacctctgcctcctgagttcaagcaatcctcccagctcagcctcccgagtatttgtgactatgggtgtgtgccactatgtctggttaatttttgtatttttggtagagacagggtttcaccatgttgcccagggtggtcttgaacccctgagctcaagcagtccacctgcctctgcttcccaaagtgctgagattataggtgtgagccacctagtgcatagcctaacgggtatatttagactactgacatttacatgattattgataacattggatatctttttttattactgttttctatttgttgctcttattctttctttgttcctgttcttttactgccttttttggttttaatggagcattttatattatcccattttgtcttctttattagtttaatgttttgttacttttttcagtggttgccctagagttcacatatgtttacagctagtccaagtctactttcaaataacactgtaccacttcacaggtagtgaaagttcttataatagcaaagtattccattttcctctcctgtcccttatcttattgctgttactcatttcacttgtctatagctataatcatcaaatactttgttgctgttattattttgaacaaacttctttctgctatatcaattaagaattttaaaaaatgttttattttacttttactaattccttctctcatgttcttcctttctctttgtagctccaagtttctgatctatcatttttcttctctctgaagaactttttaatattttgtagaaggcagatctgctggcaactgattccctcaatttttttttttttttttttttttttttttttcctgagacagagtttcgctcttgttgcccaggctgcagtgcaatggcacgatctcagctcactgcaacctcaacctcccgggttcaagcgattctcctgcctcagccttctgagtagctgagattacaagcatgcgccaccatgcccggctaattgtatttttagtagagatggggtttcaccatgttggttaggctggtctcacactcctaacttcaagctatctgcccacctcggcctcccaaagtgctgggattacaggtgtgagccaccgcacctggcccagattccctcaatttgtatttgagaaagtctttgtttttccttcacttttgagggataaattcacaggacacagaattctaggttggtggctttttccttcaacataatgaatatttcacttcactttgttcttgtttgaatggtttctgaggagaagtgcaatgtaattcttatcctcactcctctgtaagtaacgtgttttccccccttggattttttttaagactttatctttgtctgcaatttgaatatgatattactaggtgtagattttttggcatttatcctgcttggtgttctttgagcttcctggatctgtggtttcataaaattagaaatcagtaatagaaaaataactggaaaaatccaaaatgtttggaagataaatgacatgctttaaacattagttttaggaaatagttattattgcttcaaatatttcttctgttcctttctcctccttcttgtattcccattacatgtaagttacaccttttgtagttgccccatggttttgggatattctgacattttgtgtgtttttgtttttgtttttgtcttttttctcttttcagttttggaggtttttactgagataatcttcaagctcagagattcttttctcaaccatttccagtctgctaatgaactatcacaggcgttttcattctgttacaacgttttttgtctctagcgtttcttttttggctttcttagaatttccatctctctgcttacattacctatctgttcttgcatgctatctactttatcaattagacattagagctcatagcatactaatcgtggttgttttaaattcccactctgttaattccaacgcctctgccatatcagagtctggttttgttgtttgctctgtctcttcacactgttttgtgtgtttttttttttttttttttttttttttttttttgcgaagctacacatggtgtattgagtaacaggaactgtggtaaataggcctttagtaacatggtgtaaggtgtggggggaggggaggcactctgtagtcatatgattaggtcttagtctatagtgaacctgtgcctctggactgtggacttcacaaatacttctcattattcctctcccccaccgttagttgggataggatggctaacgtgggatggagttgtatttcttcccccaggtcagttaggctctgacaaaagtctggcaggttaggtactggtaaacatagcttctcttttttttttttaatttaattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaagagtccccagagtgtgatgttccccttcctgtctccatgtgttctcattgttcatttcccacctatgagtgagaatatgcggtgtttggttttttgttcttgcgatagtttactgagaatgatgatttccaatttcatccatgtcacatagcttctcttaagagcaggctttgttaagaacagaacaaacctgctgactgctgatgtatttcagagtggctacttaccagtgcttcttgctggaggcctgaggggatttgtctcaaatcttctctgtgaaaacctggtagggttcctggaggtaaaactcacaaaactgtgtgagcccccttaaaactaattccccctggagtttttacctctaagatgtgtccacactgagctccagcagtttgtcagctacagtttaggttttcctggctaggttctggctctcacagaggtttctgttcatgaagttcagctccagtaagttgtgattctctgtatttaccttttggtctctccaatttggggggcagtggtttgccctgtagcctcagttctccaacaaatctaagaaaagttattaattttcagttttttcagctttgacttactgttaggaaaaagttatgacttccaaactcctttcatgccaggctagaaaccaccaagtcctttctttaaattttaatgatctatttatagatattcgtaagaacctttaatttaattactaagggcctttgagattcatgcagtgcaagtttggagattggagattaaaatattttcggcaaaccatttgttgtaaatcaaaatggaaaataaatttacttgtgtctttacataagattgcaaagaaaattgtttcaactttagttttcctacacaaaagactttgtttcattaagttcacaaagcttttctgatagtgttccaagttttcacttgaaaaaagtaaggtctgaaacgggaggctcaaaagagggagaaagaaaaagagagaaacaaactattacttatcgacaatcctaacagagtctctttcttgatgtaaccctttcagccatctgtagttatggacaaaagcatttgacctgtacaggcatacattgatttactgtgcttcactttatggctcttttgggtatattgtatttttaatcaattgaaaggctactggggaggctgaggtaggagaatggcgtgaactcaggaggcagagcttatagtgagccgagatcgcaccactgcactccagcctgggtgacagagcaagactctgtctcaaaaataaagagagagagagagagagagagggagggagggaggggaggagagagagagagagagaggaaggaaggaaggaaggaaggaaggaaggaaggaaggaaggaaggaaggaaagaaggaaagaaagaaagaaattgaaagtttgtggcaacctgcatggagagagagagagagggagggagagagagagagagagagagagagagagagagagaaagaaagaaagaaagaaagaaagaaaaagaaagagagaaagagagaaagaaagaaggaaagaagagaaagaaagaaattgaaagtttgtggcaacccgcgagggagggagggagagagagagggagagagagagagagagagagagagagagagagagagagagagagagagaaagaaagaaagaaagaaaagaaagaaagaaagaaattgaaagtttgtggcaaccctcatggagcaggtctgtcagcaccgtttttcctacagcatgtgctcactttctgtccctgtgtcaacagctttgtgtaaagcattggctaggcacttttaaactttttcaaagcatattgaacttgggggtgatagatgatgtatatttgaaagcaatttggtggccaggcgcagtggctcatgcctgtaatcccagtactttgggaggccgaggcgagcggatcacctgaggtcaggagtttgagacgagcctggccaacatggcgaaaccccacctctactaaaaatacaaaaatacaaaaaaattagctgggtgtggtggctcacacctgtagtctcaactacttgttaggctgaggcacgagaatcacttgaacctgggtggcggaggttgcagtgagtcaagattgtgccactgcactccagcctgggatgacaaaatgagactctgtctcaacaaaaaataaaaaattaaaattaaaaattaaagaaaatgaaagcaatttggtgataattatattataacttccttcagttccaatacaatgacatttccaaagtgctgttattgatgaaaaacaaaagtgcccacaaacatgctttatttgggctgtgtagtgatttatttttaaatttgaattatttgacaacacgtaaaaattaagagttgatataaagtcgggtctagtttctcctgaaacttgaaatgacttgaacctccatggggcatcagtgtgcaggagctgagttactgttcccctccagctctccacaaccctttattgtcttacactgtcttcctccacttatattacttgcctggtcccagggagacattcatgtttatgacatctgctgaaagtaaaaaggtgtctaatgtgtagggttaatgcatgaaggcttgcagaagacattgagaactgggtttagaaggtggttcacagacatacagtatgtcctatggatatgagcttaatgttgtggtgtctgcctggacctctgtttgatttgagcatgctctcacagtctttacagggcttcttttgtgcttaaagatcagcaattaagtgatgagtgtgacatcactgaaattagtttatgcacgtggaggattagaagggagaaagaatttttccagtacaagcatagcttttattggcacatatatccctcccagccaaccacacaagaagcacagtacctgtcatttcctaacctttaggattagaggaattcaagcaagaaaaggcaaagaggaaagcctagtaaagttcacaatgcttctctttataggcagaacaaaaaagaatattgaggcaattactggcataaatcagtccaaagcaaatcaaagaaattcaagcaaaaagaaggcattttgcctgaattatggagctaatgatctcagtcctccacttcagtgttcctgaggagacctggcctgagaatgtttttccagtgatctggcagattcagaagtgaagagaaaatgtattattgtaagtgcagctatggagatggagtccagtgctgcctctgtccagaacatgtgttgagaacacccaggctcaactagcatggctagctgggaggagagaggctctagaagggatgatcatgatccccacggggcaagagaggggtggtgtcagtgcccagaggagtcatgctggctcatctttcaaaatctttgtagctttaacactgtcagagatgttataagtaattttcatttttctgtttaaaaatatgtctcttttctaacagcttttagcaataaaaaggcaacttattaatgaaacccttctgccttcaaagtatgaaattaaaatattattgtaactacaggcaagaaagcatttggattatgtgtcatttagaaatggtaataaagattatccgtatggtcttatgttgtcagtgccttacattgcattagcaatcacctaatatgagtgtgattttgattatgtggttcattttaaattctgtgtcctaggtcaatcagtgtcaagatgatttactagaaggaggtgcggttttctttcatagatgctgttaagtgcttgggcacaattagaatattttagggcatagtatatttggtattatcgtgctgtgggtgttcttaaaccttctcactgtataccttctccttaggcatctctaattctcatcttgtctgtcttgggtacacaaaacaatctctggtagcaagatctataaaaatttgtgttacctgtttatttatgttagtttccctttaagtcttctggcttttgtacaggtgtcagtcattttagatgttgagtttttgatggtcagcgagcaggatgcagaggccaggattaacctatgtctccaaaagaattagaaatctctctgcttttttttcattctcttccactgaaagagggaacaaagaagccttactcctgctgaacgttgcagggaacccagcgacatgacattttttaaccttctgctctgtaggggttgacaaaacttgatgggaactaatctgggttcatttgggatttgggacagggtcatagccttttgagaattcagtaccttccccttgatcctcctacagcctgagctctctgagctttgtaggttctgtgtcaggttctgctccctgtatgaacatactccaattatacgttcttgactcctcacctagttctgttctttagttttaacaatgtgccttttagattcatctgttatttcatttttgcttggaaaatatttactcaagggagtcttctctttgacactgtatatggtgatgttgacaataatttcgtaaaaacttagtaactctaggagtgtaacaattagattatgattgtgttgtactagaatcattggtcattttaatctagcttataataggagaaacagtgttttaggctgtggtgttttatctttctggttgtttggggttttttattttgttttgttttttgaggatagacagtacctgtttttcatctctgtgtctgcagcctggcagagtgcttgccacaaataaggcactatacatccatctctgaatgaataggattaattcagtagatgttattcctgaacatctgtcaatatacatgccaaagctctgtatcccgttcaaatgcatgcctacataattgaattctttatcctaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatgtaagtgcatatgtttcttggcttctaacacatctccttggttttgcaagattccaggtggtactaggggatttcaaaaaaaaaaaaagcttcctgaagaaatttttatgccgtgttggtttcttcagtcattttcagtgatcctttgtgccacaggttgcttagcagagatgttctaaaggtgataggaccagatcagagagtccagaaaaccacagtgcagtttctgtaaagatttagagagcagtgacacgaggctttccttcttttgaggaagaaggcacctgcttctcatcatccttcttgttgtttagatcccatttgtaaactatccaggtgtggaattacacatgggaagcctgttataaaaacagttcactaaatggcagtaacaagttaattgtttatttgtttagatgacaggttctgcctttattatagggctgtcagtgtcaattaataaattaaactctatttcagcttcacaagtcttatgcttcataccaggtgtgtaaaccaacctcagctactgccttcccatactactacctgtgatccaggtagaaggcattattttaggaaactaacaattagattgattatatcaagcacaaaaggagtagttgctttgtccctggtaatctcggagaccagagggagatacctcactctgtggtttagggcacactttggtgagttcaaggtcgggggtttctttactgtgtgaaatctgtgcctcaggcctgagctgcataaccaggattctggtcagcatggggatggaattaaagtgcagctattcctgttacaaaaaaataatcgtagtattttaaaggccggtgggccttgtggctgtgaggagcacagaaatggcatctggcgtggggcgactgggagcagtttggacggtgtgggctcatgtcctaatacccactgtggtcagtgtggtactgcagctcccctccactcctcctcttccagatcacagtgtggtcaatgcacgtgcctgtccctgagctttgcgtttctcgtacacgcggctgagctccgaattcagtcttacatttttctgcttgtagcggctgcagttgtcccacttcatcctcctccatcagtttgtactacacacacacatggcccagtggagcatgcacaggtgctgctttggcaccaatgggcagggcagcactgttgctttcatccttgatcttctttctttaccctttcctgtcattttcagtgcaggaaatagaagctatggggtctcagtgtacccaagctccttcccattttttcatagagttctctctgctttttttgtggcagatataatgtttttcatttaaaaatatgtatgtataatttatttaactgccataagaaagcaacctatgatgcattcgttgtgggctggaattggagaagcccttttggccacacacaggattagaatttttgtagtagcaggtattccttgaaggggaccacacagatacatcttcattttgcagtataacccattaacgttccaaatcttctatttcatggtgaaattcctcaagaatcaatttacttagaatcactcatcccaaaagcaagaatcttctttagtagttctaggtgtttgaagtttgaacaacaagaatattcacttctggacaggaagtttaatttggcagttacttttttgaaagtgaatgtatctgtggaaatccaaaaatgttcatgtacaaacggcagctgcagaggccaacggagcttccacaactgatcggctattagacgttattttttgccttccttcaataaagccaacagaaggaacacagcagtagactttccattttcctcccactctgagcaatgagttctcatcagatctcatctgataggagcgaccctagaggtagatatcataatactgtcttgatgtctttgaaataagacagcagtttctggggaggaaaccttcaggaaagatgttccttagaccacaaggctgccagcaccacacctatgacaagtgtgggtatgcatgagctctttcagggttgggagaaagtgctggaagttgtgaagtgagcagtttttagaaatgagacaaggggaaaaacgaaataggagaatttaaaaataagcatgaccacagttatgagaatggggattaatctctccagcaaagcaagtatgagttgcactatctgctttaatatgctataaaaaggggagaatagatacaggtagtgggaatgggtttagtttttatgctagaagatgaaaatatttttaaaatattttgacaggaaggtgaagataaacacagttattttatatctgctgtgcacatctttaccaaccacataaaaatgtctgcagctaataaaaaggctttattctcactgaccctggcatattttattggtactcatttttttcattcttattttcatccattgtgctctttttccaggcttcttaccataaacatgcgttgtaagtgtgatacatttctattttgtaaaaatacctgtaaatgacaggcagcctgagttctggtctttgttctgtcacgtactgattctacactttaaaaatataaacacaggtaaatgcactctcctaaacggactgctcctggagagttaaaatatattaatatgtcatcagaataattacccagtatgcacagggatttggtcatgcttcccataaatataatggtataattgtgtcttagtgtcctgatgaggaacttagcatcaaacagatcatgtaactacatcagaggagttacaatttagacttaagtttaaccaccttgagcaactttcaagtctttatactttaatgaaattaaactgttttaaaaacactaatcaattaatacatttgaagaggtttttttttacttaaaaaaattattctatcaaggctctgtcatccatgaagagcgttttaaaatgtctcttaaaattaggaaatacccatttttaatgaaatcagataaattggatgggattgactatcctgcttgataaaagagaggaagagaaggtgcaataattcagtcttgagtgtttcagaggaatattttaaagaagagcatttttgtaaggatttaaaatactaaggaacacgcatggagcaccacctttgtttttcataaagcattgtggagtattctctgcatatccaaatatgagcaaggagaggatttagcaaactatgggaacattgacattgggaatcgtctccaaaagccatgtgtagacaccttcttctacttttacttgtaaaattcagcttggcctgagagcagatttctataagcaaagggcagaagtcaaaatagaagtctgatgaatttctctatccaaaatggtggctgtggttgtgggctttctctttatttgtggggtaagaaaagtctttaagtgacgaaaggttgcttgtcttctaaaggataagtaagtactcagaaacaactgggaatgatgatatttcccacatagacatcagtgagtcccggagtcaccgtgggtagcatggagtcaccatgggtggtctcagagcattgtgtgttcagagtgtattacctctctgctgcccctgaccagcctctcttttatttacagctgtgtcttcaccatcgtccttcacaatgaaaacaaatacactgagcacatcggtgcctaattcctattacccaggtaacagttttttccattgtctcctctctgctctctcctcagcagtcagaatcactccgccctctctctgctatccctggtgcttgaggggcttactgtgtttgagatgttgtaacccaatgcgtttctacagctttctatgcagaaaataggggtgggcattcatcaatcatttactgttctttctctttttactttctctgcattgacctgcttacggtgtatgacagacccatttgtgccaactgcaattttaggtgagaacatttccctttaccacagtttattgcaggagtaatttagaaagtcagtgaccactctgtaggagattggagttttaattctgtataatgcagtgattataagcacgacatgtgggaggtgggtggcctgggtcatggggttaaaggaaaaagagacttttctctaaacagtcgccattaataagaggggtttgctgcatgtatcttggggatgataccaacaggttcaaatgaacaatctcagccccaatattctccctttctgtgttcagaatttaaagttaggtctgatcccaggggaaaaaaacaaggtgtcatcactcagctgtgtactttccaagagctgaattctgtctagtgtgatagtcataaaagtgaaaatagcttctcattattttcacttattgctaagcactaaaaacttcaattttaaaagtagcgtttttctaattatgccaaatgtcatgcagaaaaatgatcacaatggacttctggccctctacccatcctcggtgccactcagggcaccccacccccccaccaacattccaaagtgtctgtcacacagtggaatttcaaaggagctgatgatctgaacagcaaaatgacaagatggcacttataatcatatgctttattatgtgtcagatgtcactagaaatgaactaaggtgttagcccggtggggcagaatgcatttaaagtatgaaatattcccagcagggggttacagaaaaagtcccgtttgtccaatataagaagggtgaggagaaaaatggcattacctggctgtgataaccaaacaagcatgagctgctgttgcatttgagacgcataaataacctgagtgtatcacggctgtgttctctttctactactaacctttccgaaaaggagcacaacaaaaacgacttcaaggtatataacaattcattgtagcaagagttccaccctcagttgttcgacttctccttcctaattcacttgacaagggtttatatctttccaacatgatttttcccccctctgcttctcttttctctaagttgttacgatttttgtatagaaggtaatttttattttcctaatggtgttctgtgggcttaagcaagtttgttgcctaaggaaaaaatgaattaagatagaactttaagaatggatataaaacagagtttttaaattttgcatcattctgagggctaacaaagcccactaaaccctccctgcccacacacttttaataccaattaaaaggggaagaaaattgcattttattcttttcataagtgaggggcacaggctaatcttaggcaccagaacaatgtaatctacatacaaatgacatttgcagaatcttttgataggcgaagatttgcgatttcttcatgtgctgtggcattcattctgaggttcctctagtagattttctgaccttgggggagccgtgagtggggagggctaaaacgtgccttgtcagaaggaagaaaatgttcagatttcacagcagggttaagacaagcttattaaacaaatatcattctttaaagtcgctgctttgttattatgaacattaatgacatcttttaaagttgattagttttctttactgaaagggaatcacttggacagacaattcaagtagcaaaaatgatgcacattgtaaaaaataagtcacccagatagaccaataactgttatcatgtatggcttatataggtaccaaatggtagtacttgggaactgcattccttacacgttacttggtgcaaatgtgaatctatgtattgagtaacaaggattggtgaggttagcacttgaaaccacggaagaatttaagatatatatatctactctggcagttttgggggatagtagcagttataatttacacaaagacaacaagaaatgtcttgctgtgagtcagagctcagcacaattaaattctctggcaccttcagctccacctctctcatgctaagatgcccagccctaatgtatagagctggagtatatctttacttcatttgcttgcaaaaatgtagatgattaaatggatggttggatagctggatggatggatggatggatggatcgatagatagacagacagaacctaccctacctcaaatatattgcatccatttcaacttaaggtttttcagctagtttgttaaaaattcaagataattcataaagaatataagtagaactaattttcagttcttagaaaaccatcaaaactattagtgagaagctttgtttctttatttctaatgtgctcttctgcattatttttaattaaaaaaaatgttgaggccaggcactatatagtgcaagcatgtaatcccagcactttgggaggccaaggcaggaagatcgcttgaggccaggagttcaagaccagcctccgcaacataaggagacccccatctcttcaaataataataataataataaattagccaggcatggtggaacacacctgtattcccagctactcaagaggctgaggcaggaggattgctggagcccaggagtttggggctgcagtgagctatgatagagccactgccctccagcctggatgatggagaaagaccctgtctccaaaaaaaaaaaaagtagaaaaaaaaattgttgatgggtaatttttaaacacataaaggaaattaatgacaagtaatatattttatcaataataattcttttttaagttagagaagattaatcactaattttagtggaatcaagaatgtctagtagtataagtgacccaatttcatagcagcacacaagaagccttctattccctcttccatatgcatgtactagataatagggctcttctttcatggacttggtggtgtttaaatgcttgaagacgtgttccacactagtaatgagggcaagatggcataatgcagcacaggatgattacatacaacagtgacagttgatgtagctctatggatttaaaacttccaagaatacctagccctgggatcagagcattgctaggttgctggtgtatccacgtgaaggacccagatcacttctgggaagtttagaaggtcagcccaccatggagggcatgttaattatgttcatcccataagatacaaaactgagagaacgagagaggcacagaggggaaactaattaatgttccatttattttagtataaagaacagaacttcctgctggagtggctcaaagctcaagggattcggtacttcagcagggttcctgtatcccagtttataaagcttggcagttgccagcaagcaaatctgatgtgaaaatttccaggtttatttgtgactgttaaaatgggaacatgtgacttgctaaatttcaaagcaaatccaaatgaaacaaaaatcataaaatcaacttaccacccttttttattttgtctttgtgtctttagccacgttgtagtgatccaggtgccatttcagcaacagcaacatagctacacacttgtgtaccacctttcataccatgcatccccaggtgctttgcgatgcagatagaagtgaggttcccaaaccaggccctgctcatcaagcacccttggactaaattttcttcagagctgaacttctccgtaaaaaataaataacatatgaataactatagctgaattccctattgatatacaatctggtaatttttaaaacttgaatatatcttttatatgttttatataacattctcattttaagtgactttagcattatattttgacagcacccatcctcaatcataaaactgctaaagggattcagcattataatgagttaacctgtagaatgtggaattcttaatctaatagcatttccctgcataagacatttttaataggtaccatttctgcagttcattaacctaattttctagtaggcctccattaaaatagagcctctttaggcttctttgaccaaattttgacattaattttatagtacaatttggttgacttgttcaagaaatttaaatgagaaaatgtgttgaatacaaataagacttatttagacattacttggttcatgggggatgaaaagcaattatgatgctaattttaacctcctttttgttatggagtacttaaattcaatgcctccatcctaacgtgatggaagaattgaggcttcgccctctgaccacctctgaatagaaaacttaactggaaagttaaagcataaaataaaaactacctgtaattatgcacgcagtactattgcttatgccctgtttcctttttctcctccttttttctcctgatatgtatcttcttaaaagtgccaataaatggtaagttccccgattcgccccatggaagagttgtggagggagtgggagtgtgtgtcttactggtagattctgacaaagccagctggtgctgctctgtgctggcctgcatgtttgcctttgtagaacattccatgtgtgatgtgttggtccacaacattttgtcaagctttctgataccagagcatgcaaagtgattcatcaaaatgttatccccaaaccaggttcccttttatttttccattcttctttgatttcatgtattaagtccccatttccattgctagctttataagccacaccattttgtgcacttttattttgctcacagaacatttgtgcagagtttatttatgtcatcatacgaactactgaactaatgtttcaaagaatacaagactggttttgcaccaggtcttgatgaagtttcaggttgaaactttcacaaactttagcactggaaggctaaagggctcttctcaattagctttgtgaaagcaatatatcgtttggactgctttgtaaaagaaagatttctgcgcattcttatcagtattgccaaccccatttaaatttctaaacatttaacttttcttttttgctgagccatcgtagggaattttgcacccctaggtgaggggatgccaggagccagcttcttagcattctcagtgatgccgacctagctccctggctctccctcattttctccctggccttcttttcctagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgaggtgagcacaagctctgtgccagggctttcccattccttcttggattccatgccaggtactgtgctcccaactcaatcagaaagccagagaaaaccccctgccccgagagatgccagaaagagatgaagtacagttgtccctcagtattctgggggattggttccaggaccccagtatatgtccaagtcccggtgtgagccctgtgaaacctgagaatccaaaaatccagtcctccagatccatgggttttgcatctcaaagatattatatatattcttttcaatcctcatttgattgaatctgcgggtgcagaatgctaggatatcaaggccgactgtattttatccgtggatccactttcatctgatagtaaaacttgttaccaagaagttcacatgcgttacatggaaaaaggaagaatgctttgccttttaccttattctgcacaaatacacaatgaaaacaaatttaccagggtctcttcccctccccatcctgttttttttccctttttttcttcttccctctggcagaattaagttttagttcatgtctccctccccattcttgatcacctttcttggcttttcctgtaattatgatatgaaatcctaatgattttgtagtcattatctcaggaagaaactgtccacttaaagcaattatagaccaaccagcaatgtcatgtggtggagatcagacagcagtacagggactggctattgtcatggcagtgacagctgttactgtccagccagcccagagagcatgccactgtcttgggctcttgtgtgggcagctgtcagggacatttctgggaataatgatattctccgaatacataaaatacagggcttacccctttcacaccctgtgccattagttaattctgtcagaaggtcattcaagaattgaagagaattaattgattgaagaaatctaattcaaagaagcatgccatcccttgagtgggtggtgtggggcccagggagcaggacaggaaagttggattgcttttttatgttattaaaatcagtccgcagtcattgatgaagttaaagtagcatgcttactcagagtaaaaataggattatgtagacatgtggtttttttaaaccttagaatgtggttctggtctcatattcacctaactagctcagagttgggaaacatcttgtctggaattagagtgtttttgaaatctgtttctaccacctggatagtctgtgagtttccaactctgtttcttctcttcctgtgggcacactcacaacacttcattttatgccccagacactgcattgtcttgggtttagctctttttccaagcttgatcatcagagattcattacagcagtcaaagcaacacatggtaccactgttggcggagcctgtgctacacttcttttaggaataaggctttggtccaaagcagacatagacacactttgctctgctaacatgtgcatcctggtgtattgccaatgacctcagttcagaagactgtgaagccaaacaatcccatccagaccgtgctccagggtttaattgaagtccagaaaatattttcagttgaagttctgccttttagcaaccctgaaattcttagatttatctttagcaattcaatgtgtaaattcagtgaaattgactgcctttgcatatttcctcatgcacttttaaagtctagcttaggaattaataggattaagagtaagacttccaaaagcttaatatcgtatgaaagacaaaattaggttattgaaaaaatataagcctaatgaatagggatgatgtctaggttctatccaatattctgaatgcagatattactgaaatgtttattaaagatgttaaagagattagttttaggctcaaataacaattcatgaaataacctgagcccaattttccatggactatttaaaaatacctacttcctataacatgctacagacaatgcatatttgaaagatgtagaaaatatttcccattcagatcttttgaataaatatgatttataagtataaactgaaatattatatactaatttgaaccatattatgactgacaactaattcagttctcaaaataaagtgttgtattcattaagtacattgcagaaaactttttctcattttagctattccgtggtcagagaggactgccaaaaagtgaatacttttaaaccctaaagccattgttcatttaaaaaaaaagaaggaaaggaaataatgaacaaaacacatatactagagatgatatcaggaacaaataggaaggagatgttgggagaagtatgaaatgggcagttctgttaggaataatcccgtcactgagtaccgtgccccttgtgctgccctcctggagggatgctgatgttgtcgtctagtggggtagatgacagggaagtgaggagtggtgatggtgggcgggcatgcctgtgccatggccgcagggagaaggggacgccccctaagaagcgtgtgtcatggaatgacatgctctggtcttgatggaggcacagccaggcttctgggaactggtggtggagtgaaaggtcccagactgcaggtactcatatgtcccactttctctaaccccagggaggtgttattctcatgagaatctggcaaatccttaaacagttatttttttgaagtttatgtagtttttagacctctaataaaacagacctctttccatcatgctgtaaagtctgcatccttttcattaacacccacccagagtcaagagtgttgagtgctaactggtgtagtgggagtctctgtgctattcagtgaggccatcccacccaacagatactgagaggctgtggtttggaacacaggctctggcacccgactgcctgtattcaaactcagctctgcttcttagctgtgtgaccttcggcaagttatctaacctctctgggcctcagtttccaaatctataaatagaataattatagtctcaacctcaaaaggttgttgtgaggagtaaatcattttaatgtaggtgctagaattatatctggcatatagtaagtgttcatttgaagtgttaggtagtagaagaaaaaaaatactaatgtataataagaccaagagcagaagttgacaccatgttctttatagggaaacttcgttatactgaggtttcagtaaaactctcatctcttgcgcatagcagtctgaggatagagtgagccacatgttatggaaaggggttatacttttccttcatctccagggctggataactttcttaccatgtaccatatatcatcaaaaattcccgttaacaagtaacttacacataaataggtagacttgattctatggattaagagtttaagaactgagaaaataaattttaagaaatatatgctgtcatgttttattgctataatagtatttccatatctaagttggagagtcctaaggaatactataactctagactgcataatcctcctaaaaaattattggttgctgcattggtgtctttggcaaagtaggatttggggaagagtttaattttaccaatcatacactgtacatggcgccagggatacagagaggagaactgcttctccgctgtcccctggggaagctgacagggcaggagaaggcagccaggtaatgactgtagtttgtccagtcaaaccccacaccctctaagagagatgcgcaggcatactctgaaggccagtggggtcacctgagccagccaagagcaaggatgacttctctcttggaagatgagtgggagctgaccaagagaaggtgaaagagggtagccatccaggtagacccaaaagcaggagaatggggttctctgaggaaatggcaggagttctatatgcctgagtcccaggacgggctggtctgtgggatgagggtggtcagggctccaatcaccaaaagcacctcctgtgtcacactgagaggtttggacatcattatagaagtagtaaaagagaagaaagactcaaatagcctgagtctcattcctgtacttggatggagagctatttagtctgaacagctcaattttaaaatattatttgtatgaggcacacaggcaatgcttaaaaggtaataccccaaaaaagtaaaggagaaagggaatgtgtatttactttaaaagttcctgttgttctatctctattcaaaaatgccgtggaatgcttggcttcaagacttgttgaagcagtgaattacttcagtactgaagcatctttggggataaaatctaaagaatggctctggttgttgctgtgactctgtgtaatcatcccatcggcctttctggtcttcttcaatctgtatattatcaggaaaagccagtcatttatgttgtaaaatttttttgaagtagtgatgttctctctgctgaacaggtttcaaccaattcttctttatcgttttcaagacagcagtgtctcaaaattggcctaaacaccagaaggattcattactgatcaagtagccgacagaagtatgtccgaacaagagcataccatgtggtggggatgagatggagcagagctcagtgcaggttttttatttgattttgttctaacaaggtagtcatatggcacctctcaccagggagatgcaataatttgattcaaaagaaactcagacatgaatcacaataaagaagtaaacatgctgaattgaacagaaaatggcatgttgtcaacagagagtggtgcagggacctctccaggagaggagaaagagcagaaagggcaagtttgtttatgttgctgtgagagaagagctgcctggttcctctgacaagcaaagggcagtctgtgctaagcctctggggggaacctttgggcttcccagaaaagtagaagagagagcgcttcactcacgagggacagacaggtcagactcagccaccctgccccacgcagacttctgggcctttctcagctagagttgaacagggacatttgccatgactgcagctctgccctgaaccctcacacccagccctagacaagggtgtgttgcaccccttgtaagtggcttgataccacgtcaggtccaacgttgtggtgatcctgtgcgagtggagagtgagttcctccccttttgcagtccccaaaggaccttgttgatggctcgattattttttttatgcctcaatttttgaactgattctaagtccctttggggatccaagcagaaagacaaccttaagtaggaaaacagccaaattattctgaaagaatatgttttgctataactgtaaaattaagataaagaaaggatgtcagttgaaggctacttccagagaggatgtcctgaaaaacacagatggtactattttattagctaatagtgtcactctggggcacaaaaaaatgatttccaattactagagctgaaacgtatcaaagactgaagtaactctttgcatcctattcttcaaaaaaaaaaaagtgtgtgtgtacatgtatgtatctaaatatattaagaaaagcattatctttattccacgtactttttttgtttttgtttgttttgtttttgagacagtgtcttgctctgtcacccaggctggagtgcagttgcacaatctcagctcactgcaacctctacctctggattaaagcgatactcaagcctcagcctcctgaaagctggaactacaggcttgcacgaccatgcccggctcatttttgtatttttagtagagatggattttcgccatgttacccaggctggtctcaaactcctgacctcaagtaatctgcctgcctcagcctcccaaaatactaggattataggcatgagctgctgtgctcggccccacctacttttcttatattatgcctctctcctgggcacaaacactgttaattaattttatagttgaatgtgaagattgttttttagctcagtttaaactggggaattgaaaacattatgccagaatcttcagaattaggtacagcctataaagttttctgaggaacctgaattttctttaaacacgtctgtctccttgtagctccttttaggtcttttttaaacatatgagttgtatatccccccacctcttatccttcccccgttttctaagtaaaacagctgactttgttaaatgcaagttcagtgttttatttgctgcctttgtctatatttgacaaagctgtggcaacttaagaaaaaattattattaaaatgtctcacctgcactctaaaatcttgcttttttttttgtgacttagtctcactctgtggcccacccaggctggagtgcagtggtgccatctcagttcactgcaaccttcgcctcctgggttcaagtgattttcccaacccagcctcccaagtagctggagctacaggcacacgccaccactcctggctcatgttgtatttttagtagagtttttcaccatgttggccaggctggtctcgaactcctgacctcaggtatctgcccatcttggcctcccaaagtgttgggattacaggtgtgagccaccctctctggccccagatctccctcttatttacttgcctcctacctcagtgaagccagctgttcttgtctgtttaatgtggctacaacagaatacctggggctcggtcatttgtaaagaaaaaaggttctgcaagctgggaaggagagaagcatggcactgccttctggtgagggccatgtgctaagtcaaaggggaagtggacacgagcagtgagagaggaccaaacagaaggagaattgcttttttcattttttttaagagacactctgttgcccaggctggagtgtagtggtgtaatcatagcttactacagccttgacctcctcagctcaagaaatcatcccactcagcctcctgagtagctgggactacaggcacgcaccaccaagcccagctaacttttttaattttttgtagagacagagtctcactatgttgctgaggctcgtcttgaactcctggactcaagtgatcctcccacctcagccccacaaagtgctggagctacaggcatgaaccacctcctggaattgctctgtaacaacctgctcttgtggtaactaagccagttttgccagagcatgactcactcattagcatgaggatggcaccaacccattcatgagggatctactcccctgatccaaacacctcccactaggccccatctcccaacactgccacaccagggaccagatttcaacatgagttttgatggggacaggcaacccatattcaaaccatagcaccagcatatcctacaaaaagcactcccagaaagccacctgctctctgcagagatcgcagttctgactccctcccttcagatgcccttccatgggaaaggccttgaactggggaggacagcccctggaattttgagaccagcccagcagcagggcgcgggaggaaggcgccccgggcatctgggctcccccttgttgggagttggttggcagagggagaattgcacacacttctagacgacttttcagaatggtgcacagcagccccttcgctggcttttgcacaaagaagcaggggcaggtggaatcaaaggcgctttgtgttactcagctgacagaacattgcctgtgcacagctggttcatagattctgtgtgcagtccagagggagaggcgccccttccctcacctccagcccacacacttttcagatgtgcttttcagttcctgcttcatatttcgagggaccagctgagtcaatcaattggcacaatcagtgcaggttgttttctgtcccataggatacaaaacaaacaaaacaaaaccaaaccattgaaggctaaggatggggagctgggggtggggaggcactggcaggcactgtaaatgcattaagaatcacacggctgtgtctccaatggctgaagcagccaagtgatttttgacgctcttttttcctttaattattatggtgctggtgagccaggtccataagaaaatgataaacacttctagaactctgaaattttgagatggcttcaagctatttgggcaagtaaggtgtatgtgtttatgggtactttcttagtgggtgaaagtttctgcgtatttttaaataatgcaatagagagttggttttgacatgaatatttggtttatttttttttctgaagtaccagtagaaaagtgtgttttatgtgttgcctgcttcactcagtccgcctgctttcggggcctctttcacatcagctaattttttatacagttttcgtttgcccttgcctctgatgacatcatatacaagctcagacttcagaaaattagattaaaaattgttatttcctacaactctccatgctcccgctgatgataattcatggcagttgatgttttcctatttgtgtgaagcacttctaggcaactgtctggtttccattttgaagctggttattagaattttctgtatctaacctgaaagaagttaagcaattttcccacttgttaacatgcttttagtgtcagatgccattagccacaagtgccttcttggaggacctggcccagaaaggatagtgaacgtgcccgtgtgccagcatctgcggaccttatgtgtgtctggtactggtcctcctgcttttgattagtttgatgctgtcaccgcccactaacatggtcaaactagatatttcacggttgccattgcccctgccgctccctcatttccacaccagcaggctcaagtcccaactgctctctctcctccccattttcagtggctgccctctctcccctcccctagggcctgccctgatcacttgtctgtgccatcggaagagtcccctgacttgtcttcctacctagtctttccccttcaaatctgttccagactctgcaaccagttttctttgtaagacatggatgttatcatgtttgactgatgctgaaaactatgccacggattctttccaaaaataagaacctcagcatagcacattcagccctctgtgtcaagacctcactctgtgtttcagactttcgttgtaatgcaggtgcttcccaccgtgcaggctgtgctctgcttctgctcatgtactcgccaccctgccatcctccaggcctccagggctcatgctgcaggttgtggcctctgcctggccgtgacttcagctcctccttcacttgccaaatccctttggacacagctcagatgtgactgccccccaagctgtccctgatcccaaccagaaacaaccattccccctacagtctcacagctctgtgtttgaataatatagtaggcaatatattaactgataatacagtaggcagtatattaactgataatatagtaggcaatatattaattgatttattcagtacgtatttgacaaacaatactgaatatgtgctgaattgatttctatgtagttacaccttgtaattcatatttgatgaattgatttctgcatatttaaacacatacacctgttcctggggaaatgatagagatggatatagaactattaaaaaatacaagctcagaatgttacaaatcatcatataggatcgggtgggctaggggtatccagtcagaaaaactgtatggaccaacttgaacctgatcaatactgatcacctaaaaatggaaagcatagatatgttccatttggtcattttacttattgaaagccaacctgtttaaaaatttgaggatagacttttttttttcaaggtggagtctcactctgctgcccaggttggaatgcagtggtacagtctgggttcactgcaacctccatctgccgggttcaagagattctcccacctcagcctcccgagtagctgggactacaggcaagcaccaccacacccggctaatttttgtatttttagtagagacagggtttcaccatgttggccaggctggtctcgaactcctgacctcaagtgatccacctgcctagggctcccaaagtgctaggataacaggtgtgagccaccactcccagctgaggatgaacatttttaatacatgtttgctttacatttcttatttaaccttgtggcaggaatgaaatatatttggtctttgtgcctggttcctgacactgagctcttaaaacccttgggattttatgagtgataagagcatcttttactaaaatctaacttgatgctaatgttgacttagagtggagcccttagctagcctcaggatggggtgggtctccagaaaaacctaatgattagagagttggaactttttcagccccacacaccaacctccagcgaagaggggtagaggcagctagagatcacactctctaaaaactcgaacaagctgtgatgagcttctgggctgctgaatatatacatggaggtgctgggtggtggcacatccacagagggcatggaagcttggcgtcctggccccatacccagtcctacgcacctgttcgtgtggttgcttgcctgtatcctttataataaaccagtaaatgtgtgttccctgagttctgtgagctgctctagtgaataaattaaacctaaggaggatgtcataggaaccttgattgatagtatagatgacagcctactactggggactggcatctgaagcggggggttgccatcttgtgggactgaggcctcagcctatgggatctgactccaggtagaaagtgtcagagtggaagcgaatgagaggaaacagagttgatgtccactggagagttgtttggtgtggaaaaatcctgcacgtctgatgacagcagtgttctgtgctgggctgaatgtgtgagaggagaaaaagcactttggcttttcctatctcttaccaaccgctaatagaagcaatgtagaattatttacatgagactgtagtgcatttcataacatgactattccaacaaagaaactctatatcatcatagacagtttcacagctcataaaggcatttcagaggcaagtgaggctttgaggggtggactttccataagtcttgcttggctgctagaactttcatgatgttgagggtacctgcccttgtactaacacctactatatcggcactgtacaaagaacacaccaggccgggcgtggtggctcactcctgtaatcccagcactttgggaggccgaggcgggcagatcatgaggtcaggagatcgagaccatcctggccaacacagcgaaacgctgtctctactaaaatacaaaaaattagctgggcgtggtggtgcgcacctgtagtcccagctactcgggaggctgaggcaggggaatcacttgaacccagcaggtggaggttgcagtgagcagagatccgagattgcaccactgcactcctgcgtggtgacagagcaagactccatctcaaaaaaaaaaaaaaaaaaagagtacacacctacacacacagcacacacagagatgtttatttctaaccacaatgctattacattactatcaaacccattttccagatgagaaaatgagtcagaatttaagtaactcgccccaggctgtcctgtctagagttgcaggcaggctggagcaacacaaagcctgtgttctttctactgaagcacatgacttctgtatgaaactccatgaagacacagacctatggaaataaccttgtgttttattgatgtgacttgtgatttcaaggcaggaatgttagttttcctctctgctgttgtgtttgctttgaacagcgatttgttctttggcagaggacccatccagcctggggccccgttgacagcgccaattctgctgtgtttcagcagctcagcagcagcagatgctgtccattaatctcactcagggtctcagctctgtgacatgaggtccctgcaacattgctcctccctgctctagtttctcattgtctgaggaatgcaggaaaatcattctgaagatatccgccatcctggctcatctgacatgaccagttctaggctaaaaccaagctacagctcttgagagccgtagattccatgtgctgctctcctgggttattgcgtggctgccaaccaaccttgcagcaggaagaagggagaagagaagaagaagacaagtttgtaagcctgagttgggcatgaaagcccaaggttttctaaaaaatcttctctggaagttgatgaatcttttttcaatggaatgatacaaaataactgacaatcttattaacctcatggcagagccaagaaaacaccttatgctttgattaaatgatacaaaaaataaccagttgaaaagtcaattttttttcaaataacagtgctgtgttatagaaaggacagtggattaggaatcagaaggcaaatgtgggtcatggttcctctctgcgaactctctaacactggaacattgaggaaatcacggaacttccatgaaggaacttccatcagttgtgacagcaactactcacaaaatgtctctgatattagcagtagtacggtctccttagagatgctggatttccagtttcatgggcgtattctcatggatggaatgtttttcagtgggcgacactaactggctgttggagatctgtgtggggacatggccatcacgtatgatccacaggcacttctctggttctctgtggctggttctgattttattccaagtttctgaatgaggtggtttctatcccgatgtgcccttcctatcttttcttcctcttgtctcccctcatttcagcctcttccgaatctcacttctaacccacaccccatctccaaaacactgggaagtctgcattgagatgataaggttatagtattagcacacttttgtatcaagttctcacagtgtctgaaatgtggttatgattccatgatgtctctaatccctactcacccagttcttaagaatcatgggcaaccccgcttgggtccccttccacgctgtggaagctttgttctttcgctcttcactgtaaaccttgctaccactcaaaaaaaaaaaaaaaagaatcgtgaatgataaggaaataatgtggactaaatgttttgaattacttaatgtttgacattttacagtgtataaattcgtattattgtcacatgtatcattcagaacacagtaatattgaattagagcccatgtttttgaccagtcatgtcacggaaaagaaagggaatatgctgacttttccaatttctattgtctcttctgaaataaagtacttttatgtccatgattgaaatataatcaaattggctggatgccacggctcatgcctataatctcagcactttgggaggctgaggtgggcagatcacaaggtgaggagtttgagaccagcctggccaatatggtgaaaccccacctctactaaaaatagcaaaataagccaggtgtggtggcaggtacctgtagtcccagctacttgggaggctgaggcaggagaattgcttgaacccaggaggcggaggttgcagtgagccgagatcataccactgcactccagcctgggcaacagagtgaaactctgtctcaaaaacaaaaaaaaaagaattcacccatattattcattatgctatagattttaaaaacttcttcactccctttatcttctattatcgccctttagggagacatggaaaaccttttatctgtttacttcagggaaactatatgagatactgaataattgtaatgtattcagtgttaattataaatacgcagcgtatgtttttatatgtattgtatttatgtgctttaggtaattatgcatgtgagttccttgccaattttatggccaaaatattttacttggctgattactaagtatattttaagcttacttcttgaaacatgaagagaatatactataaatccaattaacataatttatctgcctaaagagaatggttgcttttattttttttctccattttaatgatgaaaaatagttgtaagagtatggagtatttaatttgtttttaaagctttccaggcccaattttgttgttttcttttaagagaaaaatataattttaaaaagaaatttggaaattttaaagaaagcattaaaaaaatcacctataactcactatcaattttcaataattttctgcctaatattttaaggcattacaatcttaacacaaagagtttcatatcttatttttacacttaatattatatcccaaatgtttcctttatcttttctatgaacactgctataaataactcttaagatttacctccattcctttctaaagatgtatttcaagagatgaaattactagttcgaagtatataaaatgcttaagattcattacatactcctgttttgacaacctgttttcatgaaggttgcataagctcacattcgcatcagcactctgtaagaatggttacttcagttcctcactaaaatggctattaaacttttaaaagatctttgccaatttgatgagtgaaaaaagattatttccttattgttccatttgaagctatacatgtcttcatatgtttactgaccaggtgaaaattttcttttgtgaattgttcgtatcctttgcatctttacccactagagtattattatttgtctcctactaatgtgtctaagctcttttattgcctacctttcctttcttctgtagaaacatgttgttaattctcagtatttgtgtttccataattttagaatcaccaaggccatgggaaacatggacaattcagtcagcgttaggaaaaactctgtatagttttgtttgaaattgcatgggatgcatttataaatcttgggagaattgtcttcttggcagtattggctgttcctatccattaatatggtttatgcctccatttgtttggatcttctttaatgtttttcaataaagcttcaaaatcttctttataaatcctatacatcttttggtttgataagattaaagtatgccaactaattggataacctagaagaactgggtaaattcctagaaacgtacaacttattcatgaagaaatagaaaattcaaatatagcaatagcaaggagattcaatcactaatcaaaaatctcccacaaagaaaagttcatgtccagatggctttactggtgaattctaccaaacatttaaagaagaattaaggctagtatttctcagatgcttccaaaaaagttgaagatgagaaaacagttccaaactcattttacaaggccgatattaccctgatccaaagccagataaggaccctatgagaaaaaggattaaccaatatccccagtgaatgtagatccaaaaattacccacaaaacactagcaagccaaattcaacagcacattaaaaggatcatacaccataatcaaatgggatttatccctggggtgcaaggatggttcaacatatgcaaatcaataaatatgataccccacattaagagaatgaagcatataaattatatgatcacctcaatatatgtagaaaaggcatttctcaaaattcaaagtcctttcatgataaaaactctcaacaaattgtgtatagaaggaatatacctcagcatatatgaaaggccgtatataaagtttccagctaacatactcaacaaagaaaagctgaaagcttttcttctaacaagacaaaggtgcccactctcaccagttctgttcaacatagtactagaaatccaagccagagcaattaggcaagaacaagacattaaaggcatccaaattggaaaggaagaagcaaaattgtctctgtttatatgtaacatgatcttatatatagaaatacctcagagactccaccagaaactgttataactaataaattaatcagtaaaacaaaataaacatacaaaaatcagttttacttctatacacaaactatttgaaaatgaagaggaaaaatcatatttataatagcatcaaaaagaataaaaatacttagaataaatttaaccatggatgtgaaagatctatacactggaaactagaaaacatttataaaagaaattgaagatacaaataagtggaaagaaatacccatgttcatggattggaaggcttaatattgttaaaatgcccatattacccaaactgaccaataaattcagtgcaatctccattgaaattccaatggcattttttaacaaataggaaaaaaaattctaaaatttgtatggaactacaaaggaccccaaatagccaaagcaatcttaagaaagaataaaactataggcattagactccctgatttcaaactttattgcaagctacagtaatcaaattagtatgatcctagcataaaaacagacacagagaccaatggaacagaattaggagcccagaaataaactcatgcatatatgatcaactaatattttacaagagtgccaagaatacacgatggggaaaggataatctcttcaataaatggtgttggggaaactagatatgcacatgcaaaagaatgaaattgggttgctctcttatactcacaaaacttaacttgaaattcttcaaagacttaaacatgagacccgagacagtaaaactcttagaagaaaacctagggaaataccccctgacattggtcttggcaatgtttttttctttgtttgtttgttttcttaggacccactacaaagcagtcaatgacattttcgatatgaaacaaagacataagcaacaaaaccaaaagtagcaagtaggtttatatcaaagtacaaaacttctgtacagcaaaggaaacaatcaacaaagagaaaaagcaacctacagaatgagagcatatatttgaagaccgtatatctgataagagggttaatattcaagatatataagaaattcatacaactcaatagcaaaaaaaaaaaaatccttaagaatgagcaaataacctgatacatttttccaaggaagatatacaaatggtcaataggtataataaaaggtgattaacatcactaatcatcaaggaaatgcaaatcaaaaccacaatgagatatcacctcacacctttcagaatgacaaatcaacctaagtgttggcaaggatgtggaggaaaaggaactcttctgcattgttggtgagaatgtaattttttaccaccattatggaaaacagtgtggagattccacaaaaggttaaaaatagaagcatcttaaagagacatctggactccaatgctcattacagcattattcacaataaccaagacatggaaacaacctaaatgtttatcaatagatgaatggatgaagaaattatggtgcatatatgcaatggaatattattcagccacaaaaaaagaagtctaccctgccatttgcagcaacatgaatgaaccttgaggacgttatgcaaaatgaaatacgtcagagaaagataaacactgtatggttttacttacatgtggaatctaaaaaagtcatagaaacagagtagaacgatgattgccaggggatgggggttagaggaaatggagatgttggtcaaaaggtacaaactttagttattagatgaagaagttccgggaaactaatgtacagcatggtacagcatggtgactgtagttaattatacttattacatacttgaaatttgctgagacttaagtagatcttaaatgttctcaccacacacacaaaagtaactaaattaggttataagatgtgttaactaacttgactgtggtaatcatttcacaatatatatgttacatgaaatattttaaaaacataggttgacaagtacccttaatagcttgtcagttatgattaggttaaggaaattccctttaatccctggtttatttatattatttaccatggatagatactggatttgataggatcctttttagcattttttgagatacaaaataattatttgatttctcttctttggtatgttaacatagaaagttaatataacatatatgtgatttatataattaatattattattatataccaaaaagccaacccttcatccttgggataaacctaacttggtcatgatatatattaaacattgctgagtgctgttaactgatcatttttcattcatgttcataggcgagtctaatctgttagttatccttattatattttcatattgtgattttagaattaaaataatatctgctttttaaaatgagtggaatcacattctgtatttttttattctcttaaaattatttttcccttaagtgtttaaaagtcacctgtaaaactggctagatctggcaatttccccatgctaaaattttagattactaatttttttcagtagttaataggtctgttacagatttctcatttttcttgagttaattttgatagttaatattttcatatgaatttctacattttatcttttttatttagaggcatacatttcttaatatattcttatctttttaatttgtttctactcatgtttctttatccctttttcataattatatagtttatttatgccttcttttttcctttagcattcctgccagacgtttgtcagttttattaatcttttcaaagaaataacttttgttggctgagcgcagtggctcacgcctgtaatcccagcactctgggaggccgaggcaggcggatcacctgaggtcaggagattgagaccatcctggttaacatggtgaaaccccatctctactaaaaatacaaaaaattagctgggcgtggtggtgggcgcctgtaatcccagctactcgggagaggagaatcgcttgaacctgggaggtggaggttgcagtgagccaagattgtgccactgcactccaagcctgggtgacagagcaagactctgcctcaataaaaaaaaaaaaaaagaaagaaagaaagaaaaaagaaaaagaaatagcttttgtgtttgttgatctttaatattacattttttaaaaatttcttttaatactgttctttattaatttccttctactttctttgagtttattcttttcttatttttaaatgaggtgctaaacacattaacttgccctctttttttcaaatataaacattgatttgagagtattgatttttcctctaagtattgattttcctctaagtaacacttgccctgcatccagtaagtttgacagtatttctattatcattgactattaaatatttttagtttttaatatgaattatttgacccatgaattatttagaagcatgtgagtttatgagtgtatattttagttctcagtgcatggaagatttttatctttttattaatgatttccaagttgattgcattatatacaatcagaacattcattgcaatttgtgaacattagttagagccttatacataatgttttcttaaatattttatgtattcttaaaaacaatgttgagcacagtgttttatatattttttagatcaagcttttgttcacattttctgtatacttaatttttgtctatttaatctatcagttactgaaagaagtgtgttgaaagaggtaatatattttggagctaagttataaggaaaatacaagtttagaattgctatcttttaaagtgaatttaacattttatcattaagcactgatagaattatctttagtaatgtttttctttacagtttattttgtctaatttcaatataactttgccagtttccttctaattagtattttttctagaatatattttcaacccctctattttagtggtgtctcataaataacatatagctagattttagtatttcaatcaagtctcacagcttttacctttaaattctaccatgttaccacttagtacatttttagtttattgtggttcatgatagatttgaatgcatttctatcaccttattttgtaagagatgtttcttccatttgttcttaggcttctcccccaccctaccttttcttccctatataggaagttcatgtaaaatggagtgaatatctgtaatttactttgattctatagatctctctagtcttgatctttatgtgagcccctgactgctggctcattttccctctatgaattgcagtggttctgaaagatgggattatatgttccataccctctgctcagttacctctcctttgctactgccctgggctcatcattcatcttctcttttgtcactgacccaaagcctagacttcagccaggtccatgcatcttcctccacagctcctgttccttcttgttttcattgcattgctgaaccttcagagctttgtctaaaagctctaatttttaaacaagatcctcccagtaaaaacatattctcaggcatcagaggttgtggggattcagcagtatggtaggaatcattggtatatatgggtcttttataagttacatttgcaattcaagactgacagtatttagaaacaatacgacttgtcctgtaagtctgatgagcagaaaggaggagaaaatggagctcgccaaacaattcagaactgatggaaaagcagtttgctcaaaagccccatatggtttgcccattttcctctgccctttggaaattcctctaaacattagttctgactgtcagcatgcagtccagtaacatttttttttcaatcccccagctcctctgcaatggggaggcaactgacctactccagtgtgcttgaaaccattgtcactgtactcaagagcaccaggtagcactagtacttctcccaatagatggagcattaagctcaccagtgttgctcactgtcatgctgtttcgtgctttgttggtggggactaaatcttgtatagagttttcagcggtttatgctttgtttagggtcttgatatccaatttccatgttggacttcttgtttatagtttggcacagagctcattaatgttgaccccttagccattttaaagaacctcagatacgctgcagaacgtggaatttgatctatttttcactaaataaaatttttaaatttatgtgtttgagtactagctatgactactgcattggtcagataattttaatgcttttttaaaaatctgccaatatttgacatcagtgttcccataaaataaataaatgattcttcataattgcttttccaatgcttttcccatgtgactcttttcaatagttttcactccaaaattgtgtgagtagtggctgtcatgattcttctgaactggcaattatgtcagaaccatttaatcagtgcctgagctgtgctggcattgctcttggaaggccatttttcagaatgacatccacctaagcatttgttaaattattagacctataaacccttcccatgagaactctcagaaatactgttagatatgcagagccttagggacacagccctttgcaccaccgtaagtaccagaactctgttaagcaaagttcaaaactttgagccagagtggataagagtcacagctctctgtcctcaggaaacatccctccaatgtccttgtcaagagcttgcatgcatagttaatcaaggaagaactcactgggattttgagtgacatcagacaccattccagcattgcatgttgaaggattactagcagggtttccccttaatttacgagacatatatgattatccttcagcctgcagtcactgtaggaaacatgtttcttctgcaacctgcaactggtagatgccgtaagaaaatgcataaaaaattagtgctagattttgaaatcgttattaaaaggatcataaaaatcaaagcatccctgtctcagttctgtccatttgatttataaggaggctaaaaatggaaatgtaggtttcaacgggaccaggtgtggtagctcatacctgtaatcttagcactttgggaggccaaggccggggaatcacttgggcccaagagtttgaggctaacctgggcaacatagtgagaccccgtctccaaaaaaaagaaaaattaaaaaattagctggccatggtagtgtgcacctgtggttccagctactcggaggctgaggtgggaggatcactggagcccagtaggttgaggcttcagtaagctatgattgcaccactaccctccagcctgggcaatagagtaagattctgtaaaaaaagaaaagaaaagacttcaatggttccaggaaactctgttgcgtttagagctttataggtaggtaaagagatttttctgctgtttgaggcatgaatgcggtcagaaagtcttaaaatctcaagccttttcctggcaattttcttgtgctgcctgacatagggcacacgctgctataggaaactgcggtttgcttttcccttctgctgaacctctcaaaacctctaactcctcgagaaaagggattcgtgtctatttcataggactgttgtgagaatgacattttgtgtatgcgtcaagatatcaatagatattttcactgtgttctagaactgggtcccttcattcttggatcactgccagtgtctctgatcgattcagtcattataccaccagactttgctttcctgagtcatgttgaaacattattcacttccctgtgcttagaaactcacagtacttaaagccctgagtgtttatgacccctcattagtgagctccatcctacctctcttgtatctccttgttctgtggtaaagacctctcgcttgggtcatgtccacattttccctcaattccacgccactgtctttgttgcgggcatcacttgcctctgcttggagcccatttctgttctctacctttccaagtcctttaggttggttccactaggaccagctcaactcctgcctcctccttgaagtcttcccacccaacccatccatccctcactgttttctcctttctctaaactttcacagcatgttggagtccctgcagtttaatttagactctatttactacctctctatcctgtttactgcctatttcatgagtgttacaactggactgcatcttctctaagtaggaggccttcagttctttgatgtggtctccacactgcccattttggacaagctgctctttacaggattgtcatatgataggtcaacgcagaccagtaatgcttaagtttaacaactgatcataatttcttggttttgaaaatgtttagtaccaggtagtggacttcctcgtggtggtgggaagagaaatcaatatttttatcctaacagcagttgatgttattgaccatcaactgtgggctgggcactgagctaaccatttccatgtgtgatctcatttaagcatcagcacagccctcctcccagcagacatgaggaaactaattcttagagagctccatctcatatctgtgtcaccacgctcatgagaggtactgcaatctgaaccacaggacagctgactctggggctcatgccgttctacaacaaaaaaatacaatctccatcctcatcttccctatgctttgggtctgtgagacctgtgagactttgggtctgtgagacctgaagtgttggaggacaggttggagcaggtcttctatgtacatcagataccagaatgcaacctgacaactttctcctaattgtgaatgacagaaaaaaaggatgatttgtagagatttgccaaaactgtaattttttttttttttgagacagtctcactctgttgcccaggctggagttcagtgacgcagagtttcactgcaacctcccctgcctgggttcaattgattctcctgcctcagccccctgagtagctgggactacgggcacctaccaccatgcctggctaatttttctatttttagtagagatggggttttaccatgttggcaaggctggtctcgaactcctggcctcaagtgagccacccatcttggcctcccaaagtgctcctaaactgtaatcttttttatttttattttttcccaatatagaaacagtagaaatgttggaaattgaggttattgatggtgcaactatatgatgttgatgttaggattttcatcatgtaaagtggcttagttttatttgtgttgtttgtataactttgactagttgaagtcagacttacctagtgttgaaagtgagacttgagcacaaatttgcttgagttagcactggagaggcactgcaggaggcagccaaaggacagcaaagtgtatttttcttttgcgtgtaaatgttgtaatactgttttgcaataagtgaaatatgtgtgatcacataaaggagcagtggagaagagatactgaaattctttgtcaatggttgatatatagaaatagacatacttccaaaagttaatattacagttatataaacttctataatctaactgattagaaatcttacagagtagaaatgaagcttgaaaatgagcaagatttttctaaagtttgttttctgtgcctgtgtgtttccgtgtgtttcacattctcatggcatggtcaactggaaggtattccattggttatcatagctatgctactaggagagctatactttaaaaatattttctgttaactaacgcagtgaggtgcctttgaagacttgagatagccatgatttaaatggaaaagccaatatgttgtgcgtatctgtaagtacacatgagtagggagagaagtgggctagaagaaaaaaattaactatggaaaaacataagcatatccacaaagtaggattttggtttctcaatctataatattatttcatttccagattgtgaacaggtggcacacactgtttctttagctcttttgtggccaaccacacatagctatttctccatacctactcatatgtcacctaagaaactacctaaattgatctcaaatggatctaatgagaaagacatgcctggcatctttgtaaaaataatatctatacagcaggcaaagttgctttaaagtgtttatttggggagcaatgcaaagtattaaagcatctgttgtctctgcagctgaacttttctaatatttttacaacagctaatttaacctgagtgcacaattccaaagaaggaagttgtaggataaaaaggtagagctgaaatgtacataaatctttagtgtccttgtagatctgatacactgccgtactttcctaagcttatgcaaaacagaaagtgaagaggcattttgcagaaaactaaattatacatgaagtcattaaacctcacccttcacttctgattgagggattgctgcagtcgtcagtgaaagcagaggcaaaatgaaaaaataaataaatgaaagacctgatcacattatacatttcagtggaaatgtaattgcttagaagttcgtttgaagttattgggtatgtgcaaaattgcatgtagctgctgaaaataagaaacgggtcatggcacagagcatccttgtgaacccagaatctatctctcacatgtgtggggtacagagggcaagagggagggtcgccttggatgctctgctacaagtctgcgtatcccaatcagccccaaactctcctgttcattgaaatgtttacttgttgtcttgacttgtttttccacccagagatgtatttatgcacataacacacactgtttacttctttttccaaaggagttttgtaactgcctctttgaaagcatgtctcaagagggggagggatagcattaggagaaatacctaatgtaaatgacgggttaatgggtgcagcacaccaacatggcacatgtatacatatgtaacaaagctgcacgttgcgcacatgtaccctagaacttaaagtataatacaaatatatatatatataaacaaaacaaaaaaaaactctttaggaaggttgtgagatccccttttttgaagatcatatatcctcaaaaatgttctcatccatcaaggatggtctaaatatgagcattgtgaaagaataatgatgtaataatgacctctatcaaggtcatcttccatggtgaggaacgtgaaatggaaaaggcatgaaacggcatctgtgcaagacttcatagctctcaagcctgatgtagcagggctggagaaagaaggaaaggccttttccgacccttaattaaagggacttttgctggctctttgcagattgctgctggcgccccatatagttcttaattaattccgcctgtgtcattacaaagtaagccctactgaagagtgggttaacagccggagtaagctccctggactgcattttctttcacttgacgctgtgtcttgaaggctccagcagtggggtggagctgcctctaggagcaggcctgttttaatcagcatatcacaggtccgtagtcgtgagacagaacgtctccctgctcacatgaaacgtggcttgactaagaactcagtgataacaacacctctaaaaagaaataaaacattgaatgttcactatggagaggatgctcagagaagcagagattgtctgtgtgtatccagcactgactctcagcctgccgagggagagccatgcctgcagagtttgcagtctcctggccctaagatgacatccccagaaagctttctgcttcgtttactccaacccagtgctcaccacacagcctcagctcaggggtctggctttctagatagtgccactggctagggcacagcaggcacaacagacacttggaaagaaaatctccccattttaaattcatatgttggcattcagggttacacatcagaatcgcttccatttaatgtgtgtgcagccgtgactggaaatgatgcatctctaagagtgggaagtgtacgcatctgctagggctgctagactgggtggctcacacaacagaaggttactttctcacagtctggaggctggaaatgcaagatcaaggtgccggcatggttggcgtcctctcctcacatgttggcttgcaggtggtcagttctgcacgcatgccccagggtctctgtgtgccctactcaccttttctaaaaaggacaccagtcatattggattaggatccacccatatgaccttagtttaacttaagtacttctttgaaggccccatctccaaatacagtcacattctgaggtacgggagcttaggacttcaacatattgatatgaatttgtggtcgggggtggggggggggtcacaattcagcctgtgacactgagaaatcatattctttgttcaggaatgctgagaggtctcgcaatttgagacccgaccaaggttgggctgggcaaggcatcagcctcattggtgggtcccctgtgaatcaccacctgagctgcccaaaatggttgctccaaggcacatgtggctatttaaatgtaaataatttacattaaatgttaaaattcagttccttggtcatcccagcctcgttgcaagtgctcaatagccacaggtagccctaacagccatcatatcaggcagtgcagactagaatgtttctgccaacgtagaactgcccttacgttcttgttctggagggaccacgcacaatggctgtgcagtgattaaaagaatcccgcaaccagcaccctgcacctgcctgctttgtgcccagctctgtgcctgtggaagttaaaaatggggatgcaggccccctcttcaggcaacacggtctaattgtgccagtaaaaataacattaaatctcacatattagagatgtgaagaaaacttaaatggcacatattaatacccatgatagacttttgaaggataaaagaccaatcaaaactaaagtagaaaatacatggaaaagatagatttgagctgagttataatggttacaccagctttgcaaaggaagtgaaggaagggccccctgctcaatgaacatcatatcccacagcaactggaacgcagcgggcgtagaagccagatgtcgtcatgctctttatctgagacacacaatgacaccatgctgcattctctccctttcatgttttagtgtctcttgctccttctcagcctttcctgtgcatttatcgctacatccttgggttcttggacatcctggcagatccactgggatctccttcactgtactctcttcctctagaagtgttttgttcctggtctctcctcctccacctacagcaggatgcttgttgcggggattatcttagggactccaaaatcacttaagcatggcccttctacagcaacaaaaatctgtgccgtgcagtaggatggccactgctgcttgtggttctgagctctctctaagtggctgtgatgacggaggaatagggcaggagtgcttgactgcaccataaactaagaacccacagcttcttttgcctcaactctttccgcaaccctgacctttctctagtggatgcaggaaagtttcaataaccctaagaaatgagtgccacctccctgttcactcatttagaggtagaagtggattgaggtccacagacgcatttgaagaaggcgtctcctaacatatccagtattgataacaactctgagatcacagattcaatgttgattattcaatattagctattatttagtttagtaatttaattatcagacattacaggtatttgcaatatttcatatcaagtttaagttattttttcaggacccaaggcttggtggagaattcttagccattacaccaaaagcattctccattaaagaagaaaatcaagaaattagacttcattaaaatttaaaactcttgctgtgtaagaggatgaaaagacaagctgaagactgggggaaaatatttacaaactacatatcaaaggattcatatctaaaaaatataaagaattctaaaaatttagtttaaaaaatccaattagaaaatgggcaaagacatgaaagacacttcaccaaagagaatgtacagatgacaaataaacacatgaaaagaagtcaacacgaccagatgataggaacatgaaaattatgaccatgatgaggtacatcatattagagcagccaaaataaaaagcagagacaataccaaatgttggtgagaatggagagaaactgtatttcttgtaaactgctgctggagtgtgaactggtacagccactctggaaaatctttaagcagttcttaaaaaactaaaacagatgccaggcgtagtggcttacacctgtaattccagcactttggaaggctgaggtgggtggatcacctgaggccaggagttcgagaccagcctggccaacatggtgaaaccctgtctctactaaaatacaaaaattagctgggtgtggtggtggccgcctgtaatcccagttactagggaggctgaggcgggagaaacgcttgaaccctagaggtggaggttgcagtgagccaagatcgcaccattgcactccagcctgggcgacaagagctaaaccctgtcgcaaaaaacaacagcaacaataacaacaacaacagatttactacatgacccagcaatagcactgctgggcatttatcacagagaagcaaaaatttatatccccacaaaactctgtaaataaatatccataacagctttatttgtgatcaccaaaaactggaaacagtcaaattgctcttccctaagggaatgactagacaaactctagtacatccatataccatggaatattactgagctgcaaaaaggaatgaactaatgatatagacaacaacttggatggatctcaagggcattgtgctcaggaaaaagaagccagtacttgatgattccatttgtagaatcttcttgaaatgttaccgaaattagagagatgaacagtagactagtggattccaggaattaggggatattcagtgcctattcagagattccacaaggaagtttttttgtggtgacaggatatttctttatttgattggagatctacacttaagacgaaatggcatggaactatacacacacactgtaccagcttcagtttcctgaggtacagttatgtgaggtgtaatcattggggaaaaccgaggaataaatggaagctctccataccatccttgcaacttcctgtgaatctagaattatttcaaaataaaaagctttttaaaatctatttattagtataatttaaaatttatgtcaaatttattggttaccaacataatgattctttaattaactcactggtgattatcctgataataaggttaaccttcagtttgaaagatgctggggtctcttttcatgagcataatttacaactgtaatgacaaaatgaggcaaggatttatgtcaattaacaggcttacatctatgagacattttgggtaaaaattttagcatggtacttggaacacagagagctgcatttgttatcttgtgttattgttagtattatgttatttatttatgttttttgagacagagtcttgctctgttgcccaggctggagggcagtggtgcaatcgtaactcactgtagcctcaacctgaagagatcctcttgcctcagcctcctgagcctgagtagctgggactatgggcatgtgccactatacctagctaatttttttttttatttttagtcgaggtggggtctcgctatgttgcccaggctgttctttctcctggcctcaagcaaggcttctgccttgtcttcccaaagtgctgggattacaggtgtgagctaccacacctggccaccattgttcttattaatactactgaattggttatttattgtgattttactaaaagaatttttttgtcatcaaaatcgtttgagcctgcatttttttcttatgacatttcttggcaaaaactcagattccctttcaggaattttctttgctgaaacaacagtctagctattgtgtgaaagtccattctggtaatgtgggtcctccaagggcattagctctcggctgtttgcatttcaaaattgaccctcaagtttactttcatttactttcaactctgttgccttcttgaaaatgttttaaggcagtacatctaataagcatgaagcatcttacttttagtttaatcccaaaccttgtagttctaaataaaaaaattgaaccacgtgcccctaaggttttaatctaatatctggtttcttgaactggggccagctcttcatttttcaaagcatcaacagattctaaatacaacttctggcaacctccttttagcatctgaccttggttcacttaaactaattgttatcctttcagcagactgtgattctgaagggggaagaaacactatactgtgaaacattagaggagtttttaacatttggggtataatgccctccatgtaaaatgtctattttcagtattaccctctccctgcctctactaaaaattaaaaaaaaaattagctaggtatagtggcacatgcccatagtcccagctactcaggctcaggaggctgaggcaagaggatctcttcaggttgaggctacagtgagttacgattgcaccactgccctccagcctgggcaacagagcaagactctgactcaaaaaacataaataaataacataatactaacaataacacaggataacaagggcagctctctgtgttccaaacatgatggtaatttatttaaaactagatataagtatatactttttaaaaaacatattcaagaaccaagcctcaaaaatactaaatttgaatgcactcaggatgcatgaatcttctgatttataattatcatgtatttttcctcatacagagctcctcctatgttccaggtagatgctgggtgctgaggatgtggaagactcagccccttcccttgtggagtttatagtctggggaggacagagatgtttgtgactctaatgatatgtgcatttccatcaacattctacaagttctacacattctactaataacatgccaattcagtggcactttatatatgcaagccaacatggttttttccactgacattcacaggttttaatacagaaagcaatcctgttaaacaatttaattataaaaattctactgtaaacattaaaaagcaaattcagtaacctacctgtggtcacacagttaggaatcagtcagagctgggatttaagcccaaatcttctggtcctacatctcattcttttgcctcagcaccacttaagccaaggtgagacagtgaattcagttttccccaagtgtgagatgcaaacaactgatgatgtacaaggtgatttttaggaggcccactcatggggaataagctgtgctgaattgcaggtgagaaagtgattggctttcccgttagttgtcgttcaatacttttgattcgccagggaaccttggtttgaggcaagcgttctctctcagccaaagaagggcctggcctcaggctccgaagtagtcaagcagcactgcctggctggattggatgctattccttcatttttgttgtctcgactttttctattatctttacctgaggaaagagttcttggcttggctgggcgtggtggctcacgactgtaatcccaacactttgagaggctgaggtgggcagctcccttgagcccaggggttcgagaccagcctgggcaacatgatgaaaacccgtgtctataaaaaatacaaaaattagctgggcatggttgtgtgtacctgtagtcctagctactcaggaggctgaggcaggaggatcacttgagctcggggtcaagggctgcagtgagctgagatcacaccactgcactccagcctgggcaacagagtgagactttgtctcaaaaatgatgcgaaatttcatttgcaagtactgtaaatgtatttgcatatacacgagttaaatttacatcattcaataacagagggaagtggtgaggggatgagggaagtgctgaaggtgtacatgagtgactaaaatttggaaagacctcgtgagttgctgctgagtcctcctgactgcctttgtcacttgcctctagggattctcatttgctccttcccatctgctagttgcaacttcccaatttcaaatcacattagtgaaatgagtaacgtttcaagggagtacattcagatgactacgacattcacccaagacctactgtaagatgatgatctctctgttttgagaggtgaattggttcttccaggattcccaagggtggctggaaccacctctgactctacagatgagtgatcagcaccacgtggaaacttccgccatgctgggatttctgctccataccagtgcaggctcattgttttcacttatttagaatctcatatttactcttgtagactaaggctgactgccaaggcttcccttacaagaagtaatccatgtgatctaaagtgagagtattcacattcttcagtaagatatgacatttggctaaaagtcagtctttaaataaaaggagagcctctatgactctacagataactttgggttataaagttccatacaagtgtttgcttttaagagtaggcattgaactttctggcagagtaaattgagatgtaatcattttttgctaaactgttttaaaagatatttctaaccttattttctaaatttctaaaataattatacgttctaaattttgatctttagttaccatgacttaagtattgcaggaagagcctgggaattgtgctgatgggttttataaattaataggtgtcaaaaaaagagtcacaaatatcacattaaaattcctttttctgctatacttattcatttccaagcctgtcatctcttaaaaaaaaaaaagtatccttagattttcagtcacatttgatggagtttatgtgctctgatttccgaggtgaggacatttaaaacttcacagctctccaagaaataccaggaagggatgtttgctttaaaaaaaaaagagaaaagagggacaagaataaaacccccacccaacttccaaatactatatagagtcagtgaaggaaaaatacagacatgggaggaaaaattggaaaaaattttcttggagacaacagcaaaaactggcagtcaagtcagtaaggatgtactgtcatcaaggtctcaggttttcatattagaatgagaatagtaacaggtggcctgatggagcactggctgcatgctgggtgtgtcacacatgttgagtctcaccgcccttcatgtggccatggtgtcaggagggagacttgctcagttttcaaataggaaagtgacagctgccctggtatgtttataacagcttactctgggacaagtttataaactggagggtggcaaagagaccagtcaggaggctactgcaataatgcaggcaagagatgggttggaggctgctctccaaaggaagggagcagctgaatttccacaaaaacatccatctgctctctagatgttttcaagatgccttttccaaggaggtattcttactgctctctaaggatctgggcgcatttgcacaggctcactgtcaaagtcaggtgcagaggtggaggaaattacagctcttgagtagtgtgaacctcccaaactctggcaatatctgcatcagaggcaaaatgaaaattactgtctctctgaaatttggggtgacaatcctagagacaagacctaagcctagcatgacttatagaaacacagatactttcagctgcctctaaaacagagcagtcctctttgggggacctgtgacagattgctcactgacatcactattttgacaccccattaaattaccatggcctctttgggtttgcaagggcactgcagtgagaacaggggcagatccaagttccagaatcttcaaagattgatctcattgatatacatgggaatcaagagataggcaactcaaaaaagtcagctttgaccaagttttatgtaataaatctaaacacatagaaaccctttggtccagcttctccaggacaccatcctcattccataagaagcagcagagagtcttgcaggaagaagtaatctggaaatgcaggctttgacttccaaactgatgaaatattcttgtgatgagcccttgagagcccctgaaggggggtgccaaagaaacaaggactccctgaaatgcagctgagagcttcatcattggcaacatgacagaggcacccagcctcgagaagacattccagataagggggagccccaggcatggctgaggatgtaggtctctgttattaaactgttttttagggaacaaaagaaaagagtagtgccggccaagaaagggttgaatatcccctaacacccaccgtctgcttcttacaattaatgccctactgacactcaccccaattatatcaaaatcatctcctttttggagccaccttattctgcgtcagtctctataatcccacagaacagtggccttgtccaaggaatgttcagcagccgtgaacactccgcagttactgtttccatgactatttccccttgtcactcacttgaaggatatgtttttttgctcttgccacttgatcaatggttctcaacttatttctgctccagtgctcttgagggctgtgtcacttcattagcgggagctgactaccacagtgcttctgaaggtgggaagaaaggggacttttgaaatggagcaaatttgaagagaaagaaaggcaacttgattgaggggccctccagggtgttcatactcacatcaccaggaagcatcgctgtgcaggtggtgataggactgtgccactgaactggctcattccataaaacgtggtaaccagaaatccttggtggcttaagacccatggccagggtgacttcagagtgccacatgcacagtgcaatgcatcaggcacaaagccacaggttctgagccagttttgaggccaaatggaggcgcactaagttcagagtggaatggccttggcttgggtcccagctcttctgtttaccagctgtgtgatttcaggggagccactcaatgtctttcatactaaatttccttatctatacaacaggattaaaatgctcaccccccaatagagcttcacaaacctcataagcatgtatggatcaacaggaaatatatgacattgctgtggaaaaggcacttgtaaaatccctcatacagagtaatattcaatagaataagaaacatattctaaagctcagtcagacatcatggggactgtttataggcatgaaaacattgtgtgtgtgtatatatatatatacacatatatacgtatatatatgtatatatacgtatatatgtatatacatatatatacacacatatgtatatatatacatatatgtatatatgtgtgtgtatgtatatatatacatatatatacacatatatatatatacatatatatacacatatatatatatacatatatatatacacatatatatatacacacatatatatatacacatatatatatacacacatatatatataggcggcaaacctcaatcccattatcaaaagagaaagagctattaggtaaaggaagataattgtacgataacaattgccgagatcatgatggctgctctgaatcctgcaaaacagaaaaattctgcacaatttcacgttggattaagttgcaataaaaagtggccagagattagcagcttctttaaaagatcagtgaatgttcacatttagatttcggtttgtttagaaacctagttcgtgtgtctagattcttgttttcacccagtcctcacctctcttagccgtgaagcatcacatgctccttttgcctgcctttgttcaggacactggagaatgacagtgaccagtgaccattgccatcactgtgcctgaacttctggggcactctgccttgtggcccatcaggcaaagttaggtgtcttcagttgctttagtgctatagcaataaatagtttatatgggatctaataaaatgcgatgcttcgaagcaccagaagagaagtctgagcagaaaacaaagaaatttcacagactttgcatgccccagtgagttcatcttccttctttcaggttgatgattttagtcattttacatgcacaattttattcatatgagaaagggaggaaaaattttatttcagaagcatctaaaaaacttgactctgcactgcctgaaaacatactgcacattatgtacggccttgacctgcatccctttctttctggcagcttttctgttgaataggatttttttctccttttttaatatctaggagttgtggcatttttaacagactgcatcgttttggagtaatgttctcttgaggtgggcaactgagatgtataattatatcctgtggaaaatggtggcggtatgaggggtggggaaggaggttattaaatcacaaaaacatgtttcctattcagaaaaaaatgacagtatgcaggatgttcaatttccttctgctctgtgcccatggagagtacagcatcttcaagtggggaagtcattggtattcactggagcttgcctggtttcatttttattgttttggagacttattactctttcagagtggttcccaggtctgctgcctcttcgcagtatatatgagctaaggtagtcagaggaaacactttaattacattttaagtagaataaaagcataagtatatttatgaaaattctaacagaaggtgcagtgagaccattaacttaaatcccaaaaatacatctagtgtttttttcataataggaagttcatagttggtgtgttaaattatacctgcatatttaaaatctgccctaaacactaaatattgcctaaatgtgcatattatattcaaaatcccacctataaaacttgtgctgggagcaggggccatcattgcctgcctcacacacctgtccttaagttgctgctctgcagatgggatgtcctcaggggctaaatgatgcttttagccttggttccctcagccatccctcctgctctctctcattgggcctcttgttcaaaattatgcctgagctttggtcgaatttgattttagcaagcctgaacataattctgacaagggaagactctgaggtgagagttagaggaggagttggaggttgtgcttaaacttgaatgtaaggatttgtctcaggcatagaaagatgcaaggtgaagataagcaaaatttcctcccagagaccagaagccagtcgttggcatatgcttcgaaaatccttattccaaagaacaaagttcttttctgtcgcactgggaggattcaaaacctgattagctttactttcaacaagtttgagaggaacccttcttttctacaatataaattatttggtgattacttcccaagaatattggttcagagtagaattcttcttaaagcattcaatattcagtttctgtaattttaaaagaacatgtgtaacttttgacctcttaaagataaaaaagatagctaaagaaccttttattcttgcccaaagaaaaatgcacgggtgaacatcttacaaaatgtgcactgactttgcttaatttattaaaagatatttaaaagtaaaaaagtatgtgaaaaggaacataatagaataattgcatagtaaagttacacataacccaatgttatttgattttccccaggcacattttactgttgtgtttattagtgattatgcccatctcatggtcttccaaaaaaaaaaaaaaaggaaggagggtggactcacagggtcgttaagagaatcctcagtctctctagggaaggaagaataaaggaagtgtatctgccacctctgcagctgcacatctgtggcagtcccggctgcaaactagacatgaagcagtattctaaggcactgacggcagtgttcctatcccagttactgtacttgccctgagaattgttagccaggaaagcaaccaggggcacacagtctgagagatcgtaccatatcatggcttctctgaatattcagtggctccagagctacagatgaagttttattttctaactaaaaatttaaacaattggtttttgtctcactttaggcataagagggagtctaaagtaaatattttctcagatatcttgaacgtatatgctagaaaaaagccataacattcaaaactggatccatcttaggaaaaaaacatttttaatctccataacaaaaggaaataaaagccaaggcaaccaatctagaaagcctttcccttttctctctgggctcccataggtttattacttattttctaagccagggataaagactcgtggtcttaataatccaaatgtatccatggggaaattggctatataattgaaggaacacttacggaaaatgcaagacaccatcaccctatctgtatggagtcaggagacagtgacatttatctatggaggcactagttatctgaccttttcctcagagcatttctaattttgttttgttttttaaaaaacacattttgccatttatagtgattcatgtaattcctggataagaagttgggaggctcattgcaagaagttgaacttttcctgcagtggctcccatgcaatgaacacatatcatgtatgagaagaaaaattcctgttttatagaagtaatcaatagttaaaatttaggtgacatttttaatattcttttgttgtaaacattctttcagagacaagcagagataatcttggcatggaaaacaattgttggccatgtgtatttaagttgacttaatagtgttttcttctcaaggtcattggggtaagagtggtagagaaaaagcagtggataaagagtcagaaaacactgacttcggatctaggttgtgttagaagatgttgaggtgtctgtcttcatctcatgtccctcagctgtaagggacagctcatgtcctctcctccagtgaggatcaggtgagaggatggactcattcatctgcacatacttttgatgctctcataataagtgctcagagatggataaaacttgggccccatctgtaggaaaacattctgggaactgtagtgctcaaatgcagtacaattggttattatttcatttgttgatttgtgtctgtttcttggtcaccaattaaatgaaaataatacaactaaaataactatttttaaatacaagggctattggcagtcctgtgataaccacaaatgctgaagaaacacagctgtgatgtgagcatcattccccacaagggagcctctgtgtgtccagagagggcagggaccctcatgtggctcgggtccccacgtgaaggctcagggaatctaggggcattttctgtatgagttgaggctgtggatttactggaagacttcaaggtctcaaagtcacttttcttcttccatcttcctacaaaaaacaaaatctgagaactttttagatgggtggaaaaggcagagggaagtgaaattggtaattaatcatgacaaactcaaagtggaattaaatttttggaagtcaaatagtagttattactcaactataaaattattgtcattcatagagtaacaaagacagtattcagaaaaagagtatctgactttaaaatccctgaagctatttttaaatgcatgttatgtagcagaatagaagctacatgtttgaataaatcccctgattatataaaggtcttgttctagatggaatcaactagcgatttttaatgatagtatttgtattgagttaatttattaataacctgaaagtgtttttatttgtatttgccctgtatcatacagggttttactttttatattagtccattctcatgctgctgtgaagaaatacccaaggctaggcacagtggctcactcctgtaatcccagcaggtgaatcccaaggcaggtgaatcacttgaggtaaggagttcgagaccagcctggccaacagggtgaaaccccatctgtactaaaaatacaaaaagtcagctgggcgtggtggtgcatgcctgtaattccagctactcgggaggctgaggtacaagaatcatttgaacccaggaggcagaggttgcagtgagctgagatcgtgccactgcactctagcctgggtcacagggtgagactctgtctcaaattaaaaaagaaaaaagaaatacccaaaaccaggtagtttataaaggaaagaggtttaattgatgcacagctccacagggctggggaagcctcaggaaactaacagtcatggcagaaggggaagcaaacacgtccttcttcacctcgtgacagcaaggaagagtgccgagtgaagggtgggaaaagccgcttataaaacgatcaaatctcatgagaactcactatcaggagaatggcatggaggtaaccacccccatgattcaattacctcccaccaggtccctcccacaacacatggggattatgggaactacaattgaagatgagatttgggtggggacacagccaaaccatatcactcttcaactagcgatgcatagtgtgagtctgttaatacagctgttcatatatagcacatctgatcctaccatgtttttgaaatgataaatataaggtaaaaactattatgataatgaagtgttacctatgatcacgactaagggaccttaagatgagcagattaaacctcttaactcttaggtttgtagtgttatttttttcagtcttctgtgttgtgttttaaaatggtgttgctcaactgttttattgggtggatgtacaggggacaagatctgaagcctgagggcagaacagacctggggctagggtcttctccagccagtctctgatgcaagctcggttgtatggtaacagcagtgtccatatccaccaggccacagaaaagacatggacttgacaaactatgtaactaattactggattccaaacataaatgatgaacacatagctcccactctcagggagtccacagcctggtggcagagacagacacagaaacaacagaggatgccaggcactgtccacttagtggtcagaatactatgcagcacacaggcaggcagagtggggcacagacatctcgtggcgtctgcgagcagtgtctcctactgcagcagtgctaagcaacagtttacctcatgggggagagttggacccacaaaaaggaataaatacattctacctagcgacagactaatctgaaaatattgtaaatggtggaaatggccaagacggctgaacaccacaggtgagatggagaccggggaggaaggaagagcttctgtttgggagagaactgagagaacttgaaagccaccctggagcacatctgaggacacgagtccctaatgccatgttctctggccccaaagcgttcccaaatggtgctctcattcatctgctcacccttcatctcttcctctttccctctctcttccttcccagtgggtgccaggaagtatgtgagtaccgtggcaaaaacaagaaatagctttactgaatcctgttcacttccatccttttcccataacctcctcacatagttgaccacataaaggtaaaatgtagtgtgaactaaagtggaaataaagacacacattttattttacttgtccactgagagtaggggacattttcattacaacttgaacaaaaaaaaattgaataacctgaagattaaagactccaggcatcatagtgccaaatccctaaataaatggacatctaaactccattaaaaatgaagagaaaactttggcagagtttattacaggattttagcctggaagtcataaagtctcagcttacctactctcatgttttaaccaaagataacctttcttcaattagcaattagggagaaaaagacatcactgtatctcttacaagaatattgaaaaatgacaatataattaagaaattgagtgaaacattaatttctctgtattaaatattcagctgagatggggatgaacatgtgaccatttttactcggttatacagagaaattgtgggttcactcttcagcttccatccctgtgtttgtaaggtactaactaaaggaaaacaaagtttagaaaaagctaaatgaaatatttaaaatataaatgtagtgtaataatcccttgtctcatttctgtcggcattctttccttcttgacccttgttctacgttttttaagaacatcctccatcgttaagatccctctgtttactgcgccaaattgtaattctcagtctcactttccttctagagcttctttgaagggcagtctgcaccatgggactcggctaagaaagatgagaacagaatgaagaacagatacgggaatatcattgcatgtaagtgtcaacagtgtcattgtgctgttgtagaacttcctttttgcatctagtaagattgaccaccaggctcatacagaggaaatttacagtgcaattacctccttcatccttctagaacagctggtgttaacgctcgtactaaagaaaggaataactgtctacccccacttcatcattgtactgttgtcgtgggccctgttttccttttagatttaaggtttgggtaacacaggtaacgttaagatgctgagaaggaaaatgcattttggatggagtaaacattatagtcctaatggttcccagctgctacgtgagaatgaatggaaataatgatgcacagcttgccttaatgcaaagagctcagagttctcagcaaacattaactcattaatcctgtggacactgggttaggtaggtcagtaatagccccattttaaggacaggaaactgaaactcagaagttaaatgatactccccatatcacaacactcattagcaaaagaactaggattatagcttagacattcccagtgcctgtgaaactgaatgttaccaacccgtaatgccttggatggtttctaagtcgagcccagcctcattaatgttgcgtagcaatgctgagacacgcgctagattgatgaaaccccttctcccagggcccgcactatccatcccccacactaaactgctctccgtcatccatgactgcatcaaggcactgacaggcccgctgtagtcgcctaacataattaatactatttataaagatacataaattttaaaaagcaacacaacaatgcagattaggccaagagaacatctcgctcctcgtgtctcatttcttacgagagaacaaacttgggaggtttggttattccagaggagcaatctattagctttattgattgtgaaagtgctgttaaactgtctttgcctgagttcacatttcttagtgtgacagtacagattgtctaccagtgctgcccacagaatttcctgtgactgcagaaatgtttcgtgtctatgctgtcccagacggtagccatgagccacataggagtagctgcactgtgtacttggaatatggccgtacgactgagaaactgaattttactttatttcttgtttttgctgttcaagagtttgacaacatgaattttaaattgtatttaattttaactatttttaatttaaacagcccatgaggctagtggctactacatagggcagcacagatttcagtgtgttgtagaaaaagaaactggggggtagagtggagcttacatatgacacaaaacgtcccagctgagcacatgctgctttccctccggccatcaagaaagccagatcgccagtgttgccaggtataaatgctagcttcatgtgttttgtaggttggttttagagcgtgctgtatttagtagcattggagtggtcatgtcacagtcctttgtaggtaggagatgctgtcctgaggtctagggttgattactcctcagtggatcccatcaacacttgtgggatgcattcttgatactggacactgaggacgcaaaggccatggagatgagatggtgcccctgtccccaggacaaacccaaccgggcagtcagatcgctgtggcagtagtctagcgccgtgacacagggttttgttgcagcctggtacacagtgttctagaggctcagagaaggaaaacatggtttcttggtctatctagactcttccaagttccttcattttctctgggagcccactgaagctttgcgctgttagaagaattcagatttctcctgatggctatgacatcctttccaggagtcccttcagctctgcaacaaactcacagagagtcttggaagtgaagtggggaatccccttccataccaagtggaagagacattgctgagcctataacctcatcattgtggcatcactgatgtggcctcgtgctgagcatacagaatgcaatgaatgtcaaggggtgtagccttgggtatgctgagagatccagctagcctttctccaatacaacattgagtctgcttcttcccaatgtatagtttagtacctcctcatggagacactgagatatatttttgaatcatgagtgaaaaaagctagcatttgctgagcacttacatatgccagacactactctaagcactttgcacatcgaaacccgctcactaacaacaccacgaaataggtagtatttttgtatctattttacaggtgaggcaattgagggataaagagggttaaagagtttcacggttaataaggtatggaggcaggattccaacccaggagcagcttttataaccactgctggatgggtgctgggatgactggtcccactggcttggttttcaccaggtgtggtggctcatacttgtaatcttagcactttgagaggctgaggtgggaggattgcttgaggccaggagttggagaccagccttggcaacaaagcaagactctgtctctacaaaaaaattttaaaaattagttgggcgtgatggtgcgtgcctgcagtcccagctactcaggaggcggaggcaggcaaacatgaggatggccctgtattgattgtttcctttctataaaacgtctgcaggctccccaccacgttccaagcaggttttctcctttaaacctccagagatcctgcccatttgtctccacttggcccgtgtgggtatttggtgtacagctgcttgtcacaggaacactgaattctgttcctgtacccgttgctcgtcacagctggacagagagtatgtacttaaaagggtccaataatccatctcttcattcagtaaatatttattcatcactttctttttgccagactctgtgggaggcactgctataaaaagataatgaaggctgaggcgggtggattacatgaggtcaggagcttgagaccaacctggcaaacatggtgaaaccctgcctctactaaaaagacaaaaattagctgggcatggtggcatgtgcctgtaatcccagctactcgggaggctgaggcaagagaattgcttgaacctgggagatggaggttgcagtgagccgatcatgccactgcactccagcctgggcaacagagcaagactccagaggtctcaaaaaaacaaaaaaaaaggaagataataaaacacaagatactgccctcctagtagttacagtctagtgcagggggttggcaaacttttttctgtaaagggtccagtagtaaatgtgttagcctttaaaggccaatctcagtctcagttcagcttcttggctctgctgttttcatgcaaaagcagccacagacagtacagaaacagatgggtctgactatgttccagggaaactttttctgaaagccagacagtgggctacttttggcccacaaacagtagttttctgactcctggtttagtgaagaacagattccacaaggggaactttttcttaccccccagggcacatttctaccaccaggatagttttcaactctcaggaccctgaacttgggatcaattttttcagcaccccaaacagaggtatcagatgtgatttgtgtgtctggcacaatgttgtcagaggcgggatgggtttaaatctacctcctaccaccatgaatttgcagtctgtggccagatcaggataagacatgcatgaaataatagatctcaggtccataaataaatggagaatgtgttgtgaggacaccactggggacttgcaggagaagggtgagtggacgagtggcagactaatcaggaaaagacctctcaggcaaaagagaaggtcgtagggtttggagataggaggaacagtttggagtccttgtcctaccacatactggctcaatgaccttgggtgagtcatgagccttctcaatgtcagaatttcctgacaagatcacgtgttgtggaaatgaacagaaatgccacattaaaagaacattgatcgttgttacctgaaaaaaaatctcacttcttcattacttctgtgttactcatcttgagtttagcagattcattacttcattaaaaaaaaaaaaaaatcagcatgttgaagtctccgatccaagtgatgagctggtaggtaattcagggaccatcctgctccttactagtgagcacgtctatgtgcagtggcccacttctgcccaggcgggactctggcttctgtttctgggcattgcggtgggctgtcatttacccatgacctctggggctacgttttctagcccccaccgccctccatcccatcccttccagtgctcttttagtgtttctttactgggttgtgttatttttgtatctttctagggacagtgtcaaaaagagacttctctgtccagcctcctaatcttcctctcaccttccatggcgtcctgaagcccttccctgggtatccgtgttaccccttcctctagtttgctgttgcttcctgtacccacacacacataatgacccacgcatacatcatgactcacacgtacatagtggctgtttctttatgggcatagtgaatagtattaccatcccctgcctaaaaattatgtaactgtagaaaagtcagttccactgcctgtaaagtctgcttcctagagcctcggacttgggataacaccactaactagaataaggaattgggaattcagtcagcatatcttagagattcttgttagtgcttttcaaagaacacagaagtggtgtaatgatcacattcattgtttttgcagcagtgtttgcatataaaatagttttaatggtccttaaaactgtttattggcttttgctcttaagtaagttaacttttcccttatttacactataaatttgctgagctagccccttccaaatataaaccaacaccctacccaccattaccgcccctccacacacaagcatagccctcctaatactctcaacagttcctaattataattaactctaagcttaaggcacacaccaaatctccctgctaacgaggcagcccccttgcagccggctcctctttctagggactggcaattggagataatgagccagaatctgcagaagcttcccaggctcccttcctcctctcttctgatctttattcaacaagtatatattgatctgccatgtgccaggcactgtgccaaaccacagtcattctttcaacagatatttgctgagtgcctgttatacaccaggcactattctaggtgtcagcgagagagcagggaacaaagcagacaggatgctatgctggtgtcgtgctgcaccttcttgtggggaagacaggagcaattgctgagtgcagggtgtcaacacccatgttaggaggtgagcacccagcaaggaaaatgaagcagggaatggagattggtcagggtgggtgatgtttttagactgtggtcaagaaaagcctcccagaggggatgagatgccaaccaggacttgaaacaggtgagaagacggaggagtgtggccgcccaggtggccggtacagcagggaaggctgtgctgccggagcagcgggagtggggtaggggcagaggtgggagatgcagggactctggggtgaccacaggagcaagagctgacagggcacctgccctcctgaagctgatggtcctggaagatttcgtgggggagaagggggtgatgtaaatgattacaaaataaaattcaagttaagggcacagaaggagttaacatggtaccatgagaactcacaacgtggggactgagtgaggaggtatgggaaggcctccctgaggatgggacatggaaaacaactgaacaagaggggacggagcagggaggatgctgcagaattgggaggggttcatgtgaacagaccctgtcatgccggggagccccttgggtctgaagaactaaaggaaggctgggtggctggagctggaaggacaggggttgggcaagagaaggagggaggtggaagccagacctacagagccttctggggcaggttgaggacttttgtctttattataagaataacggaaacttcattaaaggggttgggggggtgttaataaaatttcattggaaaatttagatctgactgcagagaaagtaggttcgaaagggacagctgttgaggaatttccagtagcccgagtgtgacacgatgatgatgttggctagaaagaaaataagtagatgaattcagaagaagtaatggacccaaccgaaagatggatgggagacagggtgaggaagacagaagagccagagatgactcctgcgtttccgacttactggaggatgaatggttagatggatgatgggcagttgaacaggtagacacatggaaggatggatgggccattcccttccagtattatccaggatggataatactggaagggaaccagctgtggagaggagctcaggttggcatgagatcaacagcagcttatgagtttgatttggggacatattgagatgcttttgaaacatgcaaatgcgatgccaagcagacagttctgtagactgctgtgaaatctgaaagagagggatctgggctggattataaatcagtgacccatttcatgggtcatatgggtggtggtagaagccattggcaggaggaggtgatctgtggagggagcaaggagggcatagagagcccaagacccagctaaaggggctttaataatgggcggtcctgagacagaactgctcagcggtgcagggagcactctcatggagagaaggggtgctgctagtgtcctgttggtagatctagtagatctagtacagcagagactctgatgtagtgctgaggacacgaggtcccttctgaggtgggttaccatgccctcctactccatttcctaacaacgaggtgtgactaatcagtgactggagctttggacctaccccagattcttctagccagtgagccaatcttggttgctcacattgaaggcttcacttttctaacattttgttttatagcagtgtgcttctctctgctaattgagtgactccaacagcgtctttgaacgaagggaaccagagtttatagttaggtaagaatggcctggcagagcgagcttttggcattaaattcaggtgggcacgagcaagagagaagcagatggacacaatatgtttaggaaggcatagggtagaataaataaatccctgccaggattctgaagaataaagagagagctctgacacagggattagtcagtcagaaaaagagttagaaaacaaggcaagacccacatgaaaccaacaggaagaggaaaattcatatggagccaccatcatcgaactcaaacttcctgctcagaacctgcatggcagagctgggaaccgggtggaaacaagcagggagactgcactggaggtggcatctccaccgggtaaggcgccaagcacttcctgagttgcaggcacactgggtctcctgtagaccctaccttgaaacaagcacaacagcaatcctcagcccaaatgcagccacgggaggagcaaatccattatttgcagaaatcaattgtaattaaaattaatttccagccttctctcagaggctaaatattaccttgataattgtgattccaatttaccttatatatgtcaccagtatgtagcagagagaaagaattggttagaggtgaaagattatcagtgatacactctatttctgccgctgtgggaatatctaatcacacacaagttaaaactgcatgactattgtcaatatccgtcatgtttaatatggaagtgttaaaatatttgaagttacttagagatatttttaaacgtaatgttacctgatggaaagggcagaaataccatgttctacagacttagggtggggcatagacctgccctaaatctcgcatcaccccagtccaatgcatgcctatgtacacggggggaaaacctcagcggattataattcttcaacgctaagcactggtttgttgtgacaaggtctttatgtgcctgtttcttacccaaaaatatctgcttttctctgtttcatctagtaaaggctttttttgagagatatgagacaaatagcaagtcgtttttatgcagatggagtttctcaaagtggcagagtttgttacatttcttgatggggtaacattgagttgtgattatgatataaacatgagtttaattttgatcatattcaagtcatgcatggcaaatagatttctttttctccaattcatacacattaaagaaactttgtacactgtggaaaacttggggaacatatcccagaatctcaccatccagattcaaaccctgctaacattttttttatgtttcattccagtcttcttatttttctatctcttgaagctgttgactttattttttttttttttttgctctttgtttttcaatgagaatagatgtgttattctctttctaattacaaagataatataaaccttgtggaccattaaagtagtacgtaaaatcataaagatgataataaaaatcactccagattttatcccctgcagaaacctcattcttccagttgtcccactgtgcatacctacacgtacaccaatgcgtttgattatttcatgtaaatagactcttattagacatgctgccttgtagcctgctcttcttcactctgtaatatgtcccagagatctttccaggtaaataaattaaaggcctggtaatccttttgaatgattttatcagattttttgcttgtttgctcaccattcttcagtctcctgtttatatcattgaatggttaccaaggtggtgttaggaaaaaaacgtctgttttagaaaaagcagtccttggcatggattcactagtgagggaagcaactagaggcaaaaatgaaatagtgcagatgaaaatgatcaggtcttgaattaagtcattggcactaataagacaagtgatagctaactttcccttacttcttattgtataccagctacttactaatgattacttatattaattcacttaatcctcacaaaactctataatataggcagtattgttattcccattttacagttggggaaactgaggcacagagcggtcaaataacttctccaaggccacacaactagaaagcagcataactgagattcatacagggattctggctcgggagcccgggatcctaacctccgtgctccactacacagaaatagggataggttgttgagcagataccaggagattaaaatgtagaagttattgaagagcattcagcatgtcttcaaacatttctcctgtttcctttttaaaagtatctccacctcctcttccctgaaagattggctgcttccagttttcagttctgccctgctctgctgttccccagtaagcatactggctctttgtgctttgaagattttattggtaaacttcaacaaagatgttgcttttattcacagaaaaggggtaatttttttttttttttggatggagtttcacccttgttgcccaggctagagtgcaatggtgcgatctcagctcactgcggcctctgcctcctgggttcaagtgattctcctgcctcagcctcccaagtagctgggattacaggcgcgcatcaccacacctggctaattttgtatttttggtagagacggagtttcttcatgttggtcaggctggtctcgaactcccgacctgaggtgatccgcccacctcggcctcccaaagtgctgggattacaggcgtgagccactgcgcctggcagcgtaattttttttaaggggaactaactgtactgtgttccaggcacctgataatactatgcattatcttatttggtcctcccagaactcctaggaaagtagccccttgtcacccctttttacagatgaagctcagcaggactccaaatttgtgcagatgcatgtgagttgtagagccagcatcaaatcatggtcttggacaccaaagcccctgttagtttcatttcctgcaaaatgtgaatgtgaaatggctttggaataatcaaggaaaagcacccatgctggcagagaaatacagatggtaattaaaaactacagctcaggtcttctcaaacttagcaggctgtgtgccccagaaataccaagtcctcatagtcttgaccccgtggttttcatggttagtaattgacctgttgttaaccacaaaactgattgaattctacagatcttatgcctaggcagttgagttttccaaactttttcctcccttcaaccccaatggctagaccctggccctgagagagggcccctcccagctggtaagccttcaaaacaaacctgcagaacagggcttatcattggacaattggcatttctttggattctttgtctgagtgtctcccacatttgccagatgccagaaatgtctgtgaggcatttcctcataaaaatttgatatgatttagcctcaagagtaccccaaggaataactgagttttcctgaaagaatggttgatacatatttgtctttgtaattggcatctgattcaaggtgaatgatatttcaagaacatatggtgaggggcatccatatactgatttatttgccccaacagtctatatctgttgttttcatagtcatctgagagctttgtttgagagaggacgcgtaagaatctgcagtttctgtgccaagtcattcttagacgtccaagcagcagagcatgggggagctggaagagccaatcatttcacttctttagcttttacattcaccgacttaatgtgagtgatggtgatacttacctatttcttgtattctggaagacatagggattaacttgagaagtgctgacctgtttcagccaggaagtgcaatcatgtgatgatcagcctgctgctctccatggcagaacacatgtcccgcgttctccaccccaactggaccctttcttgagacttaccccacgctcactgctaacacaggtatctcctgggcttgaggtggattcacttatcagtgttcaccttattttatcactaaaacaaaaatacttcataaactacataatgtatgactgttatcctctattagaaagctatagaggccaggcgcggtggctcacacctgtaatcttagcactttgggaggccaaggcaggcagatcacctgaggaaaggagtttcagaccagcctggccaacatggtgaaaccccgtctctactgaaaatacagaaattagctgggcatggtggcagctgcctgtaatcccagctactcaaaaggctgagagaggagaattgcttgaacccaggaggcagagctttcagggagccaagatcgcgccattgcactccagcctgggcaacaagagtgaaactctgtctcaaaaaaaaaaaataaaaataaaaaaaagaaagctatagagtcaccgtcactcctgccttgatttcatcagggaaagggaactcaccatctcaggaaaatgtgcctagcaaaagaattcacagggctctaggctgcaagtccatgaatgccctttcctaggatatcagggaccagagtggaacatgagctattattacaagggagggatggaaaaattagactttttttatttttggaaaaatacacataaaatttaccatcttaaccatttttaaggtcagtgccattaagtactgttaaaagaaaaactttagacaaattaaatttagccaggtttatttgagcaaagaccaattcatgagtcaggcagccctcagaaacagaagaggttcagagagccacacctacaagtgtgagtggcaggcttttgtaggccaaacagagaagcaaagtagagaaatcacctaattggctacagctaggcatctgccttatttgagcatggtgtgatgagtttggagttggctgcctgattggttgaaacccttcctgttttatgtattccctagcacatggtccaatagaaagaaactatgaaatataaatgcaagccacatgtataatattaaattgtccttaaatctaatagccacactaagtaacagaaaaagaaataaattacttaagtttagtaatatattttattaaatctaatatgtcctaaatgtcaacttttcaacatgcagtcagtataaaaaatataaatgaggtattttacattctttttatcgtgctaaatattccaaatttgatgtgtattttacacttacagcacaattaggattagcctcatgtggctaacagataccctattagacagtacagatctagacaatatagttacattttgcctggcttttaactttacataagtaaaagtatgtaacatatatctctgttatccagtattgtacctactaactacacataattgtttaagttcattaaaattaaattaaaatttcagttcctttgttactccagccacatttcatgtgctcagtaactagtgtggcctttgtactggtgagcacagatatagaatgtttccatcagcacagaaagttctactggacagcgttggtatatactcttctgtgtattgctttttttgttgttcaactatgtttgtatgatttgttcaagttgtatgtaaatgtagcttgttcattttcattactaaatagcattccactttattaatatagtacaatttatgtctcccttctgttgatggacatttggattgtttatagttttgtcaattgtaaacagtattgcttcagtacgtttcaagatgcacacagtatccatttcctcatggctgggtcataggtcgtggatgtcttcagctttactaactagcaaattgtttcccaaagtgattgtactaattttcatttccaccagcagaatctgtgagtttatattattccacatcctcacctgaacttggtgttcagacttaaatgttttgcctttctagtgggtatgtgatggtatctcattgtaagctgggctttttttcacttactgataaaaataaatgtttattgattatatatttatcaatatatatttatactattattttcatagaagtgtgcacacaggaggtgaagatgaatataagacacagctcctcttaaatagtttttgtttttatagagacagggtcttgctctgttgcccaggcaagtgcagtggtgtaatcatagttcactgcagccccaaaccactatgctcaagggatcctcctgcctcagcctccctaggactacaggtgtgctccaccatgctaggctaattcttttttcaatttttattttttatagagacaaggtctctaaaaataataataaaaatgtcatgttgcccaggctggtcttgaactcctgagctcaagctatcctcctgcctcggcctcccaagtagcttggtctgcaggcatatgccatcacatccagctaaggtatttttgatctgtaggagaaataagtcatgtctatagataaccatatataagagcaccaaaaagtgaaatcaaaggactattgacatttaaggaaggagaatttatacccaacaacctactccatatctctattcagatggtaaacacctcagattaaatatatccaacactgcgtgcctcatttccatcacccaccccaagctggcttttctccatggttcacatcttagtcaatggcaccatcttctgccctttttctcagatcagaatcctagaagtcaacatgatacctcttctcatccacaataagtgaactgatcattgtggtcagtcctaccacctaaatacccctcagattcagccctgtccactagccctctctatgctaaactgccattgatcccctaggactcttgcagtagcctccccattgtctccccactcccacagcccttccagttcgtcctcaacaatagcgggcatctgatgaaatgaagcacgcccctgcctgtggcttcccacggtgctcaggatgaaggtcctaatgacctggccttccctcctctctgttctcatttcccaccactctcctccctggcttctgacagcacattcaccacaccaaccttctttggtttcctgaacatactagatccttcctacctcctggcctgaatacacactatctcctggacttgaaatttaggagttctgccctctccactttccatcttcatggtttgagcttcaatgtccctttattagggaattgtttgctagctcttcagagtaggtcaggacccatgccattcactctcatagctctctgtcctttccaacttagcacttatcaaaattgtatttaagtcattatttaagcaatgactgtttaatgtgttttccattgccttaagtcccatgaactcaagcaccgtaaatctaatttgtttaacactacatatccccaacacttagcatagtgtttggcatatagcagatactcaaaaagtcactgaataaatgagaagaccttactgaggaggggacatctgagttgaatactgaaaaattggcagaatttggacagttagagatggttaggaatgattaggtaagagatttctagaagatgaaatagctcagtattctgacaatattagacaagcctgtattaaaactgaaatttaggctgggcgtggtggctcacgcctgtaatcccagcactttgggaagctgaggcaggtggatcacctgaggtcagtggttccagaacagcctggtcaacatggtgaaatcccatctctacttaaaatataaaaattagccaggcgtggaggtgtgtgcctgtaatcccagctactcaggaggctgaggcaggagaatcacttgaacccaggaggcagaggttgcaatgagccgagatcgcgccattgcactttagcctgagcaaaaagaacaaaactccgtctcaaaaaaaaaaaaaacctgaaatttaaaaaggcactgtggacccattcaaggtatcttggatgatcctggaccaccacccattcattagcatggggaagagttcaatccttgttgctcacttgctgtgtattaggcagggccccacacatgggactgcagcctgtgcctctgtgctgtgaatggagtcttttggagttaggcatgtgaccttggggaaaggtactcttagggatgttcagattatatatgacactgtctctgaccacaggacattgtaatctagtagaatcaataaaagaaaaaagatactaccatgtatataaaggcaaaacccatctcattctgttaggaagtcaactgtacatgtgtcttacaggtttctccatcctgaggggagtaagggcaattgaatctggagaagtagcagccaagttaaattttggggtgtggataaactgaactgtaggagatgatggtaaaactctacttcagaggctctgttgataggaaataggaattcagtcctggtggagattgacgtccctaaagagaaccctccagaatagcctgagcagcccatgggtggtaaatcacagggaatgagcagcactcatcctgaggagctcagagaattcaagcacaaaatagacaggaatctgacgagggggtacaacagatcttcgagacaggcctgcttagattgcaaggttctaattcggtcggttgcctgccttttgaaaacctgcccagggaaagcctgagtatccaggaaggtgaacctgacctcccttcagaggagctgacgaaagcccagtgtgtgtggagtagccgtgattcagttctagggtgcatctttcattcttgaagttcaaatggcattgccggtgcttgtggcacccttctgtgcagtagttgcatgtaggcactggctctcctaagatacacaaaagccataacaatctacacatgtccagtgcaccagctcacctcccccaaacccccaacagtggaaaacatatacagggagccactggttttaagcagcaaaatgtgtcctaggaaattggttcttaaagcagatcaccatgaggaaacattctgactgccggtgagtctgttcctggggttgctgttatctgcttggacatcatctgtaaaaacagcaggaagaaaaatgtggctgtccattacatagcccatgacaataataactgacatctatccatcgcttcctatataccaggcttttttatgatctctttatgtgtattattttgatgctcacagtaatcccacaaggtaggcactcttcatctccattttacagcgaaggaagcacagaaagattaagtaactggcccaaaaccacacgtgaaggattctaacccaccagcagcgattctcacccacacactcgaccccagaaattgctcatcccatagtctcctgtgagcagagcaggaagacatgacctcctctcagcttttctccttctctggcccagcttgtcaccacattccagataaacttattgcaccccaactaatggtaaggcactgacatgaaataatgtgactacctgtcatgaagtggaaagccccgtcaaggaaggaaagttagaaaattgacaccgatttccttctgcctgtgctgttgacaacaaacaaaacatttactcgacaggaggttaaactccagaaaccaatatgaaattttgactttcacccattagcatttcaaggaatgggtccaggtcaatagttgctccagtgactgaggataaaagggtccgtcatctgcagctcccctggcttttatctcaaaagctgtgggcttcatttctcacccactaacccaaaagaaatgttgagtaaagttagcatcagaaaaaggcagtagcagtttagaagcagggtttcccactgctctagcaacattggaagtgaagttttgcaaaatgttcttatcaggcccccctgtgctttcctttcagggcagctggcttttatctgttctgaatactgagttttagcatacactttaattggaaggaagggtccctctgctaaaaggaacagttatttaggtaaatactttttaaaggacatatattttcaaaaaacgacaatgcactttttatttcttcaaaagttattttgggggtaaatctgctatgttccaggctctaatctaaaggccagggacacagcagtgatcagtgcaggaaaattctgcccttagggtgctattagcacatcctttcttttttttttttaatttttagttttttatttcaataggttttgggggaacaagtggtgtgtttggctacatgaatgagttctttagtggtgatttctgagattttggcgcacccgtcacccaggcagtgtacacggtacccagtgtgtagtcttttctcccttacccccttctccccctttcccctgagtcctcaaagtccactgtatcattcttatgcctttgtgccctcttagcttagctcccatttatgagtgacaacatacgaagcacatccctttttaaaatatggatttggggccaggtgctgtggctgacacctataatcctagcatttgggaggttgaggcaggagaactgcttgaagccaggaatttgaaaccagcgtgggcaacatagccagaccccatttctgaaaaaaattaaggtaacaaataaaatacaatatacattttcaaggaaataattgagatacatcaatagtatttgcagataattttttttaccctggaaatacttaaatataactaattaataccataaatatgagccctctatagtacttatgtgtcaatttgtgttttcattgaatcctggacacagcccactttgaggcaggtagtgtcatccccttctccagatgaggaggctgaggcttggtgcctttatttcctggcctgtggtcacatgatggatggtgacagctttgctcttgctggctgatgcccgcagatacagataggacttagggaactcaccagtgactaaggctaggatcacatctgcacatcccagaagcctgcaccgtgagtttgtaatcatcatttgtcaaggtgggtgtcacagccttcaacatctcagggtttgtatgtgatttagtgaagttgctcaaacttccagtccaagatctacttatgtttgtggttcacaggattgtatgtaaaagtgtcaaacctttgtcaatgctttaggcccgtcaatgatcaaagaataagttaatgagatttactgtaaaatgttaaaaattacaaatccttcccaattttaatagcaaaatgggaagtagagggtgtgtactatttaattctttatctttaaagcagagtgtctgtgggtgatctctatgtaatatgcttacattctggggctcagagccacctaccagattgcttttgttaatcgttattttctgtcccttttcctttgcagacgatcattcccgagtgaggctgcagacaatagaaggagacacaaactcagactatatcaatggcaattatatcgatgtatgtattttattatttttaattgatatataattgttgtacatatttgggtgctatgtatgatattttgatacatgtatacaatgcataatgattaaatcagagtataaaactcagtaaacccaaccattctgacatgtaccagattgtgtgtctgctgaacgattgttggacatacattgggctcaatctaaaagcaaacacatgaatattaccctgcacaccacagaacttaacagtgaagacacggtcactccttttctcaaggtagcccattcgttggtgaatttctctgtaacattctatgccttctttgccatctcatgcttatgtggactaagaaaatgttatttccatttttttgtcaacaactcatattattcgacacttaaaaaatttgtttgcatattaatgggacaaaactctctaattcctaatacggcgatttgcaatcccttgtcatcactgcacttttaagttgtcttcaaagtagtctgcatctgttcaccaggacttctaatgcaagcaagacatgtcattaaatatgtaggctgtttaattattgaagactgcctctttgttcattctgcatcatgttaacttaatgttttacattagaataaattctttaggagacagcatgttttcagttgaaagaatgaatgaaatcaaaagtagactgaaaaatcaagggaaagttgctgttacctccaaggcccgagtttatattaaacagatttctgctcccttgtggttccgaaggcatactctgtgcttggccttcacactattgcttagtctatcagtacttccatagacaggattgatccatatatatggattgttttgcttcttgattgaatattactgagatgctactaaaagtaaatagcatcacaatctctaagaaagttatctaaaaataactatgagaatgttatctttagtgctaattagacagatttggcattttcagttatagatttttgggtagggactggggtatgattatttcaagaatagttcatctctcattcatcaaacgaagacccctgcactattttgataacaaccaaaaccataccctctccaggttccatttattttttattaaagcaagctttcttcataaggtgcattgcacttactcttttaatcagcacatgtttagtgagaacctcatgggagtactcagatgttccagaccagttatctcctcctcacagtctcccaactcagaagctgagaagctgaaatatgagtgtcttatccagtccacttacctccaggccaactgtagcacaccttcccttgagaggctccaggggacaccgttcacactccagtcccagctcctgcagtctctactgggtccttgagtacagggacagtgtcctaggcatcttacttcccctgcacctggcacatgcctgaatatagagagcccttagtaagtgtttcatgaaacacccactgaaggagtcattgtgatcagattaggcatcatagaggatgtaatttgaataagctttaaccggtgagtaagtggaaatgcaggagagaagatattccagctcaaggaggtcacatacatgagcaaggctataaagtaatgaaaagactggattactgagtttgaattgtattttaagagagaagagccaatactgagggcctctttattctcttagtcaatagatcttattgagtacttgtgcgttatttacctttctaggtgctagcagaaaaactgtgaaccgttcaaaccaaaaccaaaaaaacctctgacccagtggagctgctgttctaattaggagaaatgggcaataaattaaaaagttaattctgtatggtcaattagaaagttgtatgtactgcagagaaaactaaagccgtaaagggggactcggagcgccagacctggaggccctgatggcaattttgaatcgagtggctcagtcccactgagaaggtagcaagtgagcaaggaagacaaggggttgagctatatagatacctggaagaagagcattctgggctgagaaacggcccaagcaaaggccttgttgtggaatttgtgcctggcgattttgaagaaaagcaagcaggcaatcattggcatggtgtatgggggcctgcggagttccatgatatggggagaggtcatgggccaggtcaggtccacagttgtaaggactttggcttttactgtgagtgagatgggcagtcgttagaggtatctgagtaaagccgtgatctggctgctgggagggaagtgaactgcacttggccaggagaggaagcagagaagcctgctatgtggctgtgggaatcatcagagaggtggcagtggaggtgagaaatggcgagacccttgagctgcattgaaggtagagccagtaggatttgctggcagattggctacggggttcaggagggagagaggggtcaaggatgctgaggagaagatggtgtgtggaacagattcaggtaggggttagggaggaaatgaggagttcagtcttaggtgtgtgaagctttaaatatatattagacctcccagtggaggtgttgagcaggcagtgggtatgcatcaaaattcccaggaaaaggtctaggctggaaacaagaatataggattcatcagtgtacagacgagcttgaaggccatggggctggaggagctcactcagagaatgagagcagatggaggaaaatgtccaacaaccaggccttccacatcaagttgaaaagggagaaccagccaatgaaattgagaacaagcggccagggaggtaggtaggaagaaaaccaggagagtcacatcatggaaccagggaagaaagcattttaaggggattgattatactcatgctgccgatggccaagtagataaggactgagaaatgatggtgatgttcagcaatacaggccactgtggactctctgggtgacttcaccatcagatgagtccctcctaactactgggcaccttgttaggccctcggacatatagtatggataagtcaagcaaggttgttgcccttgtgggacttagcagccagtgagaaatgagtgatggtctaaagagttctatttaatattggtcatggctctataatttgagacctacagcaagtcaattgtataaaagaatgtgtttgcttttgttgttcattgttttcaacttgtttttaagggcaaaatgatctaacatgtgcatttaagttatctgagaaatctgagttttctcttcaagtttcttttttctgttttccaaccagttttgggcatggtattttgggcaatcttgggggacagaaatagaaaatattaagatccatggtgatatgttagctggctgtaattttctctgagtggatattttctttcccagatacttatcctacaatttttttgtttccttctttttttttttttttttttttttttttttgagacagggtctcactttgtcacccaggctgaagtacagtggtgcaatcttggctcactgcagcctggaacccctgggcttatgcaatcctcctgcctcagtccccaaagtaggtgggactacaggtgcatgccaccacacctggctaatttttgtattttttgtagagatggctttttgccatgttgtgcaggctggtctcaaactcctaagctcaagcagtctgcctgcctcagcctccccaaagtgctgggatcacaggcatcaaccaccacacctggccctttttctttggcctcaatttttatctgtcttgtttcttatagggtcatgataaaaggaaggaatctttcagaacttctgcctctttaaattcctggcccttgctacagtagcatgtcatggtattagcagtgtttaagaatggttttgaggatcactattgatataactgtctataccagtataacagaatgtgtgttaaacccttggcatattgccaatgacatcccaaacacaaatgaaattctgttgcaaattctcagtttgtttgcactttgtaagagtaatgctcatgttatttcagagaatccataagttgttagtgtttcttgctcatccatcatctcatagccagttatgattaagttacccacacctttggtgcaagcatcagaactgttgtatttgatgcgccttcactaattaagagaaactcagtggtgctgggttggccatttaactttcaggtgatgcagctattggcgtttgtgtgcacattcctttcagcaaagttagcatgcgacttatctgctgtttatcgattttatgtttatcaaatattctcttttatttatttttagggttatcatcgacccaatcattacattgctacccaaggtaagtttatttctactttgttgtctttctttgtttcttttgcccacttcctatcattttgtacccacttcaccctccttcaggaagatattgcacatttattgcggttctagccatcggcaggtacactcttgccttcccatcagacattctggtcatgtaaatcatttagttagaacttcatgttgagatcattaggagaaatgtgtccatcaattccttattgaattcaatatgtctaccttaggagtaagttggacatttgcaaaagtagatgtatagatagccattccatcaatatacaccagctgctctctacacagggaactgtgctggttgctgctggagagctaggctgaatccagcaagcacccccttctcacagtggttgtgtttagtggggaagatgtgcagtcacctgtatgtactttagtaggtacagtggcaggtgacatctgtgagaggaacagatacagataaaacattagggatatttggagcaggaaggggttgctttccggtgggatgactcaaaaaccgttttgtggcagaggtgagattgggaagagcccttgtgaatggagaaacatcatgagcaaagatgtggaagcagaaagttagttctcccaggtggaaagcagctggtgggtcaccttggctaaaggaaacagaagagctagaggacatgttgaggaagctcatggcagtggtttttgggtgattttcccagcgtatgaagtgggtcatctgcagatggtgggggtcatgagggagcgaggttttagagaatgaggcatcctaaaggatgagtcagtgagtcaatatgggatgaactgaagaaggagtaagaagcagagaagacccagctaaggctgaacagcacatgttctccccattttattattttatcattgttttcagcaataggctacatcccaggaacagtagcagggaagtgaaaaggatgtgatctgccaaaggttaggcatgggggcagggtgtacacagacagtcagtgacaagggaatcaacgatgccaagataattggggttggaaagtccaggcttggacgaagggcaatcagaggtgtccactggaccgtgaggagagggaaggagttaacagattgaggctgggtcccattgatgagtcatagcttaggaaaagaggcagttgtagccagagagcagaattccaatgcttggatctgcctgtgcagtagaactttctgcagtggtgggaatgctctctatctgcactgtccgatatcatagctacaaatcacatgtggctcctgcatacttgaaatacagctactacaaatgaggaactgaattttaaattttaatattgatagaaatagctacatttggttattccctgtggtggcattggacagcaaagctttggggtggaaaagctccagctatggctgaaatggagccactgtggaaactgatcctgccccatgcccacagccaccccaagaacctgggtgacaccacacagagtccacagtctcacatcaccactaggttactctgcactcaggtctagatgacctgctggagctcccactgtctttcatcatctatgacttgaagttggtaatggctccttccaaggtcactttgctagctagatgcaaagttgtctgtagagtttccagtatgaacctggcacaaagcaggccctactacatagaggttgctgaggtcttcaggaagcaaggctcagcttgagctcttacatatgggatagaacaaggatgcatgtcagagtctggtcctagacatctcctaaccctgctgcttccaaacggaattcatcaatgccgttagaggaacctgttgttaggggtttgaaattcattctgatggctttcagaatgttctgaattaagcctcacaacatcagatttaatacattctatgataatttgaaattaacagtttttgtaaattcgtgtgaaaatttgattgtaaaatacccaaaatactcccgagcttcatttctctccaataacttgattagcaagctatgttttcatagataacaagaacattaagttgctcttatttgtattttcaatattgaggccctctagattaaggtgactaaacgaacagctaaagtagagactgaaactgccaagtctagacatggctctttaccaggcttccttccctttgtccattctctctgcccctctccccctgtaagagattattctttaaagagaaatgccaatagagaagtcactttctgcagaattcatgtgagtgatacttaatagctcagtaaccctctctggcagcattctagtgttaatgagcaaatgtatttgtaagcagataagaaatagcaaatgtcatcagtttgcagtagacaatcagtctgcccttaatggagaagggcattgactaatgccctgtttaccaggtcgtggcagcctttccctggtacaaggtgggctgcagattggacttctcaaactggcagtactaacatcactgctggtggcggtgcagggagaggagggaaaatgaatgaatatttttaatctaacatgcagtcaagaatatacatatcatattaagaataatacattcataccatgatgttcagatgagaaagctagaatcttctattatataccagaagataatggactaatagccttagatcaccagtaatcaagatcactgatgataatcttcactaattggcatggacaggtagaatatgttcgtagatcacctttgttgaaaaacaaacaaacaaaacattaatacctccaagaggccaacaaaatgggcaatgaagaccaacaggcagatgcagtctttaaatgtcttcttgctctatttgtcctgtgttttgcactaacataattctttaaaatatattcacagcaggaacctatgaaactatacaaatggtgcaatttgctgacaaccagttttacttccaagagttagtaatgcacagatgttcatcaagttccttcaatacagaggacatattataaatttaagtattgggtctcctcctcccatccaccctcaattttattgatttttctagctgtaactgactttgacctttgataataatgggtgacgtttctgcaaattgaaagcatcccattcaagccagatctgttgcttttttagtattaatatgttcttcctatctccccttggtttaattgtcttctgtctggccactaatatatgatgacccaatattaacttcatcatgtctgactgaccagacattagtgcaacagtaacattcaagatttatgatttagcaaaccaggagctcaaaggagaggaagtcatgtccactactgcatgtctctgtatgtagaggcagggcagagtgaagatttcaaaagcaggctcaagtgatgggcagaagagcatgcaagtgggtaggattgcccagaagtgatcgtatttcacaatcaaaatgcaaccttggagattatgtggcctgcaagctggatgaagccacacacataagaaccgactggatagaacacctgctggcctcatggtggcagccatgggggccctggataagtgttcttttgatttttgtttggttttgtttagagacatgatttcactctgtcacctagactggagtgcagtagtgggatcatagcttactgaagcatcgaactcctgggctcatgtaattctcccacctcagcctccaaagcatctaggaccacagttgcacaccatgcctgactaatgtattttattttattttttgtagatttaggatctccctaaatctgtgttgtccaggctggtctcagactcctgggctcataggagcctcccaccgtggcctcccaaagcgctgggattacaggcatgagtcattgcactcggctttgtttagttttaattttaaaacttacctcaagagtcagataactcagggaaagaccatgcaaggctgttactgaagaaagtgctgtgagtgtgttctagacatggcttgcacagtcctgagcatccttcctcacttctaagtgagcattttccagagtcatttgtgcaccgggatcccccaagaaagaggctcaggcctggtgtggtctttcctgtgtactgcatgctcaccccccaaaaccatatggttaatccagatccagcccctgctttctaagttatgatgcttctcatgacaacacaataaaaagcaaatgttcgatgatagtcatgtctgaaaatacatgttaattattattgtcttcaatgttgtaacctgagctatagattgttgagatgcacgcgttacttttttgagtttaggtgcctcaatgcccacttcatcatttctttctttctgaactgtgctaatttgacagggttgactacctgattggggttccgaacttagccttcatcttgccatatatagtttctttttgtctccatcagcattagctctgtacagcaccctgtagagtccaggactagagagaggatctccaaacagaagcccccatgcccacgtgagaacagggagacgcttgtgcccccaaccatgttttccataggaccgcccagccatgtgcactctggcccaaatgtccctcacctttggaagacacagaacttccttcaaaactaatgaaatatcaagatcgtttccccagaaagaaaatttcatttaaggtggttcatggactacccccaccccccaattttactcatgaattatagtaattctatggacctcaggttatgaactttactttggtcagaaacattaaaagctatttggggataagacagaaaccatagacttaattaatctactttttaaaattatactttaagttctgaggtacatgtgcagaacatgcagttctactttttaaaaaaccatacttaggggttaacaaaatgtcacagattgtttataactatgtgaaatacattcctgaaagcatcaaaatttttactaactttaacaaactattactaaaatgtttactagcctaaccctgtagtaaaataccctagagtattgttataatcgttagtattttgaaccatggtcagtttgggttttacggttcatctcaggctgggttttctgcctatctgttattttgcattcgtgctgaaaagtttatgcctttgctcacctttcaacaattttagcaattataatatattagaaaatgctctctctgaatgacagagactagagtagcaggtcccatagctgatgtttattttgtaaaagcaggatgtagtagaaataacacatgtaccacagccagaaggctgggatccaaattcttgtgctgtcacagaaaaggtatttgaacttcctaaacttatttcaggtagagtcctggtgtttggtaaatagtaataatagtcaagaccttaccatgtgccagacagcattcccagcactcacacatacagagctcatttcatctttaccacaaatatgggagatatatgggattgtccccaatttataaatgagaggaaaggagacaaagaaacttgaaataatatgctccaagtcacagacctaaaagtgcaaaggccagattcaagtgtagccactgaactccagcatcaaggctcctccccacctcactatactgcctcccataggtgaccttggggattactttaactcatgtatgtatcaatgcttagagcaattcctggcatggagcaaatgccatgtatgcgtgacctgttactgtttttgagaaacagcacagaatcgcttaatcattaggaacacagactctggaactacattgtctgaactcaacccccaaccctggttcctccattggcaacttgtgtgaccttggacaagttacttaacatctctgtgctcatcataaatgaagatgaaaatagtctaccttgtagggagctatttatttattttttaacttttaggttcaggggtacatgtgcaggtttgttatacaggtaaactgcatgtcatgagggtttggtgtacagattattttgtcacccagataataagcataatacccgataggtagttttttaatcctctccctcctcccaccctctaccctcaggtaggtcccagtgtctgttgctgcctcctttgtgcccatgtgttctcagtgtttaactctcactaacaagtgagaacatacagtgtttgatttttccgttcctgcgattggtcagttaggataatggcctccagctttatccatgttgctgcaaaggacataatctcattcttttttatggctgcatagtattccatggtatatttgtactacattttctttatccagtctactgttcatgggcattttggttgattccatgtctttgccagtgtgaatactgctgtgatgaacacatgtatgtatgtatctgaatcacgcatgaatcatatagaatgatttatttttctttgggtatacagccaataatgggattgctgggtcaagtggtacttctgttgtaagttctttgagaaatttcccacactgctttccacaatggctgaactaatttacattctcaccagcactctataagcgttccatcttctccacaacctctccagcatctgttattttttctttttaataatagccattctaattggtgtgagatggtatctcattgtgattttaatatgcatttatctaacaattggtgatgttgagcattttttcatatacttgctggccgcatggtaccttttcaagtgtatctgttcctgttttttgccaaatttttaatggggttatttggcttttgcttgttaatttgtttaagttccttatagactctggatattagacctttgttggatgcatagtttgaaaatgttttctcccattctgtaggtttttctgtttattctctggatagtttttcttgttgtgcagaagctctttaattaggtctgatttgtcaatttttgtatttgttgcaattgcttttgacatctgaggaggtgtaagatctctacagcgagaactacaaaacactgcccaaagaaatcagggatgatacaaacagtgaaaaaatattccatgctcatggataggaagaagcaatattgtttaaatggccctactgctcaaagcaatttacagattcaatgctattcctatcaaactaccaatgacattcttcacagaattagaaaaaactattttaaaattcatacagtaccatagaagagcccaaatagccaaggcaatcctaagcaaaaagaacaaagctggaggcatcactttatgtgacttgaaactgtactacatggctacagtaaccaaaacagcatggtactggtacaaaagcacacacgtagaccaacagaacagaatagagagcccagaaatggtgccacacacctacaaccatctgacctttgcaaagttgacaaaaacaagcaatggggaaaggactccccattattaatattattgaataataaatggtgctgggataactggctagccatatgcagaagattgaaactggaccccttccttataccatatacaaaaatcaattcaagatgaattaaagaattaaatgtgaaacctcaaactataaaaatcctggaatataacctaagaaatagcattttggacataggccccagcaaaggggccttttctttttaatacccagtaagttgcccatttacaaaataatgtccttttttgctgaccttgaaaatatactcagacaaagcagagtaggtcttactaattgcatatgttcacatttcaaaatgtaagtagtcttatgtaaacccctaaatagctagtgacatgaacttttcatttctcacatgtgaacaaacttaaactgtgcatagttaagaagccttggaacaattcatagagattgtgatctgtggagaactggctatccagataggccccaccacatgccattgaccttatcaccgccatcactgtcttccttttatgctcagaggatccagatgcccagtgtcatctttgaggatgccaggtcacattggcaaagaccacagaaactgatatggagaaccagatgccagatagtcatttacaatgaaaactgtaaccacccatcagacagaactgccaaggtcaggcaggggcattctgtgtgaagaggaagatgccttggcagaagatcacttcatcatgaccagggcatctgaagaaggggtcggagagtttattcatgattcaataagtatgcaccacctgtcttgtagtgagttggcataaaacataagctcagtaagaacacaagaatgaatgagtgaatgagtaaatgaatggattgggacttacgatgtgccacgcaccacttagacagtagaatatctcagccaggtagagaggatggctcatgttggcccggcaaagccaaaatcctggggcagattttggtggcattatctccaacatctctgactatttctgtttcaagttaagggctggtcagcttctattcttagaaacactttctttacatatgtcagtaaatcaaatcctgtatttagagacagtccatcttgttaaactaactttgcttggctctaccctgaccctgtttgtgtaacccctgtccccatacatataatcagttttgtctgtagttataatttgtccataatttgaaaaagagaagcctaaaaagttccctccagacactttcagctaggaacaaacttttatgtgaaaataataaaaatgtggggagtgaaggtttatagtggaaatatttacagagcctcaaacactgcacaacagttcaaactttgttgtagtgccttcattctttttgctgtcagtttgtttttcttctatctttattccacatacttctggtataggtttaataaggatttttcaaaaagataaatatggtttatattttcccagctcaaaattccccttcaggcctctgaagcaataaataatagtgctttgaatgctgcactcactttcctgggcaagccattccggtagtggagggttctcagagcgtcagtgtaacttctgcacactctgtaaagcagcttttttctcttgcattctggcctccagatggagatgaacacttgaaattatttctcagtagaattgaaagaacttttttttaaatcaaaagctcagccttcagtaaacaacttttgtttttattcttccaagaaccagtgcagcttgcacttcaagtgcaaattctgtgttagctagcactgtgcttcctggcaaagttgttcctgcattgtcagtgagttgtaggttatgttttggattcatttgttatgtcctatttgagactaatttaaaagtattacctagtgaagtggagtattctctggtttccaaatttaaatagggatgctttgagaaaatgtgatttatatacaggcgaacagtgactccataaaagtcactgtcgtaagtattccagcgacccagggccaagtttatacagaccctgcctgcattttaccaaccatctgtggttttacaagagagaatgaacaattgcaattagcagcttatccagaaacttccttttaaacaataatttctcttcactagattaatttcaaaagatagttgccaattagccaaatggtcactttcatagacatttctcatccctgtgctctaaataaacttgctcattagcaatgagaacatttaaaggaagagttaaagttaaaagatgaagtaaaaaatagagcatgtcaggtaacatccacctatgttgttatagatgccataaggaaaatgtggccctctaataagagaaccaaaattaatacagaataatttgaaaataaatgatgtcctgttgttaagcaagcactcagatttaaggtgtcttaaaacaaatgctttttaaaccttcaagagtatttagaggggttcctcatttgaagtagaaaatttgtagaatcttttagaggtgacagaaactttaagaagctcacagtccagtttccttgttttgttattataacagttggcacttaaagcagaactatatttaagtgaccttcatccacataagttcaagtgagtcatatatgcaaaagtatttgcaaactgcatggactaacgttcatattttaatagagtgtgtgcaaagttcaacctaggagaaacgtcatatgttaagacagacctgttcccccatagggccttttattcaacaggaagaaaaactgtgaggttacatctttctctcaggttcagccctttaaaaggagagagctgaaactaatacccatgtactttccaaagtgctggcttccccgtgcctctggcaacatgagtccttgcaaagcaaagctactcctttacagcctggttcattcaaaattgaacaaaggtttctgtgcacctgtcacttgccaggatcagcacacgatccggaatataccagtgacttcagaattacccagtgtggagtataaataaatgatacccaactcttactaatttgtgattttaatgcacccacagatttggggacttcattttgatttttaattatttagatttttttcaagagacatggtctcactctgtcacccaggcaggagtgtagtagcatgatcatagctcgctgtagcctccagctcctcggctcaagggatcctcctgcctcagcctcctgagtagctagaactacagggataagcaaccacacctggctaattttttattttattttttatagagacagggttttgctatgttgctcaggctggtctcaaactcctggcctcaagcaatcctcctacctcagcctcccaaattgctgggattacaggcatgaggcactgcacccaacctaggaacttctttaagccatttctcttctccacccctaccccattttacagaagaaaaaataagaccaagtgcagccctagaaccacttttccagaaatctgggcaccaggtttctttttcacccatgggcacagtttaggaccagtttttcaaggcagcaaacagtttaggaagtttctagctataaccagtgactttttttcttgccttctcactcaaaaggaagctgctggaaatttcctcatgcaacacccttcactgccatggaaaatttgagactgtctgcactgagctatgtctagggagccaatttatctgtatttcattcatttattagatttattctcttttttcttaaataaaagaggattccacttgtgtactgagaagagcttaattaaggaagatagagactaatgaaagcttttatttctctggcagtagcccctgaagcatatgaatataggctgttcccttcactttacttccttgacagaaggcagccagatcctttgggtcaccaaacccctccattctgaaggctgccgttcatttttttttttttttgtccttgattgccgtctctctgttcccctctttacagcatgcgcaagtacccaagctcagtttctgagcgttctctttggagaccgacactgatgaatgctctgtacctccgccagcaggatgcttctgtgctgtggacatctgtcatgttccttccttccgaggccacagcactttctcctgcgcctctttttagctccccatgcatgccgccattcggtctgtcccagggatcagggactgaaggtccctctggaagcagtgtctctatctctgcattgtatagcatattgttgccacacactacctacccccattttattcttttctatattagagatcctctttggtgccctaatccatatcccatcactcaaatctgatgggtctgcctttctcgacctgctttctgtgtcaagaataatagaaacctttttgcattccttttcacagtggtaccactgcaacctgaaatagtttacgtaactgctagggaggtccgattctagaagaggactgaatatcgcccaaaaagaatgaaatgcaaataatggtttctttcggtagatggagtttccagaaatgctttggaacatttcaattctaagagcaagtcatgctaggctacaaaccaccccattattggttttacccatagatatctctttgctttatgcaacatagtcacaatcagatctcttcaacttgttcttaaaatttcttccatatacaaccatgttttatgtcagtaactaggccaggactgtccgctccccactaaaagaagataggcagaatggttaatgaaagcctacactctagagttgcacagcctaggctcagatagcagctctgcaagtaacctctcaatagatattagctacttattgttattatcattttgtatgttccaaaagacatatctctcaatagcagagaagcagttcaggttttaaccctagtataatgtatactcatatagttttcatgaaagctgatacatcctacacctgttaatgcttccttccagaaggatgtatcaaagggagccacttaagtgtgcaccaacatcctgtactccctccagagtacaaagagtgccatcattgttcactgttaaactgtagacaaacataggttggaaagacaacagctgcatcctaagctggaaaagcatattttccttctgtttttgaagtcttgctgaaattgagcagccttgatagcagcgccagctccacgtcttggtgttctgaaggcttccctggtgcacacttaaagtcagatgacatgtgagtgaaaacagcttaattccaaagaccagacaagttccttcctaacaggcttcattgaaagcagttcctgagataagaattacacaggggtgttttagagaggagctttaacatggtaagttccttatatttcttaggaagaaaatggctattgattaaatttatctttattataaagacatactaaataatatctactatgtaattatttgtcctttttgtttttaaacatttcataatcattttaattgaataaatgattaaaagaaaagattattaaccagaaaagagaaaatagatgatggttgaagggttgtatagcatattatagacagaggtttcccaggctattttagtgtttatttaaaacctgtccgttaatgtttggtttatgccaattttctcttaatgaaatttgacataaccttttggtgtccaatcaggatttcatatgttttagaaatacacccagaaacaaacattccatgaaactaagtatgtagagaaagccacaaatagtcacatggtttatattgtcacactttcttacttcagtctgaaatgagaattttggggaatggaatgagtgaaatgtaagcatcaacatgtgggttgtgtgcgctggagaaaaggctaatcgtggatacagcggaaagtgtatgcctgattttaggtataagaagagtacacacctgcaaggcaatttagaagaaattgggcaaacagcaagtacccgccaaccagagagggccaggtgaggggaaaagactcttgtcacaggaaaccctactccagttgagaagagatgtgtcattgtgtggcatcactgtaatttattaacaaaacactctttaacatttattatttaagtcatcactttcaacactacttctaataaggtatattttattatagcttttctcttcttttactgtcaccaaattgaaattccagtggaccagtgaacacttctaaccctattatgtaattctaggcataaagagtttttcgtgtgagagttgtccttagaaaatgcgattttaacaggccagttatatttttgattttaggttaaagtattgccgagttttccccatcatagaacaattctcagtgtgtttgcttgtaattcattagttgatttccattgtttcctttaaatggtaattttcttgggatattcttagcaattcgggataatgagcaaatcatgtcccttatacccacccatctcaactttgcttttccttttctgcagctgaaacaaaaaatatttcatgaaagttgcatgattttaacataagtagcctcaggggagaacaaatgcaactatcaaataagtgatgttaaggattattaatgctgaagccaagtatattctgtgtcactgttaccacttctgtgacacatgaggcagattcagtttgtaaagcatggtggcatattttaccgtttacatctcactactgtaaaaatgaaaagctactcaatgtaaaattatagacttaagtgttatggaagcatcatattgaaaaatcacataaagctttataataaaaacttagaaaaccactgaagggacaactagttctctaaatgttgagtaactgacttcgtaacccttattatagattatcaccaacagcaacaggagcaatcatggatcaaaaatttaggaccacttttattcctgtagcaagagctttaaaatgaatgcctctcaggctcatcgtcttctgtggttaagtcccaccttcagccatcttcattgctgatggagggaactggctgccagtgcccaaaggagggagcccaggtttcctgcagctgctttgccttaacatccctcccctttcccttcgcacttctgccattcagtgtgtacccccacccaccacacactccctccttcaggtcccagaaccacgctagaaacaaacattctggtgatgcgctcaaacgggccctggtctcgggcagttcagttcattctgcagtcagaatagtggtgctgggctgacctgaattggaattccagctttgccacatactggcagtgctgctgtaacaaaggcacttcatctcctaagcctgtttcttgggctggagtaggtgcctcacactgctgtgttggggaatgaatgagatcgtgcatataaagagcagcatccagcacctgcctggcagggagccatctagttgtacctatttatttgtccaacacccttgtcctgggttccccttattccagcctagaagccttggttctcttattgctgacagagctttagggatggcaagagtcccccttggttttaacactgtcttcctagtacagccccagtcctccctggtctgaatcaagaggtcagcctatccaccaatcccctggttcctgagcccacctgagcctcattgccacactggggagccttggagcccacgctggccctgccagccacacgtggccggcttagggcctgccccctgccctataggctctgaccttcctgcccccaggctctccctgtgctgagccatcacctgcagccacattgctgctgtctgttggattcccgacccatcaccacctggacatttctgctgcagatctccgccagccatttggatgcccagggagctgttcttgccataataattgtaaaattataaaatatgtttaaactttgcctctcattaatcaatacggaccatctttttgttcactgttctttactgttcacattcaacatattcctgtttcttaggagttgttttgttcaatggaaagagtagacccttctgctctggacactggcgtctgtccagaacatgcaggagagctcagtgggagcctttggacttggctttggatagctgggctcagtttaccatttctctcagcccaccgtaccttgctcctcctgttcccacttcatcctcagctgctgatggctggtcacacctaaggctgagcccacacctgatcaaacctccttgcagtacaggtgccccccgtagagtccgttccaacaaccaaacacttcttcctctgttttctttctctgatttttcccgagctttgattctaaaaccggaactttccttagtcatgttttttagtatctgtcatggttgtcttccactcctaaaatctgaacttgcaaatcttatcagaattttacatttcctacaagagggccccatgggagtctccttccctcccaagtggcaacaagtggctcctgctggaggacctgctatccccaccctccctcccctctcccctccttcagagtcataccctgtcctttgagacctatggcaggtacctgacttcaacaatgctagtcctgctactgcgtcgccagtcagacctaagctcttcctgactttgactgccacaggcatcctcatacatcagttaccgaccctggccttcagacttttcttcttgtgtatccccaaaagaagtttgaagaaattatgcacctgctctaaacatttgagtttgatatcgaaaactttcatcacatgtttatgtaagtgtatttgttaataagagatagacagtatgaaatactttctaagacaaaatgaggattggtgtaattaagataaatattttatgatatgtggtgttttttaactgccttacagattcaagcataccaaacctgaaagaaaactcatgaaactttcacttacgggtttcatccaagaaaatttggctctcctcgaaagcattctggttccatttaaaagagtaaatatggccaggcgtggcagctcacgcctgtaatcccagcactttgggaagctgaggcgggcagatcatttcaggtcaggagctggagaccagcctggccaacacagcaaaaccccatctctactataaacacaaaagctagctgggcgtggtagcgcacgcctgtagtcccagctactctggaggttgagccaggagaatcacttgaacccagaagccagaggttacagtgacccatgatcgcgccaccgcactccagcctgggtgacagagagagactctgtctcataaaaaataaataaataaataaataaatagtaataaatattaccaacctctactgcttcaagggttctgagttcagaacatcttaacataagccaaaatgctaagttttactcctcacagaattgtttcagacagggaagtgagtttctggagccagaattccagcccaaacctgtaggtttttacacctgggcagtgccccatggtcatatttgagataggtggtttttcaagtgtatgaaagactattgtgaggctggacacagtggctcatccctgcaatcccagcactttgagatgatgaggcaggcagattgcttgaatctaggagttacaaaccagcccgggcaacatagtgagaccctatctctaccaaaagtacaaaaattagctgggcatagtgcctgtggtccaagctactcaggaggctgaggtgggaggatcacttgaatcaaggaggtcaaggctacagtgagccgtgatcataccactgcactccagcctgggcgacagagctagactctgtctcaaaaaaaagaaagaaagagagacagacagagacagacagagagagagaaaagaagagaggaggagggggagggagaggaggaggaggaggaaaaagaaggagaagaaggaggaggaggaggagagaaggaggaagagaggggaaggaaagggaaaggtagggtcacacctgtaatttcagcactttgggaggctgaggcgggcagatcatgaggtcaggagatcgagacgttggtgaaaccccatctctgctaaaaatacaaaaattatacaaaaattagctgggtgtggtggtgcgtgcctgtagtctcagctactcagaaggctgagccaggagaattgcttgaacccaggagatggaggttgcagtgagccaagatcacgccactgcactccagcctggcaacagagcaatcgtcaaaaaaatgtatataataatacattttaaaaagaaagaaaagaaaagagaaaagaagtggaaagaaaagaaagactattgcatatggaggctggagactcctgcctagggaataagttttggcagagtccttatagatattaagtatctggaaattaatacttgaaaaactactcatatatgccttagatcgtctttatgtatctccaagggtatgcatagctcagtttgaggaggtttttttcaattttttgagacaggtatgttgcacagactggtctcaaactcctgggctcaagcaatcctcccatctctgcctctgagtagctggaattacatcagttgaggtttaagtgtcccaggatgtttgccttactgtactttacatgagagtgtgggctgttcttatcttatctctacctcagaaaatttcaagcttctggatggtggagaccatgtatgtattactcacctttacatctctactatacctcacagaatgcctggcatttaacactaggctgagtgcttaactgctgcacgcaggggtggccactcatacccactggggccaggacagtggtataaacgaacaaagcaagttaggcatgaggccacgttaggaaaatgtgcatggaaaacacactggcagcacaactcactttaaacatcatgaagaaacagggagcctccacttgggtcttggaaaagtgacctgaggaagtgacttttggactgctcagctgaaaccagcaaggagatgtgcaggctttaagtgacgcatcagcagaggggggtcttgcgggaggacgctgggaaggagcgtgagggagatagatggtcagggaggggcaggtgccctgacacagtccaggcacagactgtgtgggaccgcatttgccttattaaagaatttagggcttactctgagagcagcggaaagctgtgggaggatttatgcaggaaaatgacatgtggggtttacagtcttcatagatgagccctggctgagggatagggaacggattcaggggaggccccatgtgggtttggggtgttgtattcatccacttggtaaataggtgagttgtcatggtggctggggtttggagggggacagaaatggagtggaggaaacagggtgtgctgtgctcttgaagtagtcctaccgggtaagcacagacgcttgggggctggctgtgcttgtgaagctgaatttgattctgtatcagtgggaggcccttggattggagtagttaaaggagggaagtgacctgagatcatgtaccctagaacttaaagtataatttaaaaatatatatatatatatggaaaaaaattaaaaaaaatgaaaacctagaaagatacaaggttctatgtcattacattaaaattgtaatgcttaaaaaaaaaacacctttaaagaggtggtttcagtgtggttaatatgggttctctcctgttttcttcttgccgggattgtgaggactgtgtggtacacacctgtctggtagagcccttctgagttgcttccgatgttcaaatgaggcggtatgatgtaatgcagtcagacttctggttcaaaactcagccctatagctcactagctgtgtgaccttagacagcttgtttgacttcccagtgcctcagtctccatcagtaaaatgggggtgagcaataggacctatttcataggatggtgttttctaaatttaatgcaatagtacatgtaaactacttcaaacaggacctgggaaacagtaagtgtttaagggacattaggtattattctgtttatgatggaatgccaatttgtacttatattatctttctttacttcaaaaaactcgaaaatgccactgtgagcttaagggaccttgacttctcagcagctctagttaatgtagaaaacatagtgtatagaaattcaaatgtgaaaagcaggggtacaagtcatcaaggtttgaaaatgatcatttttatagatgtaggggtacaagtgcagttgtgttacgtggatatattgcttagtggtgaagtgtgggcttctagggcacccatcacctgaatattatacattgttgaaacgatgatttttgatatctctcacttcccatgaactagagaactcatcttatacaataaagcccatccttgaatgtctttcattaatgcttttcattgcttgttaaaggttaatgttttttattgaaaaaaaaaaacgttccgcccccttttttttccctttggggcttggtggtggcaggaatggccccctgcacctttccttctcagtagaggtctctgtgtgcctgccagctggaggagacggaatgtattactggcctgatattatagaaatttctagatgttacctttcagatttcccacagggggacaactgctgagattaaccgtgttgcctattgtgcaaacatctgtaaacgcaccaccacagcaattgcagtggctcccccccagccagaaactgcggaaatcaaatgccctgtcttgcaaacacatctgttcacaccttgagagagggaggcttttcagagctccttgctctgaaaaatcttgggagtttgtttgtttgtccactctgtgagcaatccacagtgatcttgggagtcagaggtcaaaggcaaaggcttactgacctcccatgctgttccccctgtctttaggtccttcaagggcatgggtgctaagaggagcctccctgtgtaccaggctcacatctttggacttgtgatgttggctcatgatggtcgtggtcactcagaccccaccaggagctgctgaatccaaatggagtagctcttggtgacagtaaagtccacccctcccctggcctggagggtatgttctgattttgccaggagacaggtagctgagtaatacttgagatcttgggaaatgatttgaaatatgtggaagagaaaagaaaaaacaggattgatacattctgcattaaaaaccttatttgggcaccttccctattttctaccctcaaaaaaaaaaccccacaaaaaacaggatttgaatgaacatttggaaaaatgcctggaatcatcagccacgaatcaccagtgcccacccctgagcaattttactgtagagccaccacagtgaccaggccagggagggagccatgcgtgtggcagaaggaacggccgccaagtgttggctgcacagcgccccgcgcctgcaggagagcggagacaggagaaagcgaggccagctgcactgcagggagatgtctctgcctgtactttttttttctttctgggatctatttagaataatctttgtgttcaatttcatttttagattttaacaccgaattctttttgttcttctggatccacatatctaattttagcattgaaaagaatttcacctagtttatttttgtatcctaatctttttttagcgtaggtcaatggataagaaaatcacaaaaactaagtgtatattatcagccaagtgagctgctagtgcttataaacaccctttattttaaagacaatgcgaatttcattatgtaaacatgtaaaaacccaggccatcttaactgatgcccagccgcagaggtgaggtggcatggtcatgttcctagatgacatgttatgaatggagttccttctacatccaagcaaaacaggattccatgattcacagagcttgcaggcaaggttagactagtcaggagattcagaacaaacaaatctttggtgtttcacagttacaactccataggagagcacctgatggttatactggaagacgaagccgatgtccttgatgctatagatcaggagagatctgaaaacacacccagacccacctccaccccaacccagttcagtcagagtctcttgggttaggacctgagaatttaaaaaaatctccacagtaattttaataagcagctagagttgagaaacattgcctcccgtagagaacagtcactgggaagctaggattgtactgtggttacctagggtgatggactgagctaagctgaaagcagagccttgggtggggaaactgagaggagtgatctgtatagtgcttgggagcagtggtttaattccggctgtgctgtgaggacagtgataattatgctccttctgaagaaatccttgcagaagatgtcacctttccatgaattgaaaaggaggaaaggtgctgtgttttcaagcttctccagataatcttagaaatgtaagtcgagaaagggaatcatacaaacatcatgtcttaatttgacttagtacctagtatgggtttaacataacactgtcataataatatggtttacacacatgcatacagacttaccatccattcattgattcactgggttcctgctatgtgccaggcatttcctagggcactaagaaaacagcagcaaacgaagaaggctgagttcccctccgggaggggtcttacaccgagcaatcccagaatgtcggctggcaagaaggggtgagtgaggaatatgctggaggcagaatggggcccctagcctagagtgcctatgagaagacccctgttgggccctgacaagggaagtggctttgctcttcctgcaggcacaagctgtccatgatgctgggacctctgattcatccactagagccattgtcatcagaactatttctggaagtttctgagtaggtggcacagccctgtgtacctagtgaagcccccccccctttgattcaggggtcacattgggctgtttgcgcaaagaaggactcactgcttctttttccccttgtgaataagtaacaagctgttaagtacacaatgaatgtacctctctgcaagccagaactgtagtgattgatggaatccgatgtttacttgtcccctctgtaaccttagattaaagtcactgaaatcttcagcctctacatcaggagaatggcacgcacatgccaagggacgtggccaaaatggctggtggagctttgtgggaggcagagtgcatggtcccttccccaaagggattagatgcagagacatcaggagagcaagtcagcttttatggggagggtaacagtgtagtcagaagcggcaagggagaaatgataggaatttgtgttgtggagagaaaggaaggaggcctggacagggaggaaggagaagaaacattacacaagaaccgattgctaattggtcaagagggatggggagtgactgaagggccccttgggtgtgtcactattattcagtgtccaggctgctgcaaaaggacagctattaataaacatcgttaaatgcatcttgttttctttctattgctttgttgtttataaaatgcctgagtatacattaattccaagaatcctcaaaataactttgagaggtgttactgtgatcagtatataaagaaagaagacattgaaactcatagaggctaagtaacttgcccctaatcacacagccagttaaaaggcagaagcaaatctcaaattcaaatatttgagctccagctccagcaatctgaaatgtcaagatacctagtacaattgggttctggtcctggatgtgcctgaacatttttatgatttcacatatatcatgtgactctccaagcctttgaagttgcatttctctcatttccttgcctttctacatgtcttataaagatttctacgcttacatttataccctcaagtatgcatggacacaaagtcgagtttgggtttttttaaaatctggattaaaagaaattttaaattccaactttctttacctgattctctctgtagcactggccttttgtaatatatatttttccagccataggaaagagctttttaatgctcagatcccaagagctaaggaagtagatggctatttatgttctgccaggaatctttatgttcagtgagaggaagtgcaactgcttaaaactcttaacttctctctcttactttagaaagtcaagcagaaaaaaaaatggattaatttgacagatagcacagaataagaaaaatattagaaacaagaagaggccatttttcctatagaggctcatttcattctatataccacttccctgggatatctgctaattgttagcagaaagagtaatgttatctattttttaaaatttcactcttgagtactatggagataatagctaaatgatggagaaataactttctttcacggtagtagtttaagaagggtaaaaagagctcaaaggcagatgtttgatgacatgagaaaattcagcgacaaatgacaaatttgatatttctataggtgcagttttagaaagagtatctttttgcattgacactagagacctgtgtccatctgtacaagtgagggaactgcatgtgggtattaatagatgtatttgtaagccccggaaattttccagttgaaacttacaacaaaaacaaaaagtttctgttgtgttttgctgcagggccaatgcaggaaaccatctatgacttctggaggatggtgtggcacgaaaacactgcaagtatcatcatggtgaccaatcttgtggaagtgggaagggtgagtggaccgtctgctgcaaatggccattttgttccttgcttagttggtaacagaaagtaaggcatgaggcaagcttttgaactattatgtgtactccccaaaacattaactactccagctcctcctattgcttgctgcacttgcttataaattatcagtaaacatagcctgaattgctttcatttgttgcgatagcaacagacaggaaaggcactcaagatttaaaagcagttgttatcgggccatattgagagcacaaaaatacctctaagcatgaatgctgattgttgagtgtcaaaactcaatgggtgctgcattagacatgactaccttcccaaactcccaaaattggctctaaaaacagtgtgcagctctagattcaatccttagattagaattccagcatcttctcttgcttaaattggcctttcctgtgtctcagtttccaaacctgtggaatggaaagcatcatctttctgaaggtcttgtactaccttctccgtagtaactgtttatgagcagtgcttttatttaaccaggaaacttttacatagttgtaatctcagtagtagtatgctataggattatttccaaagtgaaattttaaaatgagcaaacacacagcgtgcagttgccttttttacagtaggttgaattccatggttgtgctaactgaagagaagttggcatcatgagatttgccctcagcaaaggcagcctagaggttatcctagaattgaaacagtgagacaggagccataaagggtttgtctcttaagattctcaggtttcaggaggcacaaaccaggaagaagaaagacatcacaattctctcataatgagaatattcagtaagtaggatatatatatatatacatacacacaatataagtaggagatatatatatgtgtgtgtgtgtgtgtgtatatatatatatatatatatatatatctagcaaaaatggcacattaacctgaaaatccccctacagacatctggaaattctagataaaaatataaatatgtattttaatatgtttatatgtatatcacatgcatatgcaaatatatatattttaaatgtttagcttagcccttaataaagacagctactacagaccagaaataaagtgaggactagagatcctagggagtgtagcgcttgcatgcacccttaggaggctgggcagggggttctgtgtgagtgttgggggagggtgggcagcaccagtctttgtgatcttggatcccgggttttaaagcccactgagggcaggaaataatgtggacacgtacaatgctaagaatttagatgttgactgccacacagaaccaaaacccacaaacagtagaccctcagagaaagggcaaactggggaagtggaggtagggagagggaggagggagaagggagaggagcaccagccagcccagggaattggcaaggaagttacaccattttcacttaggtaggatctgtgggggtaaagcacttcggccaactccagggtcaaagtaaacacctaataaaatcagaaaataattagaactgtgaatcataaagtatcatgatagtgttaaagttgtcacatgcaaataacatggtaccagagaaggaaatacatgtttttaaatgttgttattagaaaagaagaaataccaactaagcatctaattcaagaagatagatgaagaacagagcaaaaccaaagaaaaaaaaaaggaaataataaacatgaatagaaatttattaactaaacagcacagaagcaataacaaagttcaacaaaataaaaagctggttttgtgaaaaggttaataacatggacctctggcaacagatcagaaataaatagagaaaaaccacatatagccaatagcagattttttttgtactgcaatagaataatatgaataacaatatatttgatgaattaggtaattttctagaaaaatatgactttccaaaactgactcaaaaagaaacagaaattctgagtagataataattatcttaaactcgaattctggttaaaaattgacgcatggaaatgtaccagtgtatttataggtactaaatattcaaggaacagataattcaaatgttgtaaatgttaaaaatatataacattttataaatatataaaaatacataaattatatacattttataaaaattattctaagagaacagaaaagaaaacttgttcccccatttcattttaagaggttagtataacctcaatatcaaaaccagacaagactacagtaaaaggtaaaattataggtgccacacatagataggaagagatgaatagaccagtaggtccaagcaggccagatgtaagacaccaaaagcccaacatattaaggaataggataggaaaatgtatgatagtaagatttacgtaaaattatctgtattacaaagggtataataagtgaccagacaaggggggaggtactatggggctattatgcaaagtttaaacacttccagagcaatattttatatactaaaagtatagaaaccatttctttctttcaatgatgtctctgccgggagccagcatgggagtgcaggtgagctggtgaggaggctactgaggcagggaggaccaccagcccggcctagaagagggtgctgggcctctccttccacagacctttctctggaaagaggaaactagcagtactgtgtgtccacctggttgggctgccataaccaaatgccacaagccaggaggcttacacaacagacatgtactatcttcctgttctggaggctggaaagtcccaatccgggtctggcaggattctgcttctggtgcaggccctcctcctggctttcatgtggccaccttcttgcggcaacctcacgtgtcagagagagcgcacgctctgtggtgtctcttcttacaaggacacgaatcctattgggtgagggccccaccttaatgacctcatttaaccatcattatctccttggaggcctgtctccaaatacagtcacacttggggtttagggcttcaccatttgagttttgggggtacacaaatattcagtccataacagcctgcttaatggggttctcgtaaagattcagtgagtttccacatgtcaggaggttagagaagttcctgcccattccgaggactcaataatacagctattagtgtaaccgtaggtttccaccaacaaacctaagactgaagaaaaagaccctttttgttccgcacaccaaatctacctacttttactatgaaaacattaatgactattgaaaaaaaaaaggccaactccactggaaagcaagttccttgaagggaagagatggccttgctcagcagcctctccctccaggcccagggccctgagcaaatgcccagcaaggtgaataaagagagtacctcgccatagtgtcacggagcacaccagagccacctcatgtagcctaaacatttcatctgctttcatgtgcttgtgtttcttcccctgagaggtatagtcccatctgactccttcatttacttcacacatccttgctgaccacccacatgtgatggggagaaagaggtacctggagcccactctcgggtgccttcctttcacaatcccagcactcccagaaagttgtgcacccgtgcacacgttcaatatttgcactggagctcgcttacaggaagagtcctcagtaaattattttgaaaagtagataattgctaaataacaactattactggatttttaaaaataaaggcacatgtattttttgcttaattggaattccaaaggacaccactgtgtctggactcagtggcttaaaaggttaagctgattttgtatgatacagccttttactttaaggaaagatgaggacagcatagtctttggttgaaaagtcaaaagaaaattgtgctgtaaaattactgcagcaaaaaataataattacacactaaagcccactgtgtctgagacatggcacaattttcagggagccaggtttcattcagagcgacctgggtttagaaaaggaatgaaaatgctatgcagtggtggtcgctgttccttccatcaggcacctggacccgtcacatccagggtagtcactggtgatttttatgacagcaactattccttctgacaaataaccatggaaattttgtttccaataaggtgtggctgaagtgggtggtggtaactaggtttctggtttacccataaatctaagtccgtagatttaaagtaactcaaccatttcaggtctggtaaggttattaaaaaaaaaaatttcttccaaatccttaccaggtttgtggggacacgggtaagctctgaagaggccccacctcattgccatcagccccttggatgggcctgactttagtaatgaaattatggcatctgtccttgaaatgtctggcatgatttgggggttttgacaagaggtcatgttccctcatgggaaaagcactctccttgttccaggctgtttcccattgttaatcctgcacatttgtttacagatagctcctccatttttagcttaaaaacaacaacaacaaaccacccaagaaatcaaaatgacatggtttttaagggcaatagctacctacttaacatgtgtaccgcacatagtgcgtccttcatgcattaagcatgagctaggcggatgcgtgtttgtttacacagacttgctgccgattcattaaggcagagctggggacctgcttccccccattttgccctgaagcgctctgcattaggcggccctaattgctggtgttggagccgccaggagacctttcctgtcgcagcacctggtgcagaagacatagatgctgcacttccctccagcggggtccccggtacatctgacaggacctgtcattatctaagacttccttgtcaccaccatgcctccccttttagcccacgtgttctgggaagagacccttgtcagttttcctggcacctgccaccggctgcacacctggcattgaaatggcgctggaacgtgttgtgattattttccctctttaatgaacccacctgagggacatttagtttcttaatccagtcgcctgtttcccaggcattcccatttacaccgtttgtgtggagattcaaaaactctgttgtggtattgagctgttccatctgccagaagtcttataaccaaatctgcaggactcccaaaggagactttttacaccggtaatttaagctaattatttctaaacatatttagtcagttttatgaagacctcattagaatgtgactgtttattaaaaatccaaatgaggtctcacagtcacttaggaaaattattgttgagtcactctgaatagttctgataacagaagataaaatgttttggagctgagagaagtggggaccagagctgtggacctctatcacagtaggggatgggaagaaaccacctacatggattcttggatattttccacccaaggagcctgccctaaaattcctctcacagtacttgtcactaaaagagtcatgaaaggaaaagtttactatgaacactagacgtcagaactaacaactttctaattcacatacaaggaaggtatattaagattccaggtgcccctctcacagccaagaaaaaaacatcttcttttgtgcaacagccaccagacccaggatcaatgaggaagcaagagagaggcaaggttgcccttttataaaaagtgtggaaatactggttaattataagaataaaaatattagtaatcgtttttactacaaaatctcttgagttgttccaagacatcaaactcataagaaagggaagagggaaattgtttttatagacattgctgacagttttccgtcttgagcactcactgttactttcataggtcctttttcataaactgatatttaagattgatcttttgtgacctgtgtaattacagtcttagcctttgaataatttatgctcattcagcaaacactcctcatctcaatctactgtcatcctttcgcctatcataggatgaagctgacataagccttacctccctcctgcatgttacccctgggcatttaactgctcattggccatctctacctctgtgtcccacaactggcacaaaccaagcaccttagaaactaagcttgtccattcatcttcagactcctggtccccagtacctattcttatcattcaggcttgaaaacaaatttcattttgtactcagcccaatccaatgtcaagccataaaaacaccatgtgaacagcacacctgcctcctgttttcaaggtgcctccagtgcagcttgggaattcacagtctttcatatcagtcccagtagcagcgtccccactggtcaccctggtgttcacactggtcaccccagcatccacagtggtcaccttgtgctgttgtggtctcagaggccaaaatggatgccccattatcaactaagacagaaaggtgaaggaaacagagttacctacaggttgaaggttcagggcctgtcggggcaaatcctctaagttcctatggccaaactccctaccaataggagctacagctctgagtcacaacccagaccactgcaactctgactggccagaggaccagccttgaaaacactctttcctgataagcagctgtagatcttgagcccatttcggcagctcatagaggctgcatacagactgtctttgtgtcccatagctgaccttttgatgtaaagagccaaatgccattttcttttcatggtaaaaaccccaccccaaagtgaacatgggatgtatggtacatgtatgtttacctattgcacatgtgctcagctccccttataaatatgtatagctttccccccaaacctgctgatatgtatgactctgttgtgtgatacagacctggtgaggcataaaagccaacctgtccttctttctgaagagagagcaccttcagtccatgctggagactcttcccagcttgcaaaccgataacccccataaagctctcctttctactgtccagccatcctggtggtcttttagacaacaccatcttctatccattccatgtgtcagtgctgcattaatttttataaacattggctcctgacacaccactcatctgttcagaatccttcagtgattcctgtcgaatccagaacaaagcccaaacctcaagatccctctattctgtgccttcacagtgtggctctagtctacggcaagcttatttcccagcattctcttacaagtgtttgaagtgccaggcagacaaagtatttgccatttgccacacacgcccagcactgcattccttgtgcttttggtgctgtctggcccatgcacagtggagctctccaggaaaacccctgccagtttggaatgctctaggtctacacagtcgcctgcagagcctctagtcgcaggggtctactgagtattttcagtgtggttattgtgactgagagattgacttctgaggtttatttcatttgtattaatttaaattgaaatgtccacatgtgactaatggcttttgtctgggacattgcagggacagcacctccttgccttcctccttatgcctgcttaaccagggcccttcatttaatactaattgaaaattccaccctttctaagaaggaaacccgacctgattattcaactggctattttatctccctcatcagcatcctctctgtatgtcacttgccatattctgtcctttagtataagttttagcccttcctcatttatagtaagtcagtcagagaatcagaaggccttggctcttcccatgcccattgcaacatctctgagccccagattcgtcatctgttaagcatagggaatgatgcactaatacccttctgtgtcacgggattactgtaaggattacagaataaattgagcatctgttgtgcctgtttccacttctgcaaactcaccttctcagccattcctgtgcacaaccaccaggctgtgggtccttccaggtaggcccagtagaagcaattggtcaagaacctttccctaaatctggccacagggacggcctctctgttgtcagagatggtggagtttgcaccttgccttgaattccttcaattctgtaggtcatgaattatctgtttctgctggaaatagcagcaattcctaaactagaattgctgtaactttaacacaaaactagaagtcaaagaggagattggcagtgtggcctgtgatgattcccatccagacactgccaggcttcacgccactacccccagcacatcagccaagaaaggaggcactaacgaatactgagctatcagcagcaggagaaaggccttctacagactcctcaacaccagctcctccaggaaagatggttccctggctgccctggtgaacctggaggttttctctgcctgaaaacctcagttcccctctgtaaaaagttcaaccaaagagctcaatttgtcatgttcacaaattagcccaaagataggctttttaatcccttctcagcacaatttaacccaacatttagtgctgtacttactgtatctatgacactaataatccaaagatagttataattcacttgtcctcaaagaatatcacctgtggtcattgagaaccgtatatcaacaatgaactgtgatacatgttcagaatgtgatagtaccaacaaagggactcattctgcctgtggcaatctaggtcttctcggagcacgtggtaaagagctggaccttagtaggaggaaggattttattttgtctttattttagatttagggggcacatgggcaggtttgttaaatgggtatatttagtggtgctgaggttagggcttctaatgatcccatcaaccaaacagtgaacatagtccccagtaggtagtttttaaaccctttccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattctttttcttttcttttttttttttttggtttggttttttttgtttgtttgtttgtttgttttgttttttgagatggagtctcactctgtcacccaggctggagtgcagtggcacgatcttggctcactgcaacctccgcctcctgggttcaagcaattctctgcctcagcctcccaagtagctgggattacaggcacccaccactacgcctggctaactttttgtatttttaatagagatggggtttcaccatcttggccaggctggtcttgaactcctgaccttgtgatccacctgccttggcctcccaaagtgctgggattacaggtgtgagccaccccacccggcccgatttcgttttttatggctatgtagaaaatgtgtatataccacattttctttatccagcctaccattgatggacacctgggttgattccatgtctttgctgaggaagcattttaaatggcaggagtgagacagtaaccacttcagcagcataaggaagggaaagcacaggaaggggaggaaatggcaagatggagaaagagctagtggcctgcctgatgcagctgatgagggaagaactctgaggccgggaagctaactgcaggcttgttgatgaggatttgaaatgtgtttctaggaaggaaggagaggtagcaagtgggcagtgtgtgtgtttgtttgttcactttaatggaaggcattgaggtagtgaatcgtgttctaattggtattgaaaagcaatcttggtgaccattaagaaaaggctgagaaaggctatggaagagtatggagacacgtttaggaggttagagcaaggctctaggtgaaagatgatgtgggcttgagtttgggcagaggtgttgggagcttatgaggagtatacagtttgggtgttatggtgggtaggtggtgctgataaggaaggaggagaacttgagaatgaaccagggtttctaccactgtgacttgggttgctataaaggatattaaccaagaatgggtatctctttccagcccacccccacacccccaaataaaagtaggtgtaaggagaggcaatgtgtttcatcttggacatgctgagtttaagaagctgaatgagcaataatgtggtgctttccaggaagctcaagagagagatgtgagctgaagacacagaaacaaactatgaaatattagcgtccccctttattcacaagcatctactgtgtgttaggctttggctgcactgaggatatcaagatgaaaagacatggcacaaactatgggacaaaaaggcaaacaaaaaagagtataatgcggctgggcgcagtggctcacacctgtaatcccagcactttgggaggccgaggcaggtggactgcctgaggtcaggagtttgagtccagcctggccaacatggtgaaaccccatctctactaaaaccacaaaaaattagctgggcgtggtggcgggtgcctgtaatcccagctacttgggaggctgaggcaggagaatcgcttgaacccaggaggcggaggttgcagtgagcctagatcgcaccattgcactccagcctgggtgacagagtgagattccgtcttaaaaaaaaaaaaagtataatgcaaagtgataaccactgcaacagaacagagttcttgggagaaagtggaaagagaaaagaggaggactcacaacagaacactggagaatatctgtttctgggggcagtcgggaggaacagctgggatggagtctggaaaaggaaagcaagaggaatagggcgagaacaaagagacccagatcatgagaacgaagagaagacagcatttcaacaggaaggggatagcgaccaggtcacgagctacagaaaggccaggtaaacaggaatcagagagcaaggtagagagaaagaatgtactgagtcaggcatcctgctaaatgtttcacaagccctattgctcttatcacagctaccctgagtacatttaaagattcctatttttaaactaagtaaggcttggtgtggttaaataatttggccaagggcatagagctagaattgaaactttggtctgtccagttccaaagcccatgctctctccccattccacagtgccccccgttagcactggagatgtctttggtacgtaccaagttcccatgggatgatagaaccaggaatccagcagcagtagaacagtggctaagtgtgcagcaaagatgcaaatgtagcttgttcttggagcagcgagtcacaggagagagatgaagcagcacctagaagggaacagggtctagacagtgattataatggttgggagtgtgtttttagtgatagagtagacataagagtaactgggagtctgaaaagaagatgtaattgccttctcaaactaaaggtacaagaaaaggggaaaagtgacagaggaaaatcacagacaagacagaaggggatgccttcagttcataagcatatgctgcattcacaccactcaatgtgcagtcacagaaagccagggatgctaagacaaattaagtgtgtccctgtacacagggagggggcatcaagcaaagggatgaaattccgtgataaaggtttcacagcatgctgtggaagttcatgaaagaggcacctcatctagctgtggagttgagtggaggttgaagggatttgtcaataaatgcatctcagaacaaggggtgcctggtgctgagtacaggaggtgggagagcaaatgaaaattaattggcaaaggagggagggaaggtgttccaggcagaggcaaccacaggaccctggagggaagctgcagggattcagtatgaaccaggggagatagggaatggggattctagggagaactgaggccttgtcatggatataccacgtcaggaattgggcttcagctcatgaatgacagagagccccaaaggatttgggtgtggaagtgacaaggggaaagggccacactggagatactgcagagacagagtggatcatccaaaggcagaacaatcagcatctgacttaacaaggaaaaggttactggcaaccttttgcctcagtgttttcagactgatggcctatctgagttctttgattacatgcaacagaaatcaactctggctaatttcaggaaaagggaaaagaatattataagctcaaaatgttgatgtgaagagtaaggcttacaaaagataggaaagaaggtaacagctccagagggctagtgagccaaatgggtctcacagccagacagtctagtcaaggcgctgatgctaagacagtgagctctctggtctctttgtcactgtgctcaggattctaataacaaggatagaacctccgactcccaaaggttggttcatgtgctcatccctcgctgtccagggcctctaattgacaagccacccaatagggaagaagtaattccccaaaaggaagtcaaggatccattaggaaggatgaatggatgaaatggatgttgacagaccaaatgatgcattcagtacaaacggcaagcactgaagccagcctgcagcgttgaggcaggagtagcaaatgaggatgcatagactgagtgtggacttgacagaagcttagctctgcagggaaaagagaggagtgcagctgtaaacagaggagcatttctgatcaaaggatatttataaggtgaaagacccttgacagtagttatgtgttaaggaaaagaatcagaagagagggagagactggacatcttgggaagtggacggagtctttgccagggagccaggagggaagggaccctgagtgcaggtcctccattcaaccttacaagagatgacatcttttcctctgagcctgcagagcagagacaggcgtggacacacttaaataaattgaaccaaacagaaacacactcaggatggcaccctctcctggtaacagtggttttcccagtgtagtaaggaacaaggccatgggctgagaagctggacgaaaagggaagtagctattttagggatgcatcaaggacataggtaaaggtgttcgcctggaatgggagtgacctcttctctggggagaaggtaaggatgggcagatataagtgagactccagttggcggctacaggatgcaggtaggtggaatcccaggacagccaatagcccaaatcctccaggtactagtggcaggggaatgtgactccaaggagaatagggtgttgtgagcgtttctaggtgaactgaaaaccaacccattcttaccccacaccttactttttgcaaccttggaatgaagggaattatccatatgaactctaaaattccatgtttatatgagagatattttcctgtttgctgtttacattttggtgacgggatccatttgaataacaaaagcatctgcactccagatccagtttaatccacatgcttccagagtccttgatgcttcctgtacactctgaataccaccaacagcagaaaacgattgagtgtggattgttaaaggggaaagattcaggacaaaaacatgaggactgtcactcccttgggagagagccctccgctcccatgtcctctgcactgttttcacatgaattgtgtagaggatctggaatggaatgttgccatgtgatcaggtaccagtgagacaaattctgtcagtgatccttctgtattttaatttatgcagaccataaaagatattcagtctgttctctaatttatagaccttcttttgaaaataatctaatctgactacagtaaactaagatttttgaagaaatatatccttttcagaagttctcaaaattacttaaagctatccccccaatttgtcaactgccacaatcagtcgcacccggtgagcacatttccgtgtctttacctagtgatcagcagggccgcagcgggttcctgcctgcagtagggagggggtccttggagagaatgtggtttctttggaggactctcacgatcgtttaatgaagatatctatgcatgccccgttgtgttctgtataattgcaagtgtgactgttacctctggaagatctccttaggcaacgaaatggctattttactcaaagtgtttaatcaatagagaatcatcgtttcacatccgtcaattcaatttggacagcaaatccatttaattaaaggtaaactgtggtttaaaggagatgcaaaaacatatacaattataaaacaacttcatttaaccaggaaacacttaattgactacaaactgggtaatgattttgaaaaatatgagactaaaagaaacacatactcgcagactaaagcaaggagaaaaccatataacttttttctccaatcttattgaaggcttattcagtattttaaatactaagttctgcattttataacttagagtaatgaggtttcttatataaaacttcatatcatatgccaaccccaacctctgtaaactttattctgatagtattcctgcaaatacatacatacacaacatatttacacatgcacatttttgtttaaggctagctattcccccccccacacacacacacatttgcctgcgtgagtaaccagactagatctcttttacaattttcacattccccatatctgatcagaggttcttcccaaatgtatgcacatgacacgcacacacacacacacacacacacacatgcatacacttggacatgcacacacacacatccctatctccatttcagaaatgttctttgctttgttgggagcaggaagccactgtttgttctgagtgcagaccatggtctctcttgttctgaattctggtgagttgtcaccatgaatgaatgaatttcctgtggggaagacaggatcatcttcctatctgtttctcacgcctcctgtgtctctgctgttgccagtgttagaaaccttaaccccttggagtctgttcatctctcttgctggttctgctccctggtatgcgtgcagctagtgactgtgcaggcatcaggtgacctctccgcctactttaggcaaaagccagagaataaaagagaggatccttcaagacatgtacaacccaattatagaggtattacataaggttgtacacgagaaggaacaaaacaccttcagctgccatgttgccttccctgccagaccataggcttctgtgagcagaaccccgaaaggctggacacagagaaagtatgagtgactgtttcaggagaggtggaagaataattacaaaggaacatgtaagctgctgcaaaataactgagtgcatacgaagggaatttctgtgtactgccctccttctgttgatttcttctacattggaagaagagacttgaatctgaagccatacaaatatgtataatatattcactaaggatgtgagtgaaggtcactacacctgtttgaaatgacagaaatgtgtctacatttagcctacccaattaatccttttgtattaaatacttggtaattcagcctaatccattatgtccctttaaaaagacaaaaaaagcaaaagtcgttttcactcaaatatcgatgaaatacaaatcaggcttcagagacaattctttatgtgctataagtcatctgacacttttgtgtcagccatctctcatgctgccacagtggcaggatattacaggatcaaagcaaatttgcaggtctgaataacaagtgctgctctgagcacgctctcctggctcctccaggtaactgcgagctgggtgcagatcagctctttcacattgtctagctgagcctatggagacacctgtgcctgggcacctgcctccatggtcacccctgcggagccctgtcgctagccttcaatggacactcttgctgctttgccataattggctgaccctggaaaatcctcacttacatctgtgcctggacttcttgtctctttgccattttactggcctgggcttggggcctctgttgtgtcactctgtcacctctaactttgtctgccacagtctttggggtacatacaggtggtcacctgcctttgtatctaaaaagtgcttcagagggcagggagcctgcatgtgtagcagatggacaagtgcacctgggaccgatgcatcacagcctgagcggttttacagtgtggttccagcacattcctacctgctcgggtgtgcacagctggagtttcccggcaccatcattggacgcaatatgggacagtctcagagctgcaatagtctgccttccttgttctgctcacgagcccttgaaagtcagtttttctcccgttttgcgcacagcaggtatatcctattcttgaacaatttgctgaaaagcagtaaatgaggtcctttcttgaaggcaggattcttttctcctttctctactttccaaatctactccctgagcccttcctctgccttagaaggcttagggttgtctggccacataaatacatgagtaaccactggggcctctcccaggaggataggaccaaagaaacagaaaaatccagtaactggttttagatagagcctttacacaactgcgttcagactaacaaagtggcaaagacatcagtatctctactttagtttcatgaactaaggaaataaataaggagaaatgtaattcagtaggctacagacaaccagaattcactgcctcagaattttttcactgaaagtgcctgccacatgtctaagaccagagaaagacagcaacttatgcataagctaccactccctgtctgtaggaccaggtttctagcagtgagaaggtggaacgggtctggacacacctctgccgtgaaatctatgcaaaaaaaacccttcatacccgacaagaagatagtgtgtcagttgcttccctatgcctgaattacaggtttgtagagctcaggacaaggaacgtgcatttgggtaacattatttgaaaattgtgggggtgctgctgagttccaaaagtggactggtcaccttggccaatactagctgaggaagcagaggtgagttagccccctggtattgcactggattacttgctaggactttgtataaagaagcacagtctgaaacagacgcactgcaggagaccagggatgaacagtggggaacactgcctgcagaaggggatgtgaaaagaagctgggagtagatgtttcaacacccgacactgtttggatttacatcttttagctttagagtgtctactgtaaaatagaagcagaactcttatcacttaaaattgtaagtaaacagatgtctttattctagagtaacatagcacatttgttatctcaccaaaaatagattcttttctgatgttgtagagtagagaatctgaaaccaacagtgtacgtgtaggagcttcaatccattcaactggtggcatcatatacttcacatccttaggactgcttatgtgatgtgcagtcaaggattgggcaggtcatatatcatgtcactccatccttcaatgccttttgatctgtttagcagctccttgtgacaacctaaggaagagggtgagggtggtgagactcagattgacccgtgtcttttgtaaattcttcttcctttcttccttccttcacccctagagccctttatttcctcaaagagatgaactgggacaggtacgcacttcagactgtctcagaggcatttagccctgattaatgcctctgaaattaaagcttgttatcttcctaatactgatacagaccataaagcattgtgtgttacaataaatggagcacccggagctctatactgagtgctgttcccttctcgatagcagaagtgctgggggatggtgaccaccactaacagttactggacatttcttatgggtaagtcaatgtggtgagtctttagctcatcagagtgattaagaaatagacatgattgttattctattctccagataataaacaaacttaaaagacattaataaattggtccaacttcatacagctagttaatgtgggacccaggatttgaactctggaacccatgctcctgactcctaaggcttccaaagaaccacattctagaatcacataatcagataactgtaggactcagaatacctttaacaatcatatggtcttgtatcctcttttgccagtaaggaaactgagtactagaatggttcagtgacttgcacaagatcacagagctagattggaacacagctaggattagccccaagccctcctgcctgcctgccaggcttctttctgttacagcacactgtgtcatcattaaatgttcatttttaagataggctacaaaaactttatccgaggttcttaaaaataaaatgttatccttctatctagaagaaaagaatatcgtgtgtgtgtttcaagaactttcccaggtcttgactaagtcagagaggtcacatcttggcaacttgggagacacaggagacccagtgcctgagctcaccagctctaggaaccctgatatgtgcctgttatcctgccaccccagtcctgaagctgctgccctcttctcaagcagtgtgaaggatccaagcaagccgctggtgatggggttgccagacacctagtcctgggtgatccccggccccaactgctcccagctctgccatatccgacctactcacacatcccttgtcgcaattagttcgcaccttgcacttagcagcccatcccagcagggcagctgcctcagctgcagagagccccatggtggtggcagtgattacatacacctacacaaaggaactaggtaccctttaaaaacactgctcctacagaaaacccattcctgtgtcttcctgctcctgttgaatacaaactttccttcccaatacaattccctttatttcaaagtgtagcatcaaagtgcagcaagaagggcctcagaagcagctgacggtcacaaaatagtgactgcttcctgctgctgtcggaggatcgcgccctcccagcccccacctgccagagcctcaagaccactccagctgccctctgccaactccccaagtctagaatatccctctcttccatatccacccatagaaacagcactccatatttctgtctcatttgtaaggtagtttcccttatgaagctttgcatacctttctttggaattagcatacttctgactgccaacagcagttttcatttttaaaattttaatgaacatttacttgtgctgagcatgttctaggtgctttacaaggaaaagaattgagttaatattcataacaactctcttagcccattttacagatgggaaaatggagccaaagtcacacagctaataaatgggacctggctttgaacccagacagtgcggctccagggaatgtgctcttgaccagtcagcttgccccttattctgccttgagttgagtttgttgtttacacatctgtctcttagtgactattagaactatgtctccttgctctctgcatccccagcaatgcccagtccgggctctgcttgtcatgcgctttcagggctgtctgaatgactggcaggacagcctggacaccacagcccggagctaagcacaggatttccctcattgcagccacagtgttggtcccttaggtctcctatctcttaatctctcccagctttacgttatgtgtttgtaaaataaggataatagtacttaccccacaaagttaatgggagcgggcgtataatcagatagcgttaggagttggaatcgttttcaccagcatgtgatctagtctttggcacataaggaaactgagggccagaacggttctgtgactggcacaaagtcgtagatctatactgtgaccctgacacatgtgaagactgacaatgacagaaaatacggatttcttttctcaacagatatatcatgtaccactctaagaaatgtcctctctgatgtacctggtggcatatatatgtattctaataatgtcattgctcaaaagatttctgaagttcttatttcagagtaatctgtagagtagtatgtgacactctctgtttattgcccttgctggtggcaaatctccctcccctggcaggaggacttacatttggggaatagctaaaagtcaagctgaacctcttgaataagatggggaacaagcagtggaaataacatgtctcctgaaagtctggttgtagtttgagtgatgctgctttctgattaagttttcatcaagatgaggtaagagagaaaagtaacaagacagatttctcgtgtggtttgtaggataacacttaaaattccacaaggggaccaggctgcatgtttctttacagctgatgaaaaccagcgttgtgggtacagatgcggccttgtgcttataagtattgtatgcccattaaataacaacattaacgaatagatgcaattggaaaacagacgctttgtgagggtactttaaggcaggaccgtaaaggcatgaaagagggatttacttatgatatgaagttatttcccaaactgaaactatccagacttccagaagctcttgatgtagtgccagttttgaaataatcttcaaggatgtttcccaaggaaggtcccccttccaaataaagccagtatgaaaggaagaatctaggaaagctatgataagccaggtacttaatcagcaactttatatatactttaaaaaatctcatctaatcttcacaccctccctaagaagttaataataggatctcatattatgcatgagaaaacaggctcggggtggaagtcatggaagtcacctgccgcatgagaagactgaggctcagggggtgtaagtcacttgctgcaacatcacaaggtagatggaaaaaaaatccatgtgcatcttactccatcacactgagaccagagcaatctgtgttctcaggatatttaaatgagtaatattttattcctgtgagacctctaaaccaaaaggtttggggatacaataaatctgttatcttggaaacaaagctggcagctgctcttggctgggctctatgtggtagctgtgcttcatggcagtgtttttgctctcactatccaatatccatccaccctcttctcagcgggcccaaacacaactattaatagaagtatggatactcggtttggatatctctttcaaaacaaagaagagtctcttaaaaactcttgagaaatcaaaacttgtaactgccttattctttttcatcccttcttcccctttaaagttgtatttattggatcacattatggtgcccccaacttaagagctaacaagtacatttcttagtccttcttcatcatgggtttcttagcaaaatgagtactcatgcgcatgcacataaacacaccttcagttctgcccagactccttcctgtggatggggagagttgctgacacaggaggcagagtagaaacgcagcagcttgtgctaatggaaaaaggaggatgatggtttcagagcatgcattctgctctcctgcccacccctccacccgtctccagttctgcccccaaaaaggcagctgaagtcatttcaaggcttcctactttgtttctgttccagaggccaagcctcctggtaagactgaggaaagcgtaaagcaccttgagttccatcctcccaaagggccctgtagctggagtcagagcctgcgtttcagcctctccttcaccaccatctaatttattgccttgagcaagccacttgcactccctaggcctgcctgttgcttcttccttccagagcacgaggaaatacaaggaatgaaaaggatcgagaccagcctggcccttgctaggtctcttctgggcaaatcacatgctcttccatccactaagtgaggccacagatgtcagaatgcagccatccagtgtgtccagttcaaagtagaaactgctcggtggatgggagttgcaatgatcttgaaaatgagtgtttggaaattgactgtctctgagattcctcgcagctatatttgatttgaatccccttccccaaaaccacctattgtgttgggagttaatcaaaccacactgataggcaaatggacatgccaatctctctctccctctctccctctctctcctcttgtcagataaggtttgagggagagaggaatcagcaggggttccccctagctgtccctccaccatcataagccatgcacaattgtcagtactcacctctgccctcctccttctccgggacaccctgcctcctctctccaggcctccatgggctccttggcctctgaattcctgtagacatctagagtccagatcacaaaacaatcacttaatagtcggaattttcatttgttcaatttccatttttggataaactgggcacatggctaaatgttttcatcacattgtatcaattaatccagtggttcccaaatgtatctacacttcagaatggcctggggagaggggggcttcaataaactactgatacctctgtcccaccccagaaattatgatttaattagagtatggcctgggctgtagaatttgttaagacctccctccccccagctaagtgattctaatgtgcaggcaaatttgggaactgctgacttcttagaactctctgccataggacttataatcatgtcctatttacagatgaagctcctgcagttgagcaaactccagtgagcccctcaagctcacgtccacactgcgtgagagccagcactccagcctggcaagactgcagctgtgctgtctcaatccttgctacccacagtgtggtccagagaccacagcatcacctgggagcttgttcaaagcgcacattttcaggccccacaaagtcagacctaccgaatttattcagaatccctccaagggagtctcatgcctgcttcactttgataacggctgctgtagtcatgtcaaatgccctgaaggttacagtcatgtgctggcagcctcgggagccacagctctggcccctagccatcctctgactttaatttacctgagtattatctgggctgctggtttaaaatgacccacctcaaagatcttttttcaggaagttagaaatcctggagttatagcgtttctgtgctgtttcgtgtttgtgagttttaaagccaataaggatcacccctttggagcagggaccacacatctattcctgccgccctctggcagtaatgagcaggtggcagggctcgggactgttagcctgattgatggcctggtggaaccaccaccagggcactaaggtaattagacgatctgtttctggaccttgctttctgggctggaggctgccgccttacgtgattaggatgcgtgggaggcgccgcctctcctagaagctgtgcaggtagcgctgggctgcaggaggcagccaagccaggcgcacgatcagagcagggacgcctcccgttccttggttcctgggctccaacgggcacctccaaaccaatagttccagcatctctgtatgcagaccttagaggacaggaagcgactgcgagccccacactctccagacacggaaactctaaatgcagagagaacgaagcatattttgtcttccttttcctttttttttttaagcaaaataataacttgacacaagtccaagtagttaaaaagatactaaaagaaacccaatttagaagggcttttagtaggctgaaaacagatgtggcaaaccatttcgggatattctgggagatgagatggggaggaccggattcgaaatgcctgggccgcctgttctgggcccgccccgccaggtgcctgtgctcgggaggggccttgcccagcacgcattctagaaggaagcggccccgcgcctcctccctcgcaattaccgccgggtcggaggcatccgggcggtgcgaagtcagcaccgtgccgagcagttgagagcagacggtgttttcttttcattgttccctcgcttcgctgggagagcggcggcacctgttccgcggaagcgcggccaaagttggaagccctggcggctgctgcctgcagccgacgcgcgggggcgcccggcttcatccggccgcgggggaccaggagcctgagagcctggaactgggtgcggggggacagccagcccgagagggcccagggtcggatttcggatggaaccagagctcgctccagggagttgaaggagttgggagcgcatctcccaataatcccaaagaaaccgagctttcagtgcatgcaaggggcatttgatttccctcatttctgagcactgaagcactccactgtcatatttttgaaattcgagaacaaggaggttaaagagtctaaatggaagactaggtgaccatccaaaatatcatacatcaattgcatcttgtaattagtaaaatcatttttattacttaaggtaaatcttgataaggtgtttttattaggtaagataaacctggtataacatacgttgcgggtgtgtgtgttttgttcagttgtcattttcagagaaataaatgaatttttaaagtgtatatttattcatcaataattatttttaaagtgtgcctgtataccatatatgtagttttatatctatcccactaccttctgcttgcataactgaagtcacaaaaaggtaaaaactaatcccccaatatacagaagaatctagtatgtcccataaaagcatctttgctaactggcatcgtgaaagtatggtgctggacactcttgaaatgaaatcattgttactgtcaaattagacatctccacaaatatacatgatctgctcaaactgactttacatctgggaaaggagaaattgtaggtctctcttactctgggatatttttgatagagcaaaggtatccatgatgtaaatttctgagatattatagataagccctttataaagtcacaaataatattcccataatgaggggggaaaagattccaaagaaggctgagcacttactgagggcagggaccatcattgtctcctgctttacagtatctgcaactcctagcatatctggtttacgtcttgccaactaaaggtaatgaggcttccctggaagggcactgaatccatggccagaaagtttcacaaggaggcagctgaaataaccagccacatagctcatgggggaacatcagtgcacctcagggggttggcattctgggagaggtcctctcagctcagatttcttttgtaaactttcccagtctgggactttccttcctacactgatcctatgactctgcataaaattcagttttatatgtatacattgcatatttagtgcacacaggacacagcgatcaggtgttgcagggtttgcagaaataagcaaaacaacaccctttatgtgctggccaggaataagtttacagtcaaacagtgcaagaagggcatcataccagggtcagaacaagcatgtttcatcagggcagcaaaaagagctcacatctatggaggagtctttgaaggagtgcagcgtgtgagatgtactttaaagaatgcaaaaaatcttcaactgggaagaaatggatgggaggagaatattctgaacagaaggaatggtgcgagtaggagtttggatcatggggtatgtttggggaacagggcaaacacttgtccttgaacataaaatatatgtgcatagaaaagagagctataaaagataaggctggaaatgctggttggggccatatttaaaaactcgttcttacctgcctggccaaataatttgtatttagtttcagaaagtagttagaaataggagattcttgagcagaacaagtaaatagcactgggattacacattgagagagtttttgtggtattgggacacatagaatgcccatgcaggaagacagtagagcctgaatttaggattgtggcagagggattaagaagttggaaaatacactttgagagctgcttcaaagacactcctagccttggcaaatggttgggtttgcgagaaggaatgggttggttaagggaatcatagcagtcacataggaagtcaggaagagcgcagtgactgtggggcaaagaattctcttttagacttatggtctttgaggtgctggcaggacctccaagggaagatgctcacagaagaagttagaaatcaaattcagaaggttgggcacagcggcccatgcctgtaacctcaacacttttcgaggccaaggcaggaggatcgcttgaggccaggagttcaagacctggcagcatagcaagaccccattgctataaaaaataaaagattagctgggcatggtgacatgtgcttgtagtcctagttacttgggaggctgaggagggaagatcgcttgagcccaaggattcaagattatagtgggctgcgatcacgccactgcactccagcctagatggcagagcaagaccctgtctctaaaaaagaaaacaaaacaaaaacaaataaaaaacattaaattcagcacatggagaaacagggctagagttacagaatagaaattcatccatggaggggcagggacaggaatagatgaaaatgccaggaatcctggggaggcagaagaggccaaggacagagctttgaggtggtcacgtgttcctgcccagcctctggtcctgctctcctctcgttgatgtctagaaaaacattcttaccaaaaaaaaaaaaaaaaatacaatttgctaggagaatttcaaaaatatgacagtggagtgcttcagtgctcagaaatgagggaaatcaaatgccccttgcatgcaaaattcttccacctgagattagttagaggcttcagacaatatggaaagacaatttcagattttaggaagttttgtttattgaatttatttatactaaaatgaatctgtagttctaatttgggaaaatgacttagctacttccttcagaaaaaatataattctaatctttagtgttcaatctgattttctgcccactcctcctaaaaagttttcaatcactttctgaaactagaaataattcaaaagaagagctaaaatattgcaaacttccttcacagtttatttttgcaggccgttctctgagtagagatgcacaggaaatgaatggttacagtaactgggatgtttgtggtaaaaatacaattttttaaacttagaccatttttccaggttttacgtctcccataactcaaatattgttttcttctgagaagaataaaaacacaggtgatctacaaaaaatagaccttcctcttgagtatacaattaacttttgtgtgcaaattttgtcctataaatcatagtgtgacccatcatgggaggaactccaaaaaaaccaaactgtaaacccataatttcttttatgttttctaaaggtcaaatgctgcaaatactggccagatgacacagagatatataaagacattaaagttaccctaatagaaacagaactactggcagaatatgtgataagaacatttgctgttgaaaaggtaagttttcatactgcttttaaaagctatggtcagacactagtggtaccatactagcctcattaacttacctaggatactttacacatgctcatatctcaatgcaggtaggctctatctgatggtttctcaagattgcatcttgctctctgattctataacagctcagttccatctttaaaacaaatcattctcatttcataagaatctatattttgcaagtaaaccaaaagttaatgtctatttgtttattttctttccctggttgatattgttctgcccgtctctctttctttgttcacagaacaaagtttgctaaattttgataaatgtccttccagtttggtaaatttccttcatggtgtatgtcgatatgcattttccagtagggagttagtatcagtgttgagacacaggtcctaactcctcctggaatctctcacttccttgtggctttcgaaacctctggtttaatgtggactgatggattttccaggtggaagtgacctacctggaaacctaagtgactgatctccatcagacatgggacactcttgcatgaaccagcgcattcattcatgctcactcccatactggttttccccttttgtagttgctggtgttgggtcggtgaatgttctgctttggttctgccctgcctcatcccatgtgcatggatggggcttcttctctgggatgcactgtagggcataacagggaatttccttattccccctctttctgctgacatagggaggggccggaggtgaagcaaactgcagtccatccagagaagtgtcacaggtaggctctggggaaagtggaggtgatgtggctgaggaacactctgccttccaaagatccacagacttttctatccagagttgattctccataaccgagccctgcacagctgccctggacttagggatcttggtgtgaatttgttagcttctactcatgtaatagtagcaggtcttcttggaagacctgggttataggcagattgctagggaattggattttggccttcctctccactctatattcttttttttttttttttttttttttttaagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtattttttttagtagagacggggtttcaccttgttagccaggatggtctcgatctcctgacctcatgatccacccgcctcggcctcccaaagtgctgggattacaggcgtgagccaccgcgcccggcctccactctatattctcactgcatctaaatgcgctttttagatgaacaagaccagttttaggaaatcaaggaaattgcaacatctgcttattggctaatttagtctgatgttttgaactacctttcctggtttgcagatccaaatttgtcatagaatcacaaagctggaaagactttattttaatctgtttctcatactatttagcattttttttcttagcctgtcttttttaataagcaggcagaaagcttggagacttcaaagaatgaggagttctggttgactcagttcttcaagttctgaacctcacactttgatgtcaattttttccttcttaggcagaattggaaaaaaaaaaaaacacatggaggatttttgtatggctgttggcaagagcactcatgaataaccgcattaaaacagcgataaaagaccctcaatatttttttctttaaaaaaaaatccaaaagccatcatttaaacatggagtttttttgaacaatagtcagctctctaataagctgaaaatgcacctctgtagctaaaggaagggtttgtttgtttctttcctctttttttttaacctcttattgtactcccctgaattcccagctgcacagaaatgtgtctgaaatatccagtcattttagtcactagacaaccagtgaagaggtggtggagggaagagaaggaataaggagcttgttaatgcatttggggaaatcaaaatgacacattagtgattttctaaccgggcaattggaatctttaaggaaaacaaatcattagtacttttgtagagcatttcttataggttttaaactttctcattagaaaggaaagaagagaacaggtaagcatgtactttgagatgcctgcaattctgattctattttgagagcatgttgcatcgagggacctaaaggtgaaagtggattagggctctgctctgcaaaacaagcagatgcaatgcactttggaactcatgaattcctgctttgcatctgattgttgtcttttatttcccacatagctgatgattccaagctaaacagattttaaataatacacagtacccagagtgtcagaaggaagacacccctgaagtctccatgcatttaggctgtctggtgaatctatccctgactattctgggagaaacaaagttgacaatggtcactgaattctcgctacccaggagctgcctaggattcagaaagggcatgagaagatgatcctcctgtctccaagacagaacatgtattatacaagacagaacatgactattcatttcacaagtatttcttaagcacccacttcaggccagggactattgtatgacttggatcaaaattaagtgactaactgggtgtggtggctcatgcctgttaatctcagcactttgggagactgaggctaaaggatcgcctgagcccgagagttcaagactgcagtgacccatgattgcgccattgcactgcagcctgggcaacagaatgagaccctgtctcggaaaaaaaaaaaaaaaattaagtgactctcacatttttgtatataacattaatgcttgttatgatgaaaaaccaggaagtaatagtatcaaattgggaggtatttgggctgtgataactgatgacatctatgatgttcttccccaaatgtattacattccaaaacagaaaaaaggagacactgctatgtcaatgaacaagaatgaaaactggatcagaagccgtttcctttgccactcttgtcaatagcaaacatattcaagggtggaggtttaattttgagaaatgttttctactttccagaaactgatatttaccttgctcagaaaaagagtcttagatcagttaagagctgtagttcagcacttgaggttgctggaactgaaatctaacaaagctagagagagaagcacaccccatgctcccactccccaaaaaccccacaccccaaaaacccaccaggacatggagaaagatatgccccttttttcccctttggaataaagtatttaccgtcaataagctttcccagttcatatatgggaatgcataccaccaaaatgggatcactcctatgtgggtcatcatgcagaaagctgggggagctttctaggggttttgagggtgacacagcctcagctgtatgttttctaagggagaccatggcactggcaaacattcccttggttttagggataaggaatttgggctcctaaccacctaatcatactactctgggatcacagagcctatttagcagacaacaatattgatttgcatttgtgaatccccgactgcttaattccttatagcttaaactctagtaaagaatggcattttcacagagaagtaaagcttcagcatttgtgggttattaaatgaagacatgttaacacatgggtgccaaggaagtcttatctcgaaatctgcagttgtttgcttttctggtctttcaaagcacataaaaattctgaatttcttctttgctcactaagtatgtgtgaacaatgattgatggtgaaagtgatgaggttaatgagtgtttacttttaagatacaataaaaccaaatgcagaaatggttcagaaaatgatcatggaatgagagaaggaagaaagtctaatttgatcctagatgtacatccagcgttgattccggttttgttttcaaaacagtcttttgctttaaaacacagtcttaatatataggcttatacttagaaaacaaaattgacaggtataaattaccttaattattctcaaaacaaaagtaaattaaaaccaagagcaaaccgtaaagtctctttctttctgccttcactacagttgagtggcaggcagctccccttcgatttactgacctagcctagaattccagcaaaaatatctttcgattcccatagtatgtattggcttacatgcctgtttgccacaagcagactgtgacagccactcaaaaacatatttctgtagccctagcacctcccataatgcctggggcagtgtagtcactcagattgctagcaattggatgaatgggtaaaatatttacccacattaaaaagagaaacctaacaaacagagctgtaaatgcaaatgagctctctgacctgtctagttggaaaggtgtcctcattcattcctactgcaagcatcatctgagcatgctcagtgagtgtgcaccactccagtccctgctgtgagaggtaccaggatgccggaaagccccaacacggagttggtattgagcacacagacatcctttaatttcttcaggcccctcttctgtgcctctttctctacagactctcacctcaccagccaccttgtgatctaagtgagacaaacctttaacatagtctactttttagaaaggaatttcaaacaacccaaccaattcatccatttgctggaattacacctaaaaattagcattttccccaaacatcatccccctttcatacccagacatcttcctaagggtacaatgccttccacattgtgtgtgagatctaaggatggcctctttccccagcagtccactgtttcctggccctagacttgctacctggggactgtttccactcccccagctatccctgcttatttgtggtttgttttcccttgttctcttccttgttctggctaaccaactactgcagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcaggtaagcagagctccagagcctcttgaaggaaacgcagtgggtgatgggtgcagggccacctttggggatgatgagtatgttttagaacttcagaggggtgatgattgcacaacattttgggagcactaaatgccactggagtgtaccttttaagaggtttaattttatattatgtaaatttcacctcgataaaaaatttaaaaagcagcagcagcagtgtggtccttcttcctccactgacagaccccccttttcattcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggtactcccgctcatcacctagcctggggccttggtccctgggctccctcctgcatctccccatttcagggccaagggcacaaggaatccaggcaattatctgttcaagtgatctacctggcattccctgttccttccctccctccctcccttccccctttttgtttttcctctcataaacaaaccaaacaaacccaggagttttccaggtaacagaatcaagagcccaaatttgcacacttttctgtattaagggacccaaaaaagtctctgttaagtgctcagactttcaataccatttccttttattatctcttttaaactagctggtaaccagagcaagaccgctcctgagaatagtggctgaagggttatctctgtgcactttgttcttctcccagggtcctgggaagaacagaagcctcctgaccctaaaaattctgcccagtgtctggcgtcctggggatttgcccattttgtgaagtactgtatactaactagtaactctgtaagtggaaattcaaggtatatcgggaatttccattttttcagaagcaatgttacatcctgctcttaggacattcgtatttttactcatatttgattgttttaagtaggcgtcacaccgaccacctggaaaatgattcatgaagtgaagtgaagaagaagtaagaatcccttacatttagatggtgcatttaagtttatgaaagcctctgggaaacctaatcccatttttttagctaacataaaaataacagaaactttaaatgctgctttcatgggttcttttccttagaaaggggatactgtgtttgaaagataataatcgtaataatttatcttttaatgtactttatagtcaatcaaatgttgccactcgcatttctcacttggatcttccattttcaggtgttgtttactggtagtgtgctgtttttgggaatcaatctgttggacaagaggttgttgaaaaaaaataattaaaggtcatatttatgtatagaaaaaaccgaattaactgtaataagaggctttttaaacttcccatataactaaagattaataataaatatgataagactctaccaatgaattttaagaaaagtcagtgccaaatcagaattagaggccccatatttacactgtgaactcattgaagatatatatgagaacagctctctgtacttctaagaggtttcataatcatattaacttttatgttctgaaataagaacttctaagtacttttatgttttgaattaagaacttccagacttcttgtcttcacagtaatgccaagtttttctggaccttctttgcactattattttgaccagcaaatcctaccatagacaaaattctgctcattcctcatgtgaaatactgagttccaagtgagtaggatcagaatgacagaggtcttcagccacagttttcatggtgctgcagtgcgtgtggtggtttgtattgggtccgattggttttaatcaatctgtgtaatatttggcattgcaccccagtctcctagcacttgagcccttggaccgtgtttctctctggaggaactgtctccactctcttgatgatgtggggctaaaattgataccgtctttcctccttctctggttctctaaagttagtaactcgttccatctccttctccaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccgggtaagtgatgcctaagggaggggcactgcacggtgacttgctcctcaagaaggatttcaaggtcagcacctgagtgagcccttgaatcacaaggttccttggcctccatagcactgttcgtattcagggctgggtaacccagagctctacccaggagacgtctatggtatcaccaccacacaaaaatgtgtgtagacattgccaggtgtccccctgggggacagaaatacctggttgagaaccactggtctaacaaccatttccactccttccctctgaaggcagacatggactagtccccaacaccatggctccttgtccacagcataaccatggcacagttacaccatggaagtgtgtgttcagactttccaaccaagagctctccattgtattcctcacatatgcattttgtccagatgtacccgagtcaaggccagactcttcccccacctctgacctcccaaatccccaggtgcctcactccactgggacttgagggctcttaattctagggacccacagtggcccttacgcctctgcctctggcccctgtgtctgatgggcactgtcagtggacgaaatccaaggagcaaaagaaagaaaactcgaactatggtgggttggggagggagggggaagggaccgtcttgcagtcagccacaggaagtttgcatctttcgaaaactgcacgtgagaggagtccgctgccaaggcttcttgtcctcatgttcctttcttttctcacgcagacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacgtgagtgccccgcttcccgcacgggtccgaggctggggtgtttggggagactgcagaacaggcttgggtcttccccattctgctcaccagcccttttgttttttaagacacaaacttttttttccaacaaaaaatagatttcagattccacgtatgtttttgtgtcggggctgatatccttcgtttctcaaagaccaccaggccaggagtatccgtaaatgcagcatggcacagttgccctctgagagctgagacttttaacctgctggctggggaacaggggacaccatggcaggaaaatgggttaatagatttgcagcattattttagttcattttcctgtaatttagcctgcagttaacataggggaaagttcaactcattacttcctgccagtctgttttcttattgctattccgttgatgcaaagagtgaatgggtatgttctgtgctaacacggaaattttaattctgttggtgtcatatcataaaaggtacctgaacttttttgaagctcttcagagctgtaaaaaaaaagtacatgtattctttacggcagaaataagaacactgtcacacatacaaattgctagcaaacaagttttagaaaaagcagaacttttaattatgtgtaattttaaaagtaaagttaaattttctccatcaagataattatgtatagattcgatattgcctctctaccagaaatattttaaaaattgataagagatactaattaagttttcttggtatcaaagtaagacttttatcactattattctgcagagaagtttatatttagtctatgttggtgctgacaatggtgacagaattcaacagctgttaaacatgttcagtgttttgtgccacaagcttccttctgcatgaaataacctagcttcttctcttcccattttcctgagtatatttggagcattcttgtttgtgtttgcagagctataaacagccttcagcttttatagtcacccagcatcctttgccaaacacagtgaaagacttttggagactggtcctggattatcactgcacatccgtagttatgctaaatgatgtggatcctgcccaggtgagacccggacttcttacagtcagaactagtgccagggggtcaagtttgtttttacactgagtttgtttgcacccgagaagtgcaggccctagtgccagatctcaagtgccagttgaagttgagaactggggatgctgaacacaacggttaaaaatcaggcggaattaggggttagaaagtcagttgaaaccagaaatacaggctgaaatcatagatggttgaggtgacagggcaagacacggccagaagttgagctgttcctaaaagatggaaatactcactggaggttgacaaggtcgcagaccgagttggagctcagcaggaacctgaacatcgcagagccaaagcagaatgagcaaaccagaggacagtggagaagggaagatagcgtttgacccagcccagatcccattcctggagtgactgtgtgcttcctggcacagctcaccgggagcctacaggtagagatcgtcatgcagggcaggtagagattgtcatgcagggtgacagtgtcggggtgacagcagagacaggcaagcaattttaaggcacagcaattagttttctcaatgctttagtaaagatattaaaaagaaataatactgggacttggagataagagaagtttggaatgataaatggggcttttgcatagttactcttaaacattaaagagaaagaattggacagtgatgactcaatgttagtaatggagttagacacattttcttgaagcaggttgtcaggcaagcattagcacagtggtcctttaggagatgaatttattgctttgggatgtgcctataccaatcatagacaaccaccatgacagtaggcattatgggaagtttgaccttagcgtgttttaagaaaaaacttgttctggaaatgaattaatttcctgtccagtagacacaaattctttttcttaaaaaaaaaaaaaaaaaaagtctgaagcatttcggcatcccaactggacatgatggcaagatttttccttcctacaatctgttttcttgccatcatccagccataaatggcatggacattcaattcagttctataaggtttttaattatgtctgaggcactgcattatattgtcaaagctcttgcctgaaagctggttaatgaaatagtaatgataatctttgttcttatccagtccttttggcttaagaagcttaaatattttaaaactcttccccactgatgctctgagaaggttagcttacagtcatttataaagacaagcagacaccacggcttgtgaagcttcaaagacccaactcaaaatagaaccaagggtcctgattttctcacttacagtggcacggccgaaatttcactaattctagagtcttaagttgcagacacttatagaataagggacttcttccttatttagaatcatgatggtttttttcttaatgtgaatcctgaaatgtggagatatttttgttcatattagtgaacaagacatcagtgattctagtgcattctttttgaaaaactgcattggaattctaaagccgcattctaaacccgaactatctggactcaaaccaagccttggctggctcatgggtaggagagacaaaaagactccagttctattcagcagacagagctgattttcagagtgagagaaaagaggctcctgggattcagtcttttagcgaacactaaactgagcatttgaatgtaaaggctttgcaattctacaagaatagcactcaactattttaagtatttataggtccggttcacggacgtgttatgcaccatttaagccattttctacatggtttacttgggcagagcatagaatgcaatgtgccaagaggcaagtgcaacccacgtcactcatatttctttggtgtaagtggcaagcttttggtcaggagcttgaactgagaaagcaagcagaaagcagagtaagctcaggcagtagaaaaatgggcagaacggttcagatgtacatgttacagcttttattaacatctcggcttcccatcataatgcctattaatttcaacagtgggtacactttgggcatcaaaaagaacataaacatcacatgctattatttgacaaggcagttttataacttgtcaccaggaagtgctggtgaggaaggaaatatttcacggaagcattatttaaaaataaataaatgtaatttttaaaatactgtcagcatagctaacataaaaggcacccttggttaccctactttcattcttacttataaaatcccaaccttaactgttctgtgatggagagagagatactgctgttttgattggcccactgctaactgaaaactatcctgcaatcttgggtataaatcaaccttagcaacctttgacaatgagattttagatcctttggaaaacagaagtcatctagaaattcagccagtggatcctcctttcctgacacatcattctgcataaaattaggtgattgtcttcctctgctcttggcccaggatagaaacaggttgtataataaagtagttctccccttgcctttccataggccacctgtccctcagctaaatcagaaagataaaagttagatgcggccaggcgcagtggctcacaccagtaatcccagcactttgggaggccgaggcgggtggatcatgaggtcaagagatcgagaccatcctggccaacatggtgaaaccccctctccactaaaaatacaaaaattagccgggcgtggtggcgcatgcctgtagtccctactactcaggaggccaaggcaaaagaatcgcttgaacccggggggcggagtttgtggtgagccgagatcacaccactgcactccaacctggcgacagaacgagcttctgcctcaaaaaaaaaaaaaaaaaaaaaaaaaaaaaaaaaaggtagatgctactcaaaaaaaagttataggaataagaagtcccaaaggaagagtaatttcaaactttaaatgcctgttaaggtttcggggctttgagaagggtttttgaagaaaaaaatcttagcagttcttccttcctgactatttccaagggtaggaattttgtggggtgctggctaataagcaccttcataagccaccatgcccagcaccactcctactgccctgagttgtgcatttacattcatgcaaatgttttagttactcagtatcaacaatacctagagtttgaggctgtaggaaattgcttttttaattaggccacttccaggcagaacagcaaagcatttattcttattacagcagatttgctagatctgagctgcaagggtttggactggaacataaaaatgcaacccaacaatgttatcagttccaaaccttgtcacaaaatagccttattcccaatagtggttataaatccacatgcaatcccagccagcagagcgtggagatctgggcattaagagttgtatagccatcttgagtaccttacatcctggggtggcacctagtgcctctccccggggcctgatgagagttcccttcaccatgcaaaaggggacatggcgactgccatccacatgacctcgttggaaagcagaattactcatggcttaaaaggtgctttctgagaaaatgaaggaaaaagtcccaggaaaaggacaggtggagttgaggaatcagccagcaaggaagtccaaaagcctacattgctgggaggaaaagagaaagaaaagaaaacaaagggagtcagtgaaatcttcagaattcctgaatgatgtctccaaacacagcatcccacatccgtaatcccagcaatttgggaggctgaggcaggaggatcactggagaagagggcttcaagaccagcctgggcaacatagcgagatccctgtgtctccaaaaatacaaaaattagccaggcatggtagcacacacctgtggccccagctacttgagaggtttaggtgcaagggttgcttgagcccaggagctcaaggctgcagtgagccatgatcgcaccactgcactctagctggggagacagagcaagaccctatctcttaaaaaaaaaggattactgagtgtcaatactaaccttatccaaactgttaggagtaaatttcctcttataactaaccttgtgtttatatgttttgaattcagttgtgtccacagtactggccagaaaacggagtacacagacacggccccatccaggtggaatttgtctctgctgacctggaagaggacatcatcagcaggatattccgcatttacaatgccgccagagtaagagacgggcctgtcatgcctgtgattatggtttcatttattttctcactcactgaatacttggagcactcactctatgtcagtcactgttccaggagtttggagtatgtcagtgaaccaaaaaaacatagattcctgaccttatggagcttacattctaataggagcagtatttagaaagtaatgatacttattaaagcacggcaaggcagattttattcaagaccatcacgataggtgcagggacccctgtcacaggaccttgcagtgggtgagagagagtgggctcaactccgagtgtggcatgggcaggcaggaatttatagccagcaggcagggtgggggtcagtggatggaaaattactaaggggaggcatgaagagtaaggggggttctggctaaactgacttaacaggattctggctgaaggcaggccaggtgaccagacatccgaggaacctgatcagatatcaaacatggtcaggtattaagggtgggtggttcttgcccacggtgacttaacagaaattgctaaaactggattttacaaggaagttcatggataggcctaggagaatattcaggagcctgacgaaagtttggtcaagcaaagaattattgtcagaaatcagacaataaataacagatacaataatagatgtagtaagttaggaagtgacaaattctacaggaaaagaagtactggggttagaaagtgctagggccttacagtggggagcaagctctgttgtaagcatgtgtgccctgtgagccaagacggaggagtccagggagcaccgaggctctctggggaggcagctttccaggcagaaggaagggtcagtgcagaggccccaaggcagggccttgcatgtgagtgccaggacagcaaggaggcggcatggcccaggctcagtgagcagaggcaagagtagctgatggggagtgagcagttcacctggaaggacagtggcttgggggccccggctggaagggcctggcagtcactgtcagcatttggacttttgctttgaaggaaataaggagccattacagagttttgagtgcaaaaatccaatggtgtaatttacattttaaaaggagcactctggcacctgtgttgagaatagactggaggagagaggcatcaggaggctgttgggataataatccccgtgagaaatgacagtgataggagaggagatcatggtgagacgggagagagcaggagtggaggtcatgagaagggggaggttctgatattttctgaaggaagagccagcacaatcctggggaatggagtgggctctcacggttcctgtcctgagagctaggatgatggaatggacactgactgagttgttgtccaggctgcccgtgtaaccggattgtttgtgggtggggggcattgtggagagaggatcagaagctcaattgtagacatactaggtttgggatgacttttaggcccctaagtgggaatatcaggtgggcctttgaaaatataagggtgaaattcaagagagagggctgaaccagatatatgagtttatgacttattgggatattggtaatatctaaagccgtgagcctgaatgaaatcaaatgagaggcagaggaagaggaagggccccagggattgagcctgggggcttctgtcagcaagaggtctgggagaaggggagactgaggcagagagagagggagggactgctgtgggagaaggaccagccagtgaggaaagcgtgttgacaagaagagagtgtcacccatgtcagatgctgctgaaggccacagaagatacagtccaagtgatttagccgtggccagattaaagctgttttcatgtttctatcataagctaagtaacacttttttgaattctgcaattctatttcactatgactaaggattaattaactattgctatcttagcaagattcaacatcaataagcaaaaccatattatgctcacaggaagcagtgttctctatcttcacactgagctcagagacatttccaggttataaattattcattacctgtaatttacctgtaattgaagttattttaccacttaacatgacaatgtggtcagtgcttatgctgtgttatttttctcttggcttttgcagaatgggaagcattctgcctcactggcctgtcatttgtctggcctgtcatttaaaacccctggttgtttttaactgctcgagattaaaaaccataactcttcaggccagcagaagccacgttggtaatttgtaggcaggactcgcctttaataatgggaagatcaagtaagtggaatcagcccactggaattcagtaaataatgcctgttttctttccactccccgattgttgccttgttcttcgtagccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgtaagtgcttgacagagctcttcatttcagaacagcgaggccccacactcactctcacctcctagttctctgacttttgtttcactagaaatggagaagaaataagtaggtctaggtgaaggggtgatcatgacactcagtgagggattggttggcttttcaggaaacaggatatgcacattctgcatttggatggtgtgccgctgccgcacaagcaagcactgaccgtttcattaggacccctgcctccgccgcccactgccaagaggaaaaaaaaaaaaacactggctcttgagagccaattgttaagttttcaggaattttctgagctgggtcttcaactgttggtaacttgaattcatccatggtagaaggatttacatcatggaaatcaacaaatgctacaactcagggctccttcccaccagccaaaggccagtttaccaccacattacttgattattcaattggaaatcatgtcaggtctcaaaggacctggagtgtgtgtgtgtgcgtgtgtgcgtgtgtgtgcgcgcgcgtgcatgctttttgggagaatgtgtatattgggagcatttggttacagccagtgtccccagaatgaggcttccaggccagcaggttttgcaggtgctaaatatgggcacccctgctacacatagcccgcagccttacctgcacattgagaattatttggggagctttacatgaaaaaaaaaaaaagcccacacctaggccacaccccaaccaattaaatcaaaatctctgggagtggggcccagacatgggtgttttttttaaatgcctaggtgatttcaatgtgttgagataataaggttgagagccactgaatggagaatgccatgtttctcaaagcactttcacctgcattttctcattggcagtgatatgtagctaatcaaccagctgcaatcggcttaatagaacaggcaattagaaagtcacggcagataaggaagatgtttagagaatttggggaaatttaaaggataagcgaatgtcacttttcagtgaagtatcattagaagtacacaatgagatctctcttaaattgaaggcaaaataaagtttcactccgggtagatcaagcctagttaaagttgcagacctggctcagggcgtgggttactctccagtcagtgcccttgtctgatgcaatgccacctcctaccccgggcctgcaaagtctccctggaagcccaggactctgcctgcctctcaacgatcaaaacacgatagtgtctcatcctgcaggaaactgatattcctttggaaggagccttaagaacctacccacagttgtcttcaaccagaagttccaatcttttgtcctctaaaaagcagtttattaacctcacctttctctagttgctgtcatcccccctttcttctcatggacccagtgcattaaaaaatctctgttggccaggcgcagtggctcacgcctgtaatcccagcactttgggagaccaaggcaggtggatcacgaggtcaggagatcaagaccctcctggctaacacgttgaaaccccgtctctactaaaaacacaaaaaattagccaggcatggtggtgggcacctgtagtcccagctactcgggagactgaggcaggagaatggcgtgaacccgggaggcggagcttgcagtgagccgagatggcgccactgcactccagcctgggggacagagcgagactccatctcaaagaaaagaaaaaaaaaatctctatcaagaaaatgacaaaaagaattcattagcagtccacatccctatttttatttctcttcaatccagatccaacctctgatcagaacaagaggctcacgctgagatgatacaatcccagcaaagaatattaacattgtagttcgtttgtattagatatatcagatttttctaaaatactaaaaataggttgcagttacccctgcctgcatctggagacccccagcgtctggagctagatgtataatgcatcgctccccccgggattagcagctttctaaaaagggtcagtgctttaacccacaggactaagttactagtgactcgaagaagttgaggcaccaggacaggcctaacaagaagacataaagacttcttaaatcactgcaccttgtcaacaacacacttcccagaggcagctgtgaccacagaactaaccagtgacattgctgttccatgtaaaacctaaagcaatcagccgttcttcacagtggacggtgggaggcatccgttgtttcttctctcctgcctgtgcagcatctcttcccattttccactgagagaaccttgattattctttggaatactcccccctccctaaagccccgcctctgttcatgtggggctgtctcttgctctcttagcatcaaggtgggcatgagacctaggcctggtgagaatgtttatttttgtttacatttatatatctaaatctaaggctttttttagctataagaaacaaagttagtttacattggcatcccccagtactggccaggaaagaatcaaaccactccagtcttcctcttggaggtaagagcatggcattcagcatagtgtagcgccacctaacggctgtgggtggagagttcccggctgagacaagacctgccggtgctttgaagtgaatggttccttgagccacagatattcaaggtaggcaaatagagagtgtttttctttatatgtgtctcccagctaataaagctagattaaatggatagaattaagatttcaccactttgcaactcttgatgaaaataatagattagacagtggtcttcaacagctgccgaaagtattaggtgcaaagctgataggaaaagcggtgtaatggtaaggcaaggatagaaaacagctaatcttctaattagcagaagagacagtccagggacagatccgtacctcagcgtcatctgacttacaacaaagatgccattgcaacgcagcactgcagtgggtggggaagactgcctggacacgttggtctccctcactccatgtacagaatcccttctagatagatggtagaccaaaaggggaaagtaaaataacaaagcttctagaagaaaacataggagaatatcttcacgaccgcgggtagatttgttaaacaggacacagaacaatagccttaaaagaaatattgacaacgtggactttcattaaaattgagcccttctcttcatcaaaagatggcaataagagggtgaagaagcaaggcagtgggaggagacttttataatacatgtgtctgacaaaggactcggccacaatgtcgaagaactgctgtactgcaagccagtaggaaaatgatagacaactcaatttattaaatgggcaaaaaacttgacaggtacttcactgaagacaaaagatgtcccagcccagcgcagtggctcacgcctataatcccagcactttgggaggctgaggcgggtggatcacgagatcaggagatcgagaccatcctggctaacacggtgaaaccccgtctctactgaaactacaaaaaattagccgggcgcagtggcaggtgcctgtagtcccagctacttgggaggctgaggcaggaaaatgacgtgaacccgggaggcggagcttgcagtgagtcaagatcgtgccactgcactctagcctgggcgacagagcaagactctgtctcaaaaagaaaataataataataataataataataataataataaagatgtcccgaatagccaatgagcatagaaaagttactcaatattattcatttttaggcaaatccacattgaaaccaggatcacatgccactgtgtactcaccagaatggctgaaattttaaagacagacaaataaatgataatcccaagtgttagtgaagctgtggagtaactggaactcttatacactgtaggaaggaagtaaatactgtacaaccatttggaaactgacagcatttaccaaagctaaacatatacgcagtctgaggctgagctcttctgttcttagagaaatgactgcagaaatgaatcatctaccaaaagataagcttatcacaggtttactcataatatttaaaaactggaaacagcccaaacattcatcagctgttggataaattgtacagtgggtattcattcagtggaattcttcttagcaatataaaacaataaactaccaatataacaccgtgggtgattctcacacagacaacacagagtgaaataagccagtctcagaagaagacatagtgtatggttcatttacacaaagctgaaaaacaggcaaaaacaattgatgatgctaggcttaagaatggattctctttggtgatactgatggtattgttgaggaaggaacgtgagggagcctcttggggactgaacgtggtttgtatcttgatctgaatggtggttacatggtgtatgcattggtaaaaattgactgagctgtctacttacggtctttattgtaggtatattatactttagttaaaaaactgattcagaatttcataatgggctgatcaagctgatatccgaacacgatgatctctcttaaaaccataaaacaagggacaaccagatatttttggcttgcttcctaatgaaagtatactttaagtatccttgtataaataaatcaatcttgaattcttaccaagccctggaactacctaccgatttacaggaaatacagagttagaaagcagcatattaaataatatcacagagatgtgatgaatgagaaaaatctaggatgtgggactctctacaggacacagatgaacttgtttcctcaacaaataaattctcaagaaaaaagagagagcaaagaggaactcacagagtaaaataaatttgcaagacataccaaccaaatccaatctgtggactttgcctagatgtggattttttaaaaagcatctgtaagaaacaatctgagagtggattttttaaaaaagcagctgtaagaaacaatctgggaaactggaacactgactagaaatttgataattttaaaacagtaatgttattattttaggtatgatagttatactgtgtactgtgtttaaaaataaaaaggtcccatggccgggcgcggtggctcacacctgtaatcccagcactttgggaggccggggcgggcagatcactaggtcaggagattgagactatcctggctaacacggtgaaaccccatctctactaaaaaaatacaaaaaaattagccgggcatggtggcaggtgcctgtagtcccagctactcgggaggctgaggcaggagaatggcgtgaacccaggaggcagagcttgcagtgagccaagatcgcgccactgcactccagcctgggtgacagagtgagactccatctcaaaaaaaaaaaaggtcccttatctccttgaggagagagtgactgcagagttgatgcagggatagtgcgggatgagcctggaccattatgtggttgcagagagtaaagaaataaaacaggctggggacttgtcagaaaagaacaaaagagccagcctgacggagctcccactggccaaagctggaacaatgtgaacaaaatcaatattagtacccttggattttagctgatagaataaaattattatgtataagctcacactgaaataaacaaatcataaaataaataaacaataatagggaagaagagacagctctttcttagtgtagaatgttgaaagagagggaaacaggaaatcaccattaggcaaacaccacagtgataattaattgttgcagacaagatccaccaacggatgctcaaatcagtgggcgagaaacaaaatatttgcgtagtcccaaaatatcttcctcccagatatttattgactgcaaagagaaagatgataactttatggtgagaaaatctggcagacaccatcttaacaagtgagcaagttaacatcaccagtaataagacagatggacatcctgaacccctgggaggagggaacatcccctctctggttttcttaccgaaatgcacggccttgtttccagtcatgagaagacatcagacaaacccaaatgaagggatggtctacatgttatagtttgtgatgacttctcagattgcggctggggacgacagctactttctacttctgtgttctacattctttatattctacaaatcactgatcagtgctcttcaaaagtgtcaaggtcaggaaatacaaggaaagactgaaggaaactaaggagacaggacaactacatgcacgactggatcctggaccagaaaaaggacattcgtggaggaactagtaagatgtgactacagtctgtggtttagttaatagtattgtcccagcatcacgttcttggtttgcataatgcgctgtgggcaagtaaggtgttcatatcagggaagttggatatgcattctctatgctatttttacatttctgcacatctaacatgggttcatagtaaaaagttttctttaaaaagagcctctatgttttatagataaataatgaaatgccaatggatttgttgttgttgttgttgttgttgtttgagagggagtctcgctctgttgcccaggctggagtgcagtagcacaatctcggctcactgcaagctccacctcccgggttcacgccattctcctgcctcagcctcccgagtagctgggactacaagcacccgccaccacgcccggctaattttttttgtattttttagtagcgatggggtttcaccgtgtttagccaggaaggtctcgatctcctgacctcgtgatccacccaccttggcctcccaaagtgctgggattacaggtgtgagtcactgcgcccagctgctaatggatgtttttaaaggccagatacgtctttgaacgtaacccgtacttgtcacagcaattttcctggcagaacctaaataaggttcattgaaaattttctaccatgggcccttatcgatgaattgctgtatcagagaatgtgaccagggctgaggtgagctgggaaaggctctgcagtcaggtgacctgtggccaaacactgcggatggcttgctctgtttgctttaattaaaagaatctgcccaggtaagaggtcccccggcctcagagccctttgttgttactgttccccagggtttagacagcttgtttccacaggtgtttgcaagatgcagtgtaaagacagaccgagtgcagtcatctgatctttttcacgacaggaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggtaggacaccccctctgagctgttccatgagacaccccattagcattagaatccactccagctcccagatttgcagggaaactgatgcgtagaggaagagactcattttcaaaatcacaatgtaatcactttgcttgtagggcttttttcttctttcttgttctccctcttcctctctttgttcttcacacggagactttgtctccagctcattcgaaatgcggaaatagctgaaactcacaagtgaacatccttattaacttcccttcctggcagtgccttccatgtggctaagcacttagtcttcacagagaagaaataatcatagtacgtgaaatgccagattttcaaattatatattttataaatagcttaatcgcctaatatttatcaaagctgtgaattttagtttgacatccagaatattgcatttaattatggtggccatatctgagaaaagtattaaaggagatgagaaacaaaggacaatgtacaattattttcttaagagtattttatgaaatctctttttatgtggagctgttgaaatgccaaccaccgtgactctagaatagtttaaaggaggaagcttttagattaggtttttgcacttctctgtgagtggaggaaggatctgtaggaaacagcaggactaatccaaggttggaaaatggcttgggggcaggagagggaggaagagatggccgatgggacaagcgccaaagccaatgttcccaggtccacagcatcacaacactggggttgatgttaaaaattaaaataaagggacttaagagggagttgagagtcaagctgaatttgaggaagtagccatggtcctcatgcagtttaagaagtcataatagcagtgctccaggctggctaatagtagtgaccaatgacaacgagctcccaaacgtgtcccactcatcacgaaccactctccagggcatccactttgcccagatacatgtctcgtgcctgatgagctgctccatttccaagaagcatggctgttggtcagaaaatttgtcacacccacttggttaggcacactctcacccatcagctgttagcatgttggcttctagaaggggcagaaaggactgtgctccccagactcctgcgcccctcctccccaccctacggggagcccatggaaacccaaattctagtctcaactctactactaattctagttaggtgaccccaaacacattagttttgtcatttaagtgtccttaagcatgtcacttaactcccttaggttttagttttgtaaactagggataccatgagctcactgaggtacccagtgtgcagagagatgtgaaagtgttttggaaattgcaaaggggagaggtggttgtagagagtgtaggagtctgccaggcgtgatgccatcagtggcctggcagaagggctctaagtgccctggatgtagtaacggatttcctgtgggttgttgaaaggctggtgtggggcttcactaggaccgtctccctccctgcaatcccacctgaatggtaaagagttctaccgccatggaattcccagtgttccaggatggaggcaattgagcaaagagtggccatgctgtcggcagaggcctgagtttgggctagcagaggatagaaacaaatgcacaaatgaaatattctgcctgtggctttgtgaggtggttaacctcactaattcagggacaggtatgtagcctcgagactctggttggtacttgggcacagctgaccttgatcaaaaaaaatgtcacttccctctcactgcagcctgaattaagcacatcattagaaacagacccttccaggcctttcctctaatggctccagctgcagctttcatcactcaccaggttttatgggcaggagtgatggggctttttccaaatcagtggtgcacgctgaaggacaggggtgatttttcgtgaaataaatggaggcttagatggccgaaccagaagggagcttgcggtcccagcccacgattctatcgtaacttaggactttttgtattatgtgtgatcctgagggagaagatgggatttctgggtgcccagacctccaaagtcagcagcaggtggaggataaggtcagggtctgagaaatgtaggaaagttttgcaatgtctggagaaaactatgtgacatatctgtcacggggctgttagcagggtattagataatatctggtgacaaagaaaatctcaccatcctcttttcagtgggtttgaagcttccagaactgaataggacctgttgtcatttggttttgcctgtaaatacgacttctgtttagtttggtgttgatacctctgtatgttgtctgagagaattaattagcttaggccagggtgataaagtctggtacagttttattgggcatcacaggccatctgaggcctgagtgtgtcctaagcacagaatgttgtgccagcagctgaaaagagcagtgtactgagtctacttagccgcgtcttcagaggatgacgagcatgtgccagacagccctgggggcacttccgagtgtctgcagaggcaggctagggtgcaatagaggggccctcgccccagccccaccagatcacatgtgtggctgcattccctcatggtcccttccgttcagaacaggcaaatgctaccgctctaccctccctgccagggcgggtgagcacacagagggacgctgtgtctctcaccatctccctttgcagctctgattgttctaaattgcttctgagtgggaagattcgtcggttcgtgttgaagcatgacactctccagggagatccagaaagccctcaagatgtatttctgcaaatttttagctttgggagctctggagaaaagccagtggattgccaggaggcaaaatagtttctaatacaagactagatttttttgtatccagcaggggcagctgcatttttcctgacccctttttcagcccgcttctaagttatccatctcttcaaccagcctcaagtccccatcaaagaactgggtccccagaggatggacaaggacagcacagcctgagattccccacgactcgcctagttatattcagaaggagtgctggcacctgagctcctttgaagagactccggctgcaggaaagcggctgcttcacgctggcagctcccctctcacttttgccttccttaatggcttttgaagttcccagggctctgttttaacatagaaatggtcttcaagggcagatcttgcctagagaaacatagtgtcccctgtgaggtggtgggaactttggaagactcccctccacagcctagtgcactgcccaggaagtgaacaactggccccatcatttacccaaatgccttgggcagggctgacaaagctgcctctgcaggtaattacacactttaatatggagtgcagtggcgtgatcatagctcactgcagcctcaaacccctgggctcaagccatcctcccacctcagcctctcaagtagctggaactaaaggggcatgcaaccatgcctggctggttttttatttttatttttatttttttagagatgggagtcttgcagttttgcccaggctggtttcaaactcctggcctcaagcagtcctcctgcctcagcctctcaaaatgctgggattacaggcatgagccacagtgcctggcctggcatcttatcttagtttcatgccattctgcacatatttctcagcctctgttctatgtgcagcatcactgggcattgatgcaagagaagtagaagatacagtctctcccacatggagcttagaactcactggagatgcaaaagtcctacctgaacctcagttttctcatctgtaaagtgggagtaagaatattaagcctggccaaacacggtggctcacgcctgtaatcccagcacttagggaggccgaggtgggcagatcacctgaggtcaggagtttgagaccagcctggccaaccaacatggtgaaaccccttctttactaaaaatataaaaattagccgggcgtggtggcaggcacctgtaatcccagctacttgggaggctgaggcagaagaatcacttgaactcaggaggcagaggttgcagtgagctgagatcgcaccactgcactctagcctaggtaacagagtgagactccttctcaaaaaaaaaaaaaaaaactattaattcagtcacaaaaggccacatattctatgactccttgtctgtgaaatgttcaaaacagacaaatccatgagacagaaagtagagtagtggctgctgagggctgggggagggagatgggggtgactgctgataggcacagggtttctttctgaggtgatgggaatgttttaaacttagattgtatataagtctgtaaatatactgaaaaccactgaactgtgttaaagtacaaaattacaacacatttaatttgaaggtctaattggcttgtattagtgaccctagaatcaggcaacatgtcattctgtaaaatagaacgagtgctccaaggagctgagcagaggaggctgctttataggcagaaaaaagcttgagaaggcagagacagggaacacaacgcagatcggttgtttcaaacttccttccatcatacggttaaaacagaagggacttctttatcatggcagctcaggaaaaccgggtcgcttctgactggttgttgcacttctcctgatgtttggaaagctgccctatttcaaagttcagttggatggcgacgtagcacctagcacgagggactccattctggtttggtctagtctgtcagggcctcatccaaacagtggcctctcatgaactttatgtaacaactgtatcctttaaagaggccaattttatggtatgtgaattatatctcaacaaagctgttgttttttacaaagtaacatcaaaaacaacaaaaaagaatactgttcatagaaggctacggggcttttctgtttatggaacatgtcccaagagttatcttgttatactcagtcaccttcaccaaagccagaagaggtgctgccgctgcaccccctttacagagaagtctagcgtttcgtcattcgtgcaagccaaatccagatccggatccctcctcccagctccaagcctgctgatgttcaaccaccctacaaggagccccccaagctttctcccagcctagaggctggacaccagcggggctctcagggttcatgatgtgtggaaaaggtaagggaaaaaaatcgacaactaaaagccattagacgaaaattccaaatagaatgtagccggataagcagtcccaacccacctgggagtctgaaagggagggccctgtaggaaggtgatggtcataacccttcgctgggttgatttgttactgagttgctgggagaaatccaggataaagggtggtaaagcagtgcatgctcttgcaccgggagaaaaagggcacaggttagtgtaggggacctgagaacagggcagagctcaatcactgtgtgtgtgagcttcatctcagaccaggtgtaacaggaacagccccgtccaccatcacgtgccttgtaagattcagaaaagagcatctcctcagtggttctcaagcctggttgcccactgaagtcatctgggagctttagaacaattctgatccctgggcccacctggagactgattcgattggtcaggggcctggctgcagcagccgagtgttaaaagcccctggtgagtctcatgtgcagcctagcttaagaaccatgtctgctctagacgcagtatcagcccaggctgcacttgagaatccgcccacccccaactcccgggggagctttcagaaataccagtgcacaggcctgccccagcccacttcagccagaggctctgagatggagcccccgccaggtaggatagacgtgccacacggctgagaaagttggtgtaggaggatcagcgggcctctcccttccctgcagtgccatgcggcggtgttcacagctcgccgccccctccccctccgtcccacttactccagagccaggccccatcctgatctgcggatctgccgcacaggttcaggttgccccctctgtaacttacagccgaccctccagactcagcctcacctcccctttagtaagccaacaatggactcacatacaaaatgcaatgtggtgtggggcctacagctctcccccttgtgccaccaactggtgtgtataggctgtccctcaatagctcttgctgtgaaatttgcagcctatttaacggctgtgcatgtgtgtgtgcatgtgttggggtggtgagtgcaggagttgggtgggaatcagaggtgagctagggtccccaatccacactccaggcaccttgaatccacccatggtcagtcttcctgcactgttgaggaaggtttgtaataatttttgctaataccccatcccctctccccacccccagattccacttgcccatcctgccccctacactcagcaccagccaagcgcctggctcccaggagtttcccagtaagcattttctgagtgactgaaccattcttctctgcagccagacctgagtccaacctgagccaccctttgctgccctctccaacctaggggaggttgtggctgtgctcagcagggcctcaataaggaactgggcatggattttgcagggggctttggtgaagaaagttctacctataggtattaaagatagagattaagggaatgagccactcatcattccagggacatgctgctgtctcgctgagcagggatgagaatttattggtctccttggcacagagtggctggccacaacctggctgggaacactgaactgagggatcccaccacggtaatagggcccacgctgcccttctggcagggcatcactcagaagaatttttccagcccgaaggatctgtccgttcagggtctagccaaaatcatagagcttgccttagtttcaaaagcaaccaggtcagaggtggaggctattctctttgaacctttggaggccgttgatgtggtgtttgaagtgcccacgctggccgccagcctgagttccttagacacaggcagcctgcgcagacgacaaggctcgggcccctgacggaggcccccagtgccgcccgctggtgtgctggcctcgtgacgccctcaccaagctagcagtggcttttaacagccaacctcaatttccagttcccttgcacattttgctttctcccactcataggtacaggaagtctgatcgggagcggggccagcgtcagggaccttggtgaggaatagcagcaggttgccctggttacggtctgacccaaggatgtgaggaggaccgggccaggctcccacctgagcccctactcagggcacctcctcatgcccgaagccagctaatgtcacccaaattggagcactcaggaccaaggcctaaacattcctttttcccctggagcacagggatggctcatgtggcttaattatactgttcaaaagggagtgagctgagagaggaaactgcagcagatagacctatacctggtaatcaaatgtaatcagtttccaatgtaggaagatttcaggcatttacccaggtgcttgggggaggggacacaacaatttgtggtcttccttctctttccccttatttttctgattcagaaaccagtcatcacagaatctatggggactgggtgcttgctcaggaaggataaggtgggagagggagaattcattttgaaaattatagtcatgcctgagacagggcagcttcggtgacttccaagcagcagctccttagcagcgaagcccaaaatccctcctgagtttccggcctgtgttgtggcctgagggcagcagccacatctctccactaggtgcattttaacatgttaaaaggaaatatgttaaaaggatggctctgagtagccactgaaattaattgcacaattaggcttgtataaaatcttttttatgcagtaagggatgggaccgtgtagatttccattacagaaagaattgtccctgtgattcacaaaagcatgatgggagcacttcacagccaagatgtcggcctggtgatctgacaacgtggccttttggaattttgaaattccaattatctcttttaaatattctgaaaataaaagtatcaaatcctgaaataataaatactagaatatgaatcagaaatctaattttgcccagggcaagaaataattttttccagttaaaaagttaaaaaaatacttctacctttattggcattgtgtgtggaaaaagtggtctatttaagggaaatacaggctagtaaaatatttgttatttgcactaggagataatttaaggaacaccttctcaaatgtcatcagacttactttaaaggcaaaccaagtccaaaagttctaaattgagaaagctggaagggaaacttaaatatgatccaaccccctgttttatgaccagaggggaatggattggccaagatgtcggggatggttaataggacctcaggctcctggtcagtgtggggcactcagacccatgagtctagaaagcaaagaacaactggattcatgtttcctatgtcagagtccacccagttgcagttccacctgagtccttcacagacattaaaggtaggattcacatcatggaataagcatttttctactagcgatttgtttaataaagctttattggaatataatttgcatgccataacatttccccttttagatggaaataatagacactgggaactccaaaagagcagggaggagagggagggttgaaaaattacctgttgggtataacattcgattgtaatcagtttccagtgttttgcattcctaccagccgtgtaatgcactatgaacattcatttgggggatgaataccctaggagcccaatccccaccattacatgtgtaatacccatgtaataaacaagcacatgtaccccaaataaaaaaaaatccccttttaaagtgtgtcattcactggttttcagtgtattcacagagttatgcaaccatcaccacaaaccaaatgtttaacatttccatcacccacttagccccctcaaagaaatcctagacctactagcagccactccccattacccacttccaggctctggcaaccacccttcagcttccagtctttatagatttgcatgtgctgggtgttttcatagaaaaggagtgtgtgcccttttgaatctgatttctttcactcagcagattcatccatgcttcagttcatccacgttgtaacatggattagtacttcattccttttcatagccaagtaatattccactttatggctatactacattttattgatgtacatttgagttgtttaccctttttggctgttaggaataatgctctgtgaacatttgtttacagagtttttgtgtatacgtatgttttcagtttccttaggtgtacacccagtagtagaattgctaggtcatatgggaattctgtgtttaaccttttgaggagctgccagacggttttccaaagtggctgcaccgtttgacattccctccagccgtgtatgagggttcgctttctccacgccctcgctaacacctgcgattttcttgttatgtgagccttctcgtgaatgttattccactgacattaatctcatggcaccgtcagtgattgaaatgatcttcttgttctctgtcttcgcctctggatcatgaccttcccgaggactgaatgtgtcataaaatccccagtctctagcagtacatgtgtattgagttggatcacatgctgctggacccatggcttgtcatcatgtgtacatgtagccgactttgactctcaactgtgtcagttctgggctagagactgttactttatacaaagagagataaactgtgtcccttgtcctcaaataaataggttggactactagggtatttacaaaacagagtgtaggtgaagaaaaggaaatttcagtgacaaattaggaggcacttaagaaatactggacgttttcaattaatttggcaaaatgaaaagtaatagatacatttccttggttgtggctgtgatgggtagagacagtggtgctgaacctcgctcacacatgtgaaagcttgtctgctccagaagtagaagagagccttccagttgctaaggctctgtccagggccgggctcctgccaggtggcaggcagaggcttcctcaagccctgcgtccctcttctgggttcagagaccactcccaggcttggttctatcagcacactccatgcatacaggtgcagaatgctctccccggccacccgagaccacacctcagccaggaccttgtgcagagcttgcttgggccaaggtacacgatccaggaaagctgagctcaagaaaaatgaatccaatgctggatgtggtgactcgtgcctataatcccagctaattaggaggctgaggtgggaggattgcctgagcccaagagttcgaggctgtgttgagccatgattgcaccaccgcactccagcttgggtgacaaagggccatgtttcttaaaaagaaaaaaaaaaaaaaaagaaaggagggagaaattaattccctgtctgatgaagaactggtctatgggtcccagaggatctcaaacatttccccttctgtacctttcctcgtcctgttgcctccgcctggaatgcctgttttaattaacgggtgaggatggccacgtactttatccaaactagggcactttgagagtgaaagagggttatgccaggacaacaggcagaagccaggaccgtccagggcaaaccaaggctgcctccactccacgcatcagttccgtcctctggggaaggcgctgtccacttcccactgccatcttccctaagaagacctgccgtcccctgagcatagggaccattccacctcatgtgttgtcattgggttacctgtctcatcctcctcactggatcacggacttctcaaaatcagggaccaggtcaaggggcttggtattcaggaggtgcttatgaaattctcatgagattgaggaattcccacagactgaaagtcaaaggtaaagctggatcatgcatgaggcctcatctaggtaccaagggccttgtgagagatgtcaggaaggcatttcctgaagcactcgttactttctcttctacccctgaccctcctgcacaaagctcagcatgttgatatcctggaaaatacatgtgtggacaaacatatttagagttccaagtgtccagaaccttccgggaattctagccagcacaggtagcaaaataccttccacccagcattgtggggagcatctccaaacagtgaatgtatctggagttcagaaccgtgactttctgattcatttctaattcaaatcctcccagattgatgtcttcccattaagaccctactctatggtaattgctttactaggaacagcgttgagatattcttgagctgacactttcccctcctgttttccaggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaagcaca

SEQ ID NO: 699 - DNA, 110144 bp, Homo sapiens
gtcagtggaggcagcagcggtagaggcggcggcgaggactggcgacggcgaggaggtgagtgtccgccgcgctccgcacggtcctcttcccgcggcgggtcggagcgggtggacgtgcgccggcaccgctgcgagggacgcttatgtaagggtcgcgcgcgcaaaggcggcgcgggctccgcgagtgacggctggaggagacagcgacgggctgtgcgcggtgcgcgacgcgacgcagcggacggcgcccctccccctcgcgcgggggctcggccggctggacccgcccccggacccgcccccggctgcagcccccgagcgcccctccgcagcgtccgcctgcgggctgcctcattcttgctctcgggcccattttgcagatggagaaactgactaaagcgcctcgcgcgaggtccctgagggttcgaacccaagtctgtcaggatcgggagcccaagttgtccccatcgtactggatgtggctcagctctgcaggaagccgcggcgtgtaaggcgagggctttccttgttccttgctctcgcactccgcctcccgtaggatcctctactttgtttcagacggggaagctccaggcgcccagacgcagtgattcgcccaaggccgctcattcaggaggtggggctgggctcagccccttatttctccagcttttagtagtttacaaagcgcatcagagtcggaagccaagtccctaggtccctggcaactttgagattcttttgttttcttttcttttttagacagggtcttgctgtcacccacccaggctggagtgcagtggcgcgatctcggctcactgcagtctcgacctcccgggctcaagcgaccctcctgccacagtcccccagtgctgggactacaggcgggcgccaccacgcctagctaatttttgtattttttggtagagacgaggttccgtcatgttgcccaggctggtctcgaactcctacgctcaagcgagcggcctgccctggcttcccaaagtgctgagattacaggcgtgcctcgtctgaaattctaaaaaatcagattgtgtctttattttgtgagaagaggtaggcctgggctccttacccgttctccagctgagaaaacaggctcagagaagtaccaacacttgctgatgacaaccagaacctccagagtgcctgccatctgcctccctattgctcccgtacccactgccaccatcagccctggctggcctcccccaaggcaccctttccctgtatgtgatgcaaacacttgtgctgggggtggatgtgctcagcatttctctcacttgcagctacagcttcctgcctgcaggctctccttaactgttgaactcttaatcacattcttttgcacacctacagtgttcctatccctacactgggccgagagacagcgtgggcgatgaggtcaatccttgtcctgcaactgctgacaaacccattgggggagagagaaaataaacaaaacctaagcagcaaggcagcctgctgcagatgtttgtagagagcctagtgggtgaggtattggccctaggaggacatggaagaggaagttcagtagaggccagtaaatcacagcaaaccacacactaaagcgagagagaggagaaatggcctggaaggggatgggcttgggaaggcttcgtggaggaggtgagttgtggacctctttttgatgccgctgcagtggagaaacagtgattggatttcagcagctagaaagttttattctggagaggttttgttaaagaggtttttttgtttttgttttttgagatggagtttcgctcttgtcgcccaggctggagtgcagcggtgtgatctcagctcaccacaacctccgcctcccgagttcaagcgattctcctgcctcagcatcctgagtagctgggattacaggcgcatgccaccacacctggctattttttgtatttttagtagagatggggtttcaccatgttggccaggctggtcttgaactcctgacctcaggtgatccgcccacctcgacctcccaaagtgctgggattataggcatgagccatcatgcctggccagttacagaggtttcaagcaattagaactggaagaggaaggctgaggaaggtggaaggagaatgtgggggaaacagcttcactgttgggtgtaagaaacttgattggtcactgggaagaggcctctacaggagatgtaaccaggtgagggcactaggatttgctaaggtgcaggtaagtcagtgactggaaaccaaactgaggaagcaagattagatgcaaaggtagacggggctgggcgcggtgctcatgcctgtaatcccagcactttgggaggccgaggcgggtggatcacctgaggtcaggagttcgagaccagcctggccaacatggtgaaaccccttctctgctaaaaatacaaaaactagccaggcctggtggcgggcacctgtaatcccagctactcaggaggctgaggcaggagaattgcttgaacctgggagttgaaggttgcagtaagctgagatcacgcccctgcactccagcctgggcgacagcatgaaactccctgtcaaaaaaaaagaaaaaaaaaagcccaaaaggcagacagggctctgagggcccagctgcaggcctgagctgcagattgtgtcccatggtgttctggtaagctccctgaaagcagccgtcatttgtttactaatggctccttcaccctgctgtgccctgctcttagggaaggggctttgttcactacagttgctcagtatctgctttttgaattaattaggctgtcatccaaagtttcctcagtttaccccaatgtaccctcatgtgtcataacgccttctgtctttctactgaagcccgctgcagcctggctgactcggttccctgtgccagtcctcacctccaagatctcccctagaaggttgtccctggtagcccacagtaggtcccccaggcccttttcccttttttgtcctgctccttgctttcacccggtctcacttccagtgccccaggcactgtgataggtacctgtcctcccaccaccactcatgggggctctgggaccagtggcagggcaggacctcagattcactactcttatcccaagccacagttccctgtgtccctcttccctctgtcctctcagtacctaatagtgccaggaacaagtaggtgcctaatgagtgttttgggtgaattagttgaaaaggggtcaaactgggaaccagtgaggagagaagggtgcaagatggggaatacggaaaggagttacttttggaggtggcagggatggccagcaccaaggtcagtatggcagtaaatctggcaatccacatttctcactggcaccttctgcatgggctggaggcctcgttcaggtcaacgttttctgtgtttttttttttttggagacggagtcttgttttgttgcccaggctgcagtacagtggcaccatcttggctcactgcagcctctgcctcccggattcaagtgattctcctgcctcagcctcctgagtagctgggattacaggcaccaaccctttgcctggctaatttttgtatctttagtagagatggggtttcactatgttgggcaggctggtctcgaactcctgacttcaggtgatcacctgccttggcctcccaaagtgctgggattacaggcgtgagccactgcacccggcctctggtcaacattttcattgaggatgagcatggccttctctttggctgcctcccaatatcgtcctgcccccatctgaatgggccccgtttcttgtatcctgaaagttcctgctttggggcaggtttctcacccagaggcctccttcacagcagcagggcattttgcctgctcactctgaaacctcacctgggcctgactgaccgtgccttcctctctttctcttagctgccttctagtctcacctgtggacactttgccaaaggagtcgggcctgacggtggaagatgggaaatggccaaaagaataaaccatttcctcttacttaccgaatgaaaagcttgcttcatcttggcgttcaagactctctaatatgattccacctgttgggctctttcttccatttgcctccgcaggtaccctcttctgtgtcagcccccatagtgagattagtcactgttaccccaaactcacttctcacggtcccccctctgctcttgttcttgttgactttgttttctgcagggccttgcttcttatcttgtcctgtcaaaattaaattattcttcgagacacaggactttattaaggcttgccaaatctattcagttggactgggctctcttttcataacgatgatgataagtaatgatttattgttattaataataaaagtcaactactgtgtggtggtgacggccttgctaagccccttacatacacataatgtgattatcacaacaatcctattacgaaggtcctattagatccatctcttacaaatgacggactctcataggtgaaactcagagaggtgaaataacgcccagagtaacacagccaggcaggctaggtggctcactgctggagtccctctcacgtgccatcccatttttgcttcttttaaccagcccctaacaacttgctttttggcactttgtgggcagggcctgagtgtacatacagttccttgtgcaaggcatgtgctcaataaatattttattgacttgagtgccccagacattgaatttcagccttgacgttatctgtcaaggcagctggttttctctgaacagggatttgagcttgctggcctgtttttccattttgctgttcattgactagtggctagggtaggtgtggctttttcggaaataagcagtcaataaaactccgaaaagtgattacacaataccaactgtgggctcccatgggcataaacacgaggtgggctcttacttatggcagagaggggtctctgcaggaaaggatttgaggaaatagccaggaaatagagtacacatctcaggtcacgtaagacagctccttattagtttcaagttgtggagtgagagaagaaccagactcccagtattcagagggagctcctgaaggattagagacagctctgcggagatgcagagaaagcgggcctgaggctggacggagtgggcaggaagagaaagcacttcagataaaacgaactgtttctagaacttcttgttcatgtgtagtgggtggcagaaaagggttttacttaagcgcttcccacctagcctgtcggttaacgtcccagtgtgtcctctgtgccaggcatggtgccactgctgtgcgtgtgctgcctcattgggtattccctagtacgctgtgagatgggcattgttattattcccattttacagatgaggaaacagactttgagtgattacagagcggctgtcagagtaacaagaggtgcagtccaggcagtgggacagcacagctggcgcttccagctctgtaccctcctggtgccctcagtggaagcaaagaaacagttcttggccgggtgcggtggctcacacctgtaatcccagcactttgggaggccgaggtgggtggatcacctgaggtcgggagttcgagaccagcctgaccaacatggagaaacccccatctctactaaaaataccaaattagctgggcgtggtggcacatgcctgtaatcccaactacctcaggaggctgaggcaggagaatcgcttgaatccgggaagcagaggttgcagtgagccgggattgcgccattgcactccagcccgggtaacaagactgaaaaagttctctgggttctaaaatcggtgttcttgccactcctgttttctctgggaagttcctggagcaatgagggtaatgctgttttttcttttgctttagatagtgtctgccttctggagagctgaccaaacactaagggtaagtcctgtgcctgaatccaggctggcgggatgcatgggggtcttcaccaggagcagctgtggatgccagcagtttggcatgtcaggtcttaagctcaatcaataaaaaaaggctgcgctctgatttgtggataatatccgtttaagcagtcttgtctgtttccagttgctcctgatttttacaggaaagtgacatctggctccctgctggccccatttggcagctggccagcctcagcagaaggccctggttctggaagggtatggtcagcttgggaagctgggcaggaagaatccctggggctgggccgtctctgagaagaccccttgagtcagcatggagagcaggcagctgtggtgtgaggtggttctgccagctggttgtaaagtcacttgacacgggtttccagagggtgacgctcaacctttgccagtcacggtaacaacggggaaaaagggacctgcccttcttcccctgcacattttacaggcatgtgccaccacacctggctaagtttttttttttcttttttttttttgagacggagtcttgctctgttgccaggctggagtgcagtggcgcaagctcggcttactgcaacctctgcctcctgggttcaagcaattctcctgcctcagcctcccgagtagctgggactacaggtgtgtgctgccatgcccagctaatttttgtatttttagtagagacggggttttaccatgttggccaggatggtctcaatctcttgatcttgtgatccacccacctcagcccctcaaagtgctgggattacaggcatgaaccactgtgcccggcctaatttttgtatttttagtagagatgggattttaccatgttggtcaggctggtctcgaactcctgacctcaggtgatccgccctcttcggcctccccagatgctgggattacaggtgtgagccagcgcgtccggcctctactgcttttacagttcccccaacatggatttccatggtggcaggtgcctgggagattcagtggcctcccctcagcctaaattccacagccctcccgccggtcccctgctagtccagtcccctctccccctgctggtctgcaggagcagccgagccagggaaccaggtgctctcccagcatttgtgacaacaataatgctcttcccttcaggcccgctgtggccttggggactttgtggctcagggacaactttctccagagctcatatccagtgctgagtggggattccttggtataggagtttttctcggttttccacccattatgtgggggttttcctctgacgacccttcatgacgcaggagctggtttcctgtgtgagatttcccgcagtcctcccttggagctaggtcttgggccagcaggtgccgtctgcgtgctaccattgagtaagggcaatgggctcatggtgggaatggccgtaacgtggaagaactccaccctccacgagtttcacccccttgttctctctctgcttgctctgtcctcttattcttggctgctagagttggatgttatttctcttacttgcatccctacaatgagaggtgggcatgttggggaaggttccccccaaaccacttgtcttatggaactgaagaaactgaagcctagagaaggctgcttagcagaatccaagatgctgatcccattgtttattcttcttttaaaattgccatattttattgatgtcttcccttagatccatcaatagagagggaaaatcagtcaccaagaagggacctcttcttccaggttatgtaatttgtcaaagcttgtttggctcctcagttcccaaggcactgctgacttgagctttgcctagggactaaggctctgtagtctaagcttgtcaccctcccctcctcttcagctttctcctggggggacatggatgtggccctttgttgtgttgttaagtgttatgcctgaaggcgttaccccaggtactcccagcactacctcgggtttcctactcttgtgttacctccttgtcctgatatgcctcgaggccagagaaagaggtggggccgggagggcacgggacagctgggagtacatttccactgcctgtgtgtggaagggcctgactgcttctgtggcagctcctttcctgatgacatccaccatgacatcacaacgaggctttgggaaaattccacgacctggccatgctgagtcatacttagtctctggggatgtgtgtcacctttctcttgtctgtcactgagtgctgcagttactatgaagtgacacatgctgcccatttattacgtttgcacatcactttatgctgctttggagcctcttctcatgtacatgctgtgtatcaatgtgaaatgtattaatattaaatcattaataataagtatattatttattctggaaaatatttgtctcttgcaatgtgtgaggaaccagaggttcagagagactagagactaagcgacttggtgagtttcgggtgactggtgcgtggcatgtctgagggaggtttggatgccacacccactcctacccctggatttttatgtaatgcaaagattattcagaaattactttggtcgaaaacaattgattttcaatttgttaaaattatgaattcagaaacctagttattttaagggccagtcttttaagtttagcttataagtgtagcctataaatctttctgatctatttacgattctaggacattttaacagtcactttcagggggcttttatttatttattttttttgcgatggagtctcgctctgtcgcgatctcggctcactgcaacctccgcctcctggttcaagcgattcttctgcctcagcctcctgagtagctgggattacaggcgcccgccaccatgctggctaatttgtatttttagtagaggcggggtttcttcatgttggtcaggctggtctcgaactcctgactcaagtgatctgcccgcctcggcctcccaaagtgctgggattacaggcgtgagccgccgccccggccttagggggctttttgattaatgcttggtcccatttgcaaatttgatgaaacttctgaaatgtttcaattgaacttataaatcatattcaacttcagttaactattttaataattcttctggccgggcatggtgggtggctcacgcctgtaatcctagcactttgggaggccaaggcgggcagatcacgaggtcaagagattgagaccatcctggccaacatggtgaaaccctgtcgctactaaaaatacaaaaattagctgggtgtggtggtcacgcgcctgtaatcccagctacttgggaggctgaggcaggagaatcgcttgaacccgggaggcggaggttgcagtgagctgagattatgccactgcactccagcctggcgacacagcaagactccatctcaaaaaaataataataataataaataataataataattcttccatttttctgattaaaaaaaccctctaatacctaaatgactcttgtaaatctaataaatgaagctgaatattacacttttcttaaactttcctataccgttttatgttttgtttgtttatttttgtttattttgagacggtctgattctgtcactcaggctggagtacagtggcacagtctcagctcactgcaacctctacctcctaggctcaggtgatcttcccttttcagactcctgagtagctgggactacaggttcaagccaccacacccggctaatttttgtactttttgtggagacggggtttcaccacattgcccaggctcatctcgaactcctgagctcaagcaatcagcccgccttggcctcccaaagtgctgggattacaggcgtgatacattttagtttttacaatagctttattggagtattactgagatataataagttgcacatatttaaagtatacagtttagtaagttttaacatatgtgtacccttgtgaaaccatcactgcagtccagagagtgaacacattcatcacctttggaattcctccctctgcctcctcactcttcaggaaaccatggaactgctttctgttactataggttagtttccattttctggaatttcacataaattgactcatacagtatatattcttttttctctgccttcttttactcagcataattatgttgagatatgtccatgttgttgcttgtattgatagttcatttccttcttttttttttttttaagacagagtcttgctctgtcacccaagctggaatatagcggcgtgatcatagctcactgcagccttgatcttctgggctcaagtgatctcccatctcactgagtagctggaactacaggtgtgtgccactacgcctggcatatctatctatctatctatctatctatctatctatctatctatctatctatctttagtagagatgagatctcggtatgttgcttaggctttttttttttttttgagacggaatctcactctgtcgcccaggctggagtgcagtggcatgatctcggctcactgcaacctctgcctcccgggttcaagcgattcttctgccttagcctcccaagtagctgggactagaggcgcccaccaccacgcccagctaatttttgtatttttagtagagagggggtttcaccatgttggccaggctggtctcgactcctgacctcaaatgatccaccccacctcagcctcgaaaagtgttgggattacctgcgtgagctaccgcacctggcccttaggcttgtcttgaactcctgaactcaagcagtccttcccactttccaccttggcctcccaaagtgctggggttacaggcatgagccactgttcctggtcagttctttttttttttttgagactgagtcttgctctgtcgcacaggctggagtgcagtggcacgatctcggctcactgcaagctccgcctcaacctcccgagtagctgggactacaggcacccaccaccacacccagctaattttgtttttgtatttttagtagagacggggtttcactgtgttagccagaatggtcttgatctcctgaccttgtgatcctcccgcctcggcctcccaaagtgctggaattacaggcatgagccaccgcacccagctttttttttttgctgatttcattatatgggtattacagtttatccagtcacctttgttggtcatctcaggtgcttctactttttggcatctacaaataaagctactgtgaacatttgtgtataagtctttgtgtgaacatatatttccttttctcttgggtaaatgcctaggagtggagtggctggatcctgtggtagctgtatgtatgtttaacttgaactgccaaattttctgacgtggttgtagtattttacattcctaccagctgtgtatgagagttccagtttctcttcatcctccccaacactggctatggttagtcttttaaattttagccatttaaaaaggtatatggtggtatctcatggtttcaatttgaattttcctaatgataatgatgttgagcatcttgtcatgtgtttgtcatctgccagtactgattttaaacttagtaaaatttctatgtaaaatcacacgtctaaactaactactcagttacatgttttttgttttgagacagggtcttgctctgtgccccaggctggcttgcactgatgcgatcgtggctcactgcagcctcgacctcccatgctcaagcgatcctcccatctcagcctcttgagtagctgggaccatggcatgcacgtcatgcctggctgatttaaaaaaaattttttttttgagatggagtctcactctgttgcccaggctggaatgcggtttcatgatcttggcctacttgcaacctccgcctgctgggttcaagcaattcttctgcctcagcctcccgagtagctgggattacaggcgtggcccagctaatttttgtatttttagtagagacggggtttcaccatattggccaggctgatctcgaactcccgaccttgtgatctgcccgccttggtctcccaaagtgctgggattacaggcatgagccactgcacctggccttttaaaaaattttctttgtagaggtgggatttcactgtgttgccagggctggtctcaaactgctatcatgcgatccacctgcctcagcctcccaaaatcatgtggttacagatgtgagtcaccacgcctggcctcagttacatgttttaattggaatctcaagactgatttgttattctaaacagaccatattctcttagagtacataaagtaacagacaacacacagatttcttttttttttttttttttttttgagacggagtctcgctctgtcgcccaggccggactgcggactgcagtggcgcaatcttggctcactgcaagcttcgcttcccgggttcacgccattctcctgcctcagcctcccgagtagctgggactacaggcgcccgccaccgcgccctgctaattttttgtatttttagtagagacggggtttcaccttgttagccaggatggtctcgatctcctgacctcatgatccacccgcctcggcctcccaaagtgctgggattacaggcgtgagccaccgcgcccggccagatttcttaacacaaaaatataaatactatggtttttattttcctagccttgtctatatttaatctaatattttcctggaattagagaagcttacctaataaggaattaaatacatgattttaaagtatagtaaattatttttctaattaacttttggcctttctttctcaactggatgacattttctttataattaaagagacccctggcagggatgaaactggactttgaatctaactgctaagcagagcctgctccactgccaccattttgcctccaaatggggatggtctcacagcccatgtgcctcaaatagaagtatcacattactaatgtcttcctcttctcatctcatgtaactctgcagttccgacccgcccccccaaaccatttgaattcagttaatctatttaaggcttcctttttgttatgcagtatggccacaaaaataggtggaactaaatacaaaatagatacagtttagattctttagattctctgtatctcccaaggctttctctgaccaaggactagtaaaatcatgtctgacccaccagggctagaatttgagtcccagtcttctgagtccatgtctggcatttccttccatctcttaaaccttttcaaataaagagaaagagggtggtacttaagagttcttactttctgatcacgcctggttaccaataaattatagcatctggaaccagtgccacctttttcatgttcttcagttcacgcccctggaaatggtgagaattttggcctctccctaacctcccggtggagagctaccaatctttggagagcccattgccatcaaattcttgttagaaatctgcgtcttggatgataactagatgcagaattgcattcctgtcctggtcactgggtatggccccaggaagcttgtaggtggtgagtggacctggttgagaattattaatgcagtttgacctctccgttgatgtctgatgcacatgtggcccaatgtgagtaagagcagaggtttgtagagtgacaagaaaaggacatttgggggagaaattggcaggaggctgacttaggtttttgcgctgcaagagtttttcgtcccccattttaaaaaattgtggcaaaatacattgtcttcatccctttgggctgctataacaaaataaccttattctaggtaatttataaacaatagaaatttatttatttattatttttatttatttattttttgagacagtcttgctgtgtcacccaggatggatgcagtggtgcaatctcggctcactgcaacccctgcctcccaggttcaagcgattctcctgcctcagactcctgagtagctgggattataggtgtgtgccaccatgcccaactaatttttgtactcttagtagagatggggtttcaccatgttgggcaggctggtctcgaactcctgacctcaagtgatccgcctgccttggcctcccaaagtgctgggattacaggtgtgagccattgcggccggcctgaagttgttttttctgagacggagtcttgctctgtcacccaggctggagtgcagtggtgcaatctcggctcactgcaagcttctcctcctgagttcatgccattctcttgcctcagcctcccaagtagctgggactacaggcgcccaccatcacacccggctaattttttgtatttttattggagacggagtttcaccgtgttagccaggatggtctcgatctcctgaccttgtgttccgcccgcctcgggctcccaaagtgctgggattacaggcgtgagccactgtgcccggccttttgttcttttcttttttttttttttttgagacagtttcgctattatcactcaggctggagggcagtggctcactgcaacctctgtctcctgggttcaagagattctctgcctcagcctctctattagctgggaatacacgcgcctgccacgacgcccggctaatttttgcattttttagtagaaacggggtttcaccatgttgagaaatttcttttttttttttttttttttttttttttttgagccggagtcttgctctatagcccaggctggagagcagtggcgcgatctctgctcaccacaagctccgctgcttcccgggttcatgccattctcctgcctcagcctcccaagtagctgggggactacaggcgcctgccaccacgcccggcaaattttttttttttgcatttttagtagagacagggttccatcgtgttagccaggatggtctcaatctcctgacctcatgatcctcatgatccgggcctcggcctcccaaagtgttgggattacaggcgtgagccaccgcacccggccgagaagtttatttcttaacggttttggaagctgagaagtccaagatcaaggcagcagcagattcggtatctggtgagggcttgttcctcacaaatcatgctgtcttcaggctgcgtcctcacagggtggaagggacaaggcagctccttttgaccgtgaccccttttttttttttcctccgactcctgggctcaacatcttcccacctcagcctcctgactagctgggattataggcgccagccaccatggccagctcgacctcttttattaggatgctaatcctactcatagaacaggaccctcatgacaacctcctcaaggccccacctcttaatacgattgcattgggagttaggttgaacatgtgaattttgaggggatgtccatataacacatgtattatgtacacctgatattaaacttactttttttttttttgagatggagtttcgctctcgttgcccaggctggagtgtgatggcatgatcttggctcaccgcaacctccgcctcccgggttcaagcaattctcctgcctcagcctcccgagtagctgggactacagacgcccgccaccagacccagctaattttgtatttctttttagtagagacgggttttctccatgttggtcaggatgatctcaaactcccgacttcaggtgatccgcccgcctcggcctcccaaagtgctgggattacaggtgtgagccatcgcacccagccgaaactttcttaaccattttccagcgtacagttcagtggtattaagtatatttatattgagcaaccatcaccactatctgcagactttttttcatcttgtaaaactgaagctctgtaacccttaaatcctgactcctcattctccactcacccaagcccctggcacccaccattctactttctgtctctgaattggactgctctaggcacctcatataaatggaatcatacggtatttgtctttttgtgactggcatatttcacatagcataatgtcctcaaggttcatccatgttgtagcatgtgtcagaatttctttttttttttttttgagatggagtctcgctctgtcgcccaggctggagtgcagtggtgcgatctcggctcactgcaagctccacctcccgggttcacaccattctcctgcctcagcctcccgaggagctgggactacaggcgcctgccaccatgcccagctaattttttttgtatatttagtagagacggggtttcaccgtgttagccaggatggtctcgatctcctgacttcgtgatccgtccacctcggcctcccaaagtgctgggattacaggcatgagccaccgcgcccagcattttttttttttttgagatggagtttcactcttgttgcccaggctggagtgcaatggtgcgatctcggctcactacaacctctgcctcccgagttcaagcgactctcctgcctcagcctcccgagtagttgggattacaggcatgtgccaccacacccggctaattttatatttttattagagacggggtttccccatgttggtcaggctgatctcaaactcctgagttcaggtgatctgcccgcctcagcctcccaaagtgttgtgattacaggcgtgagccactgcgcctggccggaatttctttttaaggctgaatgatgggggccaggcatgatggctcacacctgtaatcccagcactttgggaggccgaggcaggcagatcacgaggtcaggagatcgataccatcctggctaacacggtgaaaccccgtctctactaaaaaatacaaaaaattagctgggcatggtggcgggcacctgtagtctcagctactcggaaggttgaggcagcagaatggtgtgaacccgggaggcggagcttgcagtgagccgagatggcgccactgcactccagcctgggcgacagagcaagactctgcctcaaaaaaaaagaaaaggctgaatgatattccgttgtatggattttacttatccattcatatatctgtggacacttggcttggttccatgtttgagctattatgaataatgcttccatgaatatgggtgtacaaatatctctttgagactttgctttcagttcttttggatatatacctgattgctgggtcaatggcaattctatttttaatttctcaagagcctgctatgctattttccacatcagctacagcattttacatttccattaacagtgcatgagggttccagtttttccacatcctcaccaacactttgttgttttgatagtagccatcccaatgggtatgaggtgatatctcattgtagtttggatttgcatttccttaatgattagtgatgttgagcaccttttttttttttttttttttttagatggagtcttgcttgctctgttgcccaggctggagtgcagtggcaccatgtcagctcactgcaacctctgcctcctgggttcaagctatcctcttgcctcagcctcccaagtagcttggattgtaaacatgcaccaccatgcctggctaatttttgtatttttagtagagacgtgttagccaggctggtctcgatctcctgacctcaagtgaccacctgcctcagcctcccaaagtactgggattacaggcgtgagccactgtgcctggccttgagcatcttgtgatgtgcttattggccatttgtatatcttctatcttctttggggaaatgtctgttcaagtcctttgcctttttaaatttttattatttatttatttatttattttgagacagggtcttgttctgttgcccaggctggagtacagtggcacagtcttggctcactgcagcctcgacctcctgggctgcagtgatcctcccacctcagcctcccttgtagctgtatttttttgtattttgtattttgtagctgtagtttttgtattttttgtggagacagcgtttcaccatgatgcccaggctggtcttgaactcctgagctcaagtgatctgcctgcttcagcctcccaaagtgctgggattacagacatgagccactgcacctggcaaactcccaaaattcaacacacacacacaaaaaaccacctgattcaaaatgggcagaggggccgggtgtggtcccaactaccagggagactgaagtgggaggatcacttgagcatgagaagtcgaggctgcagtgagtcgagattgtacgactgcattccagcctggacaacagagtgagaccctgtctcaaaaaaaaaaaaaaaaagttttgggaactttctatgtattctcgatattaatcccttatcagatacatgatttgtaaatattttcttccatactgtggattgcctttttaccccatgataatgtcttttgatgcacaaaatttttacattttcttgaagtccaacttgtctatctttgctttttgttgcctgtgcctgcctttggtgttgtatccaagaaatcattgttaaatctaatataaagcttttcccctatgttttttccaagagttttgtcattttaggtcttatgtttaggtcatggatatggtgtcaggtaagggtccaatttcattctttctcatgtgtctctgcaggagttgttttttttttgttttttcttgtttttggttttttttttttttttttttttgagacggagttttgctcttgttgcccaggctggagtgcaatggcacgatctcggcttgctgcaacctctgcctcccgggttcaagtgattctcctgcctcagccttccgagtagctgggattacaggcatgcgccaccacacctggctaattttgtatttttagtagagacggggtttctccgtattggtcaggctggtctcaaactcctgacctcaggtgatccacccgccttggcctcccaaagtattaggattacaggcgtgaaccactgtgtccagcctctgcaggagttttaagtacagtctgtcctcacctgtggctgtgttcccctttaaggtggtaaaggagcactgtgagatacagtatttcatagcacagttgtttcttgctatcccctggggactggttccaagacccccctatggatgccagaatcctccaagatgctcaagtgcttgatagaaaatggcatagtatttgcatataacctatgcatatcatcttgtgtactttaaatcatctctggataacttaaaatacccaatccaatgtaaatgccatgtaaatagttcttatactgtattgtttttatttgtattattttttattgttgtattgtcattttttattttgctttttcgaatatttttgatccccagttggttgaatgagtggatgtggaacccacagatacagagggctgaccatatagtaaacgaaggcagtgatgtcactgagtgacgactctgctctcaaagaggagggaaaatgtgcttcaccatagggccagtattaaatgactggggggtgcagagaagatgaaacctaaaatgtcaagtcatttaacacagcaattccagttctagaaatgtaacctgtggtatcatgggacaggcgtgcaaacatatgaggtgatagcagaaaatgggaaatcaccaaaacgtacatcagaaaatgattgctacatatgaagtctgttctgtgtcatatgatgtagcctttaaaaatagctcatgtatcctaatcaagctgtcactctaaatttattaccataggacgagagctatgatgcctttacacaaaaaatatatattataaaacagaatgtataatatctcattttttgttattttggaatgctataccaacaatttgttcaggttgctggagttacaaaattatgtgtttaaaaaattttctatatagtatttttttctttataggatgttttaattttaagttatcaatttaaaaaatctaattagagaagggtgcaattcataacactacttggggcttacggtcgagtactaggtacttaaatatcagagtttgactcttttacccctcttttccaaaaaattgttttgggggatgaaaacctctttctaaatgccatatgagatatagattgctggggagtggtggagtgaggacttcataaatgctgttcctccatttaaaggaatgagaaaactggcaaaaatgattaaaaccaactttttcagaactcgagaaattaaccaaaggcttgcaacaatctaagacacatttattcaggaaaaatcgcagaaaaaagttattcttgttttcaacaaaaagttatgaggcatgcaaagaaacaagaaagtatggttcatacacaggaaagacacagtcttttccagcctagatgttggacttcatagacaatgatgttaaatcaactattttaaatttgtctaaagaacttaaggaaaatgtgagaagagtgtctcaccaaatagagggaggccaaggcaggtggatcacgaggtcgagagatcgagaccatcctggctaacacagtgaaaccccgtctctactaaaaatacaaaaaattagctgagtgtggtggcacgcacctgtagtcccagctactcaggaggctgaggcaggagaatcgcttgaacctgggaggtggagattgcagtgagctgagatggcatcactgtactccagcctaggcaacagagcaagactcagtctcaaaaaaaaaaaaaacaaaaaaaacccagaaattctggagttgaactgtgtagttactgacatgaaaaattcactagaggctgaacagcagatttgagcaggcagaaaaaaatcagcaagcttgaagatggtaccttgagatttttcaggctaatgaaaaaagaatgaaggaaaattaacagcctcagagacccatggtgcaccgtcacacaaatcaacatatgcatcatgagagtcccagaaggagaggagagaaagggtcagaaagaatggccacaagctgatgaaaaacagtaacctacccactcaggaagctcagtgaactccaatgaggatgaatatcagagatccacacctagatatttcataatcaaagtgtcaaatgacaaagaatcttgaaagcagcaagagatgagcaacttatcttgttcaaaggatctttgatcagattaacagctcatttctcctcagaaatcatgggagccaggagatagtgggatgaacactgttgaaggcaaaaccttcaactgtaattattggacttttgagtcttagatggtcctgacctctttgtcttcagggacagtttttcaatttaatccctaataacaattagtcaagcttccttgacctgtaggaaggcctgtctttaggccgggcacagtggcttacacctgtaatcccagcactttgggaggcccagacgggtggatcatttgaggtcagaagttcgagaccagcctgaccaacatggcgaaacccccatctctaccaaaaatacaaaaattagccaggcgtggtggtgcatacctgtagtcccagctacttagggggctgaggcacgagaatcgttgcttgaacttgggaggcggaggttgcagtgagccaagatcgcgccactgcattccagcctgggagcctgggtgacagagcaagactccatcttaaaaaaaaaagaagacctatcttttatagagttcccttccccaagtttttctacaaatacccagggatgcttatgtgttccaccaagtttggaacatagttagggagtgaaaaacataggttaaatgaatgtcatctgtctggcttggttatttccttggccagctgttctcttctgtatgttgcctagttctccctgcctcagggctgttgcttcacccttcataccatattgccttaaatacacaaacgacctgtcaggcatttcacaacattttactgaatgcttggagatagcagaatggaattacaatacagaaaaagatgttttgctcacaaaggggaatttaccctttacctcaagaaaaatagagcaattgccaataacaatattggtggcctctcccctgcccattaaccatcaagacgtcagcaaatactggggtctaatctcaactagtgttactccaggacaccatatggagctgactgctgatgttctgttcttgataatatcccttatgtgtgtgtagcactttatagtttttttatttcatttttttctttttttctctccccccccaccttttttttgtgtgtgtgtgtgacagggtcttgctctgtcacgaggctggagtacagtggcaccatccaagctcactgtagcctccacctcctgggctcaagcaatgctcccacctcagcctcccaagtagctgagactacaggcatgtgccaccacacccagctgattttttttttttttttttttgagacagggtctcactctgtcactcatgctggagtgcagtggtgcaatcacagctcactgcagcctcaacttccaaggctcaaatgatcctcccacctgagcctcctgagtagctgggactacaggcatgtgccaccatgcctggctagtttttgtattttttgtaaagactgtgttgcccaggctggtctcaaacttctgagctcaagcgatcctcctgcctcggcctcctgaagtgctgggattacaggcatgagctacagcacttggctagttttattttatcaaccagttttccctggaactggttatggttgtggttttgctgcttatggatgacagacccgaggttcagagaggttcagtgtctctctcagcttcactaggaagagttatagccaagctctgacagcagcaaaccagattctggcctgaggttctcagaatatgctgccgttccacaggatgttgcaatatggtgtggcagggtgttacagtgcacagggctgaaaagaccaacctgagaccctcccctttccttctgaagttatcacttcatggacgtttgcagcttttatcataagagccatttgttgtcgcatggcttgtggccaactgggagtctacctccatctaaggcagggctcttctccctgccatgttgcccaaggctgtttcagtaagactgtaaggttttcttcagccctcctggcttttgactgccccattccaactggttgcaaaatagctatttgtgtttttgctgacctgagccatctttctgtccatttatacttctgatattcttacgtggcaatcagtatctagcagaatgaatgccccattttctaatcctgcgttttctcagttgactgagtggcttaaggaggacaagttattactgggcagtactccaagaaatggttctttccttcagcatttactgtgcatctgtgctatgcacagctccttactggatgctgtgaggccacaggaggatctgacaaggtggccttgccctgagttgtttatccgtggttgggagagagggaatgcacgtgctggacaaaatacatgcttgcatagtgactggctagcgtggaagagtagtaatgacctcattgatcctgcttctgtgccaggtgagatgctaaatgcataaacatacacagggggctgggcgcggttgttcacacctgtaatcccagcactttgggaggccgaggcgggtggatcacctgaggtcaagagttcgagaccagcctgaccaacatggtgaaacctcatctctactaaaatacaaaaaattagctgggtgtggtgggaggctgaggtaggaaaatcacttgaacccaggaggtagaggttgcagtgagccaagatcgtgccattgcaccccagcctgggcaacagagtgagactgtatctcaaaaacaaaaacaaaacacacatagggaattaccggggagtggcatagcagagttgagagcatggaccctggagtcaggcggacaggatggagttcaggcttagccctgatcagcaagttccttagcttcttcaagccttggtttcctcatctataaaatgagggcagtaagaccttccttccttgtcttactacccccattttatagatgaggaaaccaaccagtgggggctgttgggtagagatcaaatgcaataacttttgtacaaatgaaataacacacgttcattctgtacaaatgaaataacacataaacaaatgaaatcacacagtcatgtgcctgacacttggacacaccgtaatggtggctctgttaatgggaccagtgatgaacagttagaagtgaaccccttgagggtagaatatgtgaatccgaggccctgcaagatgaggggactctctcaggtgggtggaggagctggtcctcgcatgtgtgatatttgagttcgtaggaggcgggtgcccccggacagtggcaatgggagtgaggccaggtgatgagacagagggtgatgccccagcctcgctggcgtggaggaaggcagtgggaagccggcaagggtggaggttgtgcctgcattgatcactgtggaatcctcagggcctagcacttgggaagcaatgttggagtgtgctggtggggcgtagtgagcattagggctggaagttcattctgtgaaccccagctgcgtgttgggatttgagacaataagaagcccctgagatgcttgagccaggactacccagaggtgaatgggatttttggaaaacctctgggcggagtgggtggctgcctgggaatggggagaggcagaggttgggtggggactagctcagcagggaatgtaactcagacattccggaatgatgcaagtggaggttagggaagtggttgcaatgggaaggaggtggcaaatataaagtgtcacagaagaaaagttgtcatggggccaagtggagggagggattggagagctctaaattgcagctcaatcttcatcttgaaatgcaggatggaaaaagccaccccatttatttagctaaagggagctgactccaagacctgaggtcggggaaaagtggagagacaaatagaaaagaaatagggaattgggacagggcaccatctttcgggatggtgggcttttaagcccaactcagcatttcctgagaaaattgagatagcttgagaccagagcaataagcgttgagacttacccggagaaaatgttacccagagaggagaaagggctggtagggcctgaagattcttgagctgattttccccagttcttgcctcttagtgcctcccatttctcctcatctgacggtttctgggtgagacagttgcatctcatctgtggtaggctgcctactgcttggtgagcctgggctgaagggctgaggcctctggaagagctgtcaggagagagacaccttcagggtacttggagctttcgccttgcttccagggcgggataggtggaagctgaaactgcctcctagcaaacagatttacactgatcaaaacaaagtatttgtaggtgttagagttaagaggttgaggttttccgttggattttttaggtgcatggtggaagaggtattttagacgaaggattctcctagcagacacaaaatatgaattaagaacacttgtttctgtttttctcccaactacttcttgatattcatagttcctggtgctgggactttggaatgggttttggtgtgcagaaaagacagggcatttgctgccaacaggggacataattgagactaaattcacaagataagggatggtatgatttaccttccaagaaaagatctgtgtctggtcctgtatctggcttctttctttattgcttttgcagttctgaatcagttttctttccccgatggctagcttctccagctggagagaacacacagtttaaagaggctttccccccagggccagattaaggatacttctgggctaaagggcaaatgcagccattcctagcagatttatggccccgaaaggacatttcggccactgcatctgcgagatttttgtcccacatcagctagcccagcagcgtaagcccaagggtttagtcattgacagagtccaaccaaggggtctctgtggaaccctgggcttgaatgggctggagttctaccctcccattgaaatcatttgagatggtagagtgccttccatgctgaaaacaggtctcatgtaacagttactgatggggccaaggaagcccaggtatgacctaggtaactcctcagagatgctactgttgaacctaatagtcttctagcaggttaccaagcggtaatccaaagagttagtgtttaacttaaaaaaaaaggtattcagtttagctatgtaatacttgcaccttgtacaaacattgaaatgtatgagtctcctttttcctctctccccagtaacccagtcccctcccaggaggccacttccggttaaattatcttgtctgtcctcttggaggtggtctgccctttgaaatagaaacatatttccttttttctttttctttttcttttttttttttttttgagacagagtctcgctctgtcgcccaggctggagtgcagtggcgtgatcttgtctcactgcaagctccgcctcccgggttcacgccattctcctgcctcagcctcctgagtagctgggactacaggcaactgccactatgcccggctaatgttttttgtatttttagtagagatggggtttcaccgtgttagccaggatggtctctatctcctgatcttgtgatccacctgccttggcctcccaaagtgctgggattacaggcgtgagccactgcgcccggctacagaaacatatatctattgtttgtttctcctgtgccctttctgctccatgcccttttcatttatcagtgtatcttggaaatcgtccgatgtcagcacaaataaaaagtctgcagtactctgtgtgccattgcatgtttttttttcttcattttgccatttgtttattgcaaaatcccacacttaacagaagacatgtttaaaacatatgagtatgttaaaacaaaatagtaaaatgaacatctatgttcccatccctaggttaaggttaggaccatataagccccctatgttccctccccggttgaagtcccttccctcagctattccttttttttttttttttttttttcttgagatggaatcttgccactctgctgtccagggtggagtgcagtggtgccatctcggcccactgcaacccctgcctcctgggttcaagtgattctcctgcctcagcctcctgagtagctgggactacaggtgtgtgccaccatgcccggctaatttttgtatttttagtagagacgaagtttcaccatgttggccaggctggtcttgaacccctgacctcaggtgatccgcccacctcagcctcccaaagtgctgggatgacagatgtaagccaccacacctggcaccccagctattctgaattttgtgatatttattctcttgttcttgttagttttcccaccgatagccaacctctgaataacttattgttgaattttgcctggttttgaacacctggacatggaatcctacagtagatttctgtgacttgctcagcattacatttgtgattcgtccatgtggatgcacatggctctgttcatgttcactgccgtagagctttccattgaatgaatatccacagtgtgttgatcctttctgttgccctgttgccaagaaggccttggtctgccttttgttttttttcctctctcaggaataaccctgctgggaacttttttttttttttttttttttttaagacagagtcttgctctgtcgcccaggctgaagtgcagtggtgtgatcttggctcactacaacctctgactcccgagttcaaatgattctcctgtctcaacctcccaagtagctgggattacaggggtgtgccaccatgcccaaccaatttttgtatctttaatagagacagggtttcgccatgttggccaggctggtcttgaactcctgaactcaggtgatccgcctgcctcaggctcccaaagtgctgggattacaggcatgagccaccacgtccagcaggaacattcttacatatggctcctggaacacatgagcaagaatttctgtggggtataaactaggagtggagttgctggcatgtctaactcttctaggttatccgaaaccaaagatttgaggttttgaaaactaatttgcccttctcctgccatcagtaggagcactgagtattttctgatcgcccaggtagtacaactttggactgcaagtctgtgtgagggctgttttgtgattgcagcttcttggggggagttttttgtttttctacctgcttttgtttttctacctgccaaggatttagacagttgatttttcttgcaggtagctcttggggacagggaagggtacatcaagtttcttggtggttcactgttacgttaagggagtatcctttggaagtcccaacttcactgggggtaagatctctttagatttcccaccgtggctgggctctgggccgtgcttctgtgaccttttgaggctttgaaaactgaagctcaggtttgcctagttctgcaaatgccatctagataaaagcttcagtgttaacttacctccctgtttctcctccttagggttttagcctgaatgttccttattttcttgccagcttgcctatgcttttaagacaaaatttaatctggccaggcgtggtggctcatgcctgtattcctaacactttgggaggacaaggtggaaagatcacttgagcccaggagtttgaaaccagcctgggcaacatagtgagacctccatctctgtttcaaaaaaatatgtaaaaaataaaaagaaggccaggcaccgtggctcacacctgtaatcccagcactttgggaggccgaggtgggtgggtcacttgagttcaggagttcgagaccaccctggtcaacatggtgaaaccttgtctctactaaaaatacaaaaattagccgggcatggtggcatacacctgtggtcccagctacttgggaggctgaggcaagagaattgcttgaacctgggagagagaagttgcagtgagctgagattgggccactgcactccagcctgggggacagagcgagactctgtctcaaaaaaacaaaacaaaaataaagtagcactttcaagatgagcctttgcatccctagggttatggcttccattctcaggggttgctggatttcacatttgagaagtaaggctgccagcaccacagcgatgagacagaagtggtttcggccactcccccagaattttagtactatgcctgggcctggaaatctgactcatatttcaaactcacatgacactgatttgtcccagaaggctactttatggatttataatgggagatagaatctctggggtcagcctcttctggtttaaagatccttggttgacctgtcggtactaggtaagtcttagatggtggctaagtccattctagcattcaataaatagtacagatagggttgcttacagagcaggaatcatacacaggcccttttaaaaaatggtatgaccctattttagaccctgaccctccttgtccctggttgcagattcccactttcatgtagtgtttctttcccaaatattttgctattttagccttttgatttctgaaattgcccataataagtaatgctcatggccaggcacggtggctcatgcttgtaatcccagcactttgggagtcggaggtaggtggatcacttgaggttgggagttcaagaccagcctgaccaacatggagaaaccccgtctatactaaaaatacaaaattagccaggcaaggttacacatgcttgtaatcccagcaactcaggaggctgagaccagagaatcgcttgaacctgggaggcggaggttgcagtgagctgagatcgctccattgcactttagcctgggcaacaagagcgagactctgtctcaaaaataataataataataataattaatgctcacattatttttttttttgcactactaggtagactgaacaccccatggtcattctgctgctgccaagttcatcttggtaggtgctaatttcaggctggcctgattcttgtttttttttttttttttgagatggagtctcactctgtcgcccaggctggagtgcagtggcacaatctcagctcactgcgatcctgcctcctgggctcaagcaattcttctgcctcagcctcccaggtagctgggactacaggtgtccaccaccgcgcctggctaatttttttgtatttttaggagagatggggtttcaccgtgttagccaggatggtctcgatctcctgaccttgtgatccgcccgccttaggctcccaaagtgctggattacaggtgtgagacaccatacccggcctgccacaggtgggcttctgaaggtggtagaccctggagccaagcagtggcacaacataggcatctgaaatccacacgtccctttgtggcttcatgtctgtggccgaaaccaacaagcagatgtatagtgttatgtttgcttgtattgttcatcttagaacttagttccctctctgtctcttcatgtaaatttctcctttacattattttcttctttctcttagtcccaattcgacaaacctttcttgtttcccatgatctagtctccaggcttccttactaccctctccccttgagtaggcttgacaccatccagccctttctagtggggaaagcagaacccaaagttggcatcccagattctatcttttttttttttttttgagacggactttcgctcttgttgcccaggctggagtgccgtggcacgatctcagctcactgcaaccactgcctcccgggttcaagcgattctcctacctcagcctccctagtagctgagactacaggcacctgccaccaggcccagctaattttttgtatttttagtagagatggggtttcactgtgttggccaggctggtcttgaactcctgacctcaggcaatccacccacctcagcctcccaaagtgctgggattacaggcatgagccactgcgcccagcttgcctggctgatttttaacagtgacttttaaatttctactgccatccagcgcattcctgggctgctgtgtgtgtttcctatcagagaatgaaaaccagaggagtacgggagtacactggtgtggctgggagtcgagctctagagtcatactgctgagttcaagtccttgactaattaaagcatgactaggggaggccagcctggatagttaaaaattacatatttaaaatgtaatatatgtgtgagcgttcacagcagcgttattcaaatacaaaaaaaaattagctgggcatgatggtgcatgcctgtaatcccagctactcaggagactgagggtgggagaatcgcttgaacctgcgaggcagaggttgcagtgagccgagatcatgccattgcactccagcctgggcgacgagagcaaaactccgtctcaaaacacaaaaaaagagccaaaaggtggaaacaacccagatgttcatcaaccaatgaatggctaaacaaaatgtggcctacccatccagtggaatgttgttcagccataaaaaggagtgaagttctgacacatgctacgacatggatgaaccatgaaaacattgtgctaagcaaaagaagccagacacaaaaggtcacatactatatgacatttctaggaaatatccagaataggccatagagatggaaagcagattactggttgccaggggctgggggtgggtgggaatggggaatgacagctagtggtaccaggtttctttttggagtgatgaaaaggttctggaattggatagttggttaccaacattataaatatgctaaaaaccactgaactgtatagtactggtaaccagaatatgtgcatcattaggcctatatattaaacaattctagttggtcatgtccctagaccccggttgtgttgacttgccatgatttgtttaactgtttgcctactgttgaatacttggcttatttccaggattttgtgatcattgataatggtaagccttactttcaaagtctgataagctttttaaaaaattctgcttcctatgtgatgccaagcacttaagaagtactctataaatatttattgaattatctttgcttgctattcctgtttcattagtgtagataattactttctgttccagattatttcaaaagaaaatattccttaaactgttagcctttcagtaagagctgtacattttatatttgtaagtggtatatttcagatagaaatagtttgcttgccttttctgatcacaagggtaatatctgctaattataagagattcagataatggccttgcctggacagtggcctttatcacagtcctccaagcaattccacatctgcaaagaaacatgcttcttatctttttgccatatcatttcattatcttctctgcatcttgagtttgactcattttcttctaaaaaacttcttagataccttctgctagacagtagcctacgatgtatgatgccattgccttcttttttttttttttttaactcccctccctgttgcgggaagtcaggaaccctgaacggagggacccgctgaagccatggcagaagaacataaattgtgaagatttcatggacatttattagttccccaaattaatacttttatttcttatgtctatctttactgcaatctctgaacataaattgtgaagatttcagggacacttatcacttccccaatcaatacccttgtgatttcctatgcctgcctttaatctttcaatcttatcatctttgtaagctgaggaggatgtatgtcgcctcaggaccctgtgatgattgtgttaactgcacaaattgtttgtagagcatgtgtgtttgaacaatatgaaatctgggcaccttgaaaaaagaacaggataacagcgatgttcagggaacaagagagagaaccttaagctctgactgccggtgagctgggcggagcagagccatatttctcttctttcaaaagcaaatgggagaaatattgctgaattctttttctcagcaaggaacatccctgagaaagagatgcgtccctgagggtaggcctctgaaatggccgcttcgggggcagccgtcttttatggtctaagccgtagggatgaaataagccccagtctcccgtagagctcccaggcttattaggacgaggaaattcccgcctaataaattttgatcagaccagttgtctgctctcaaaccatgtctcctgataagatgttatcaatgacaatgcgtgcccgaaacttcattagcaattttaatttcaccccggtcctgtggtcctgtgatctcgccctgcctccatttgccttgtgatattctattaccttgtgaagcacatgatctctgtgacccacaccctattagtacactccctccctttttgaaaatcactaataaaaacttgctggttttatggctggggggcatcacggaacctgccaacatgtgatgtctcccctggacacccagctttaaaatttctctcttttgtactctgtccctttatttctcagactggctgacacttagggaaaatagaaaagaacctacctgactatcaggggctgtttcccccgatacctcccctccttcattgtccttttgtccaaagatcatgtctgtcttgtttgcaaataagaaggaataataggctaggctcagtggctcacaaggcctgtaatcctatcactttggaaggctaagatgggtggattgcttgagctgaggagttcaagaccagcctgggcaacatggtgaaaccctgacacatgctaattttttgtatctataagaaattagccaggcattgtggtgcgcacctgtagtctcagctactcaggaggctgaggtgggaagatcacttgaacctgggaagcagagattatagtgagctgagatggtgccaaaagaaggaagaatagtgtgccatttgttttgctaagtcagcatccttaatttctaacttttttcctttctttctttctttttttttaattgaggtgtgcactgtcatgcctagctaattttttttttttttttttttggtagagatggggtcttgctatgttacccaggctgatcttgatctcctggcctcaagcaatcctgctatcttagcctcacaaagcattgggattacaggtgtgagccaccatgcctggctcaacttttcctttcttttctttctttctttctttttttttttttttctgagatagagtcttgctctgtcgcccaggctagagtacagtggcgcaatctcagctcactgcagcctctgcctcctgggttcaagcgattcttgtgtctcagcctcccaagtagctgggattacaggtgtgtgccaccacacctggctaatttttgtattttagtagagacatggttttgccatgttggccaggcttgtcttgaactcttggcctcatgtgatccactggccctagcctcccaaagtgctggtattataggtgtgagccacttttcttggccactttttttctttttctcttttttttttttttttttgccttgaggtcttgtgacattctgaagctatgtgcttttctgtgaccttttaaaccctttgtattggccgggcatggtggctcacatctgtaatcctagcactttgggaggccaaggtgggcagatcacttgaggccaggagtttgagaccagcctggccaatgtggtgaaaccccatctctactaaaaatacaaaaattagttgagtgtggtggtgcacctgcacatgtgtaatcccagctacttgggtgactgaagcgggagaatcacttgcatctgggaggcggaggttgcagtgagccgagatcgcgccactactacgctccagcctgggcgacggagcaaaactctgtctcaaaaacaaaaacaacaaaaacaaacccaaatcctatgtattccatagctgtcttgtaaggaaggaatgaaccgatgggtctcttttctctttccctgtgtcatgtggtggagctgtgcctagcacgacttctttttttttttttttttgagacggagtctcgctctatctcccaggctagactctgtctcccaggctagagtgcagtggcgcaatcttggctcactgcaacctccgcctcccaggttcaagcgattctcctgcctcagcctccctagtagctgggactacagttgcatgccaccccgcccagctaattttttgtatttttagtagagacagggtttcatcgtgttaggatggtctcgatctcctgacctcgtgatccacccgcctcagcctcccaaagtgctgggattacaggcgtgagccaccgcgcccggtgcctagcccgacttcttgccccacattattgtgtgttcgcctttccctgctgcgccatcattgctcagcacgcctcaagatgggatgtggcagcaatggtgggccattctgtccttatgaagctagtgttattgactatgccttgctttttttcttcagagtcatttttctaggaacaaggacaatctcatacctttgcctccctgtctgagacccctgttttagctaacagcaagcttggacaagatggtttatcagagtcagggttaaagcctaagaagtgaagtgaaactaatgagccatctcagtgatgcagaagcctcatcttctccagctgtctgtggctctgggcttccttgtgttgctgtgttgctggcagccatgtggggatctgggccagagacagaaatgaaagagtggaggaagaccaggtacttatccctgatgcacctctggaagtgctggagttgtggatgcacctctggaagtgctagctaggctcattgctttttttttttttttttttttttttaagacaaagtcttgctctttcgatctcggctcactacaagcaacctccaccttctgggttcaagcgattctcctgcttcagccttccaagtagctgggattacaggcgcgcaccaccacgcccagctaattttgtatttttagtagagatggggtttcaccatgttggccaagctggtcccgaactgctgacctcaagtgattcgcccgccccagcctcccaaagtgttgggattacaggtctcagccactgtgcccggtctaggctcattgctttttccagccaatgctgatgactgaaagactgttttaatcttagaatggtgcagttatttattgagtgaaagttcaactgtctgtagctgtctcctcatctttcttgtcgttattctgtttagatttccagccccacactctcctctctgacttaagactctctgaaacccctttacttcgtcagtaaatctattctgggattgtaggtgctggttgggctttatggggacaaagggacccctaccctcattcacaagcacaggggaattgtcatgaggaagatggggtgagggagagaactccttgcgagtgatgtcacagtgggcagctttctctttgtagatccttgacagtcagatctcagggacagttccaaagtgtggggaaaacgagattagaactcttgggtggttttggatctgctgtttggtttttcctcatctagaactaaatttatataaaagaatacaacagtagaataatcatggcaactaagtttgttctgctgtcctggggcctcttcatgtattatctctacttactgcaacagctctggaggtaaaaggcgttaccttgaagaaactgaggctccaaggggtgaactgcttgtccagggccatccagctcgggagtggcagagctcagatctaggctcctgtctcccaccccaccgcccatgcccctgccttcccctgcaccagaacaaagccaccacccccagagggccgtgtgtttgtgcttttatttccctgaatggctccaggtttttgctttgtcatttctgtgcttgtgtcctttgcagagtctttggcttccttttatttttcctaccccagtagcatctgacgcaatgcctggggtctgggaggaagcagggttctttgcttagacatcttggttttcatctgttttacaaaattatccttggcctctgttctctttttccttttatttcctccctgaaatactggttctttaaggctatcgggaaaagaaagataatcctacccaagagtttgaagaaatgtaaaggagaagtgtttttagcaagcagctgggtttttagcggggtcgtttccacgctccgtgttgccctagtgaaagtggtttgtcttcctcacgactccaagggaactggcacataaatggatgcagtcaggtggccgttgagccaagggccaagtaaggcatttcgtcctcagccacgttgcccttgcctcatgcctgtatttctgttctttttttttttttttgagacggagtctcgctccgccacccagcctggagatctcggctcactgcaacctctgcctcctgggtttaagcaattctcctgtctcagcctcctgagtggctgggactacaggcacctaccaccatgcctggctaatttttgtatttttaatagagacggggtttcaccttgttggtcagtctggtctcaaacctcaggtgatccacctgcctcggcctcccaaagtgttgggattacaggcgtgagccaccacgcccagcctcatgcctgtatttccatgtcctgaacatgttacatttgcatccaggcccagctctgttccctgaggaggttggagttctgataccccacagaaggaaggagtcaaggcggggaggctgcttggaggagggtgcggcgaagacaaagaaatggctctacgattcttgggattgctgggaagctgttgcttatagggttggctctctgtcctctctgatgctccaaacaggtccccaggggacaggccttcccggggctgccactttctccagtgttaggtccatatccattttcctgtccccctccgcttgtcccagctttatcatccgagatatggggcttctttccaaaggtgaatttaagtttcaggttttcctaacagtttcagctgttaggcaggggcttgtggcaggaaaaagaagacagaaatttctgttgcccataggagggtgacggggtgctgggtaaataccagttacagggaagttccctccaatgagtagcctggcacctttctgcagggtgtcttctgagccagctggattcatcgtgttggcctgtgaagtctgagaacaccatctctctcgtctttcccctcctcccctcctctgtgccacagcaagaggcgtggtatactctgggtcctccctcatcacttacacagccttctctctgtgtttgattaccagaatgagccagccttgttctgagtccgttcattcatttattcattcaacaaccgttttgtgctaggcaccatggtaacctacatttcaaggctgtaactgctattatcaagccatttgcagaagtttgggtcactgatgtgcctttgacctgatgcccattttctaaacccaggcattcctcttgagtgatacagcatctctgtacctcttctccaggacttatggcttaggtttttgtttttatttttaatggggctttctggcaaagacctgaaagcctgctagacaaattctaaaagtgctgtaacactaacgcctaggtttcagttctgacttcatgcaaagaggatgcctgaaccaagctcctcactaccaggcctcattcttttctcagtgacttagatccctctccccaaccttggtatctgtttgctgttcctagcacagatcctcagcactggtgtattcactgcctctggctggagcccatttgactgttgtcactacctcgtccccctgcccttcctcgccagccaatgacttctcatctcttcccagcttgtcaagctcctggagatctcagagtcacaggccccacccagggctctgcaaaaatattctttaagggtgtgggcgaagggataattgttttatttttgagacagagtctcactctgttgcccaggctggagtacggtggctcaatcttggctcatggcaacttctgcctcccaggttcaagtgattctcatgcctcagcctcccgagtagctgggattacaggcatgtgccaccacgcctggctaatttttgtatttttagtagagacagggtttcatcctgttggccaggctggtctggaactcctggcctcaagtgatgcacctcccttggcctcccgaagtgccgggattacaagcctgagccaccgcacctggcttgaagagagaatttgaaaatagaaagttttttccattcatttcaccttttgaggctaacctagacagcttgaggtaatccacctgggcccacagtcccaggattatgtgagtcttcagggactctccagaaaccctcttgttgatatgggtgctggaaacttgacggggcttggtttagttcctctctgagctgccctattagaggaacttctggatagatgaaatcttccagggagaagttctgaatgttctgaatgttgctgctccctcctcctgggccttcttcactgggctggggctctgctttgaggccagagtgggaagactatttggaggtcacacgtgtttggcgtggcttagggggtgaggaagccttttatttattcttctgcctcttatctccctacttatctctatacccacacccctaaaaagagaatggcagaagtagattttgttgggctgggcatggtggctcacgtctgtaatcccagcactttgggaggctgaggtgggcggattacttgagctcaggagttcgagaccatcctggccaacatggtgaaaccccatctctacaaaaatacaaaaaattagctggacttggtggcgcgtgcatgtaatcccagctgctcaggatctcttgaacccaggaggcggaggctgcagtgagccaagattgcgccactgcactccagcctgggcaatagagcgagactctgttttaaaaaaaaaaaaaaaagtagattttgtatatgttttttgaaataaggtctcactctgttgcccaggctggtcttgaactcctgggctcaagcaatcctcctgcctcagcctcccaaagtgctggtattataggcatgagccaccacgccctacctagaagtataatgttaattgcagagttggttctagtggactcaaaacattatagtttgtgtacctcccttctacaggacttgggaatggaaagaggaattttaattgccttgcatgtgaatttttctttaatgcaaaattctttaagaggaggaaaaaggattctatttgctgtttctatcaccacctagagggctcacaggctgctgtgggggaaaggacttgggcatttgactaaagattttgcaattgatggtgggtgctctatcaggtatgtgctaacttaggggaaagctaaccagcttccagtttgtccccttcctgcagcaggaggtcctcctggaccatcccaggctctaggctgcccatggaggtctttccctgcagctcaccccagggtatgagtgccgtaatcctagaaggctgaggctgggctcaggtgcctcttgccccaggtaacccaagttcaggccagataaatttctccgttattatacagaatgccaggagttttccagaccctttccccttatcagtaatttcatgtccaccagagcagtggacaggcatcatgtaggtgttagacattctgaagcttacgtctagctaaggcaacacacatacacaagacaagattgaggacagcgtccaaagcaacaaacgcagccttcagaatagcatcagtcctcccggcctggttctagttttccttggagcttagttctagaatttcagacttgacctcttagcttatcaattctctatgctcttgaactccatcctaggtaggaaaaagtgaagggtgatctctggaaacctacgccaatttgcatagacccttctgataagtagagtgctttaatatacatttctaagtggggaccaggtacagtggctcacagtttgggcccccagcactttgggaggccaaggcggggtggatcacttgaggccaggtgtttgagaccagtctcaccaacacgatgaaaccccgtctctactaaaaatacaaaaattagccgggtgtgatggcgcgcccctgtaatcccagctactcaggaagctgaggcaggagaatcccttgagcctgtgaggctgaggttgcagtgagctgagatggtgccactgcactccagcctgggcaacagagtaagactctgtctcaaaggaacaaaaacaaaaacattcctgcatggggtgagggctcttggtttgtagatgatttgctcagggtcatgacgaactagggctggaatctaggttttgtgctcccaaatattttattttattttatttttttgagacagagtctcactctgtcacccaggctggagtgcagtggcacggtctcggctcactacaaactctgcctcccgggttcacgccattctcctgccttagcctcctgagtagctgagactataggtgcctgccaccacgcccggataattttttgtatttttagtagagacggggtttcaccgtgttagccaggatggtctcaatctcctgacctcgtgatccgcacgcctcggcctcccgaagtgctgggattacaggcatgagccaccacacccggcctttctgctcccaaatcttttgtactttctgtagtgtcatgcttttctcccttccacgtttattggttccctatctttacccagtgccttcttggatcactgctctgttagcctttggggagactaaggtgactaaactgtggtctcaggactggcagctcctaggaactcaggtcccccagaaattgaggtgagtaatttgctgcctataagccagatctgcttagacggtgaagtcctccttaaccctgttcagagcacagactgcacatacaaaactgcttggcaggtcggtcacagtggctcacgcctgtaatcccagcactgtgggaggccgaggtcggaggatcacctgcgcccaggaggtgaagaccagcctgggcaacacagtaagaactcatctctacaaaacaatagtaatagtaaaataaaactgcttggcaacgagcaggacaggcttgctgtctacagctgtgggcctggcctgacctacgctaagggaaagaccacaggggctgggccaagtgtggtgagtgagagctggggaacagacgtggcccctgcacagagcgcatttgttcctgctgatcccctccagcaataggggagttccagcagaagcagtggctgaaagaaacacagttggtgtgtttgttttggagggtaaggaggaggaaggaccaaagcagagggagtggaggctgtaaagagcgttgtaggaaagactgagactatgggaggggtagttagtactgagctcaaagtgccgaaagaggcagtggctattgcctgtaaaggacgaagaaagaagggagacagaaccaaatctggggcctcagaggattgggaccaggcttcccccaacaccatgtgcttgtcagcaccaggattttttgcctgactgccctctctgttacgttagcgtgagactttaggataaatcgaggaagtctcggaacctggcatgccacctctgaggcctgtggtccctcccctggtagctccccctgcgggcagggccctggtacacccctccatggatggagcagaatcacccctggagcccttgctccctgcaggatcacagggcacggagtggtccacagctggccctcagctccaggggctgccgtgtggcttagggagacttgcctttgctctacaactgtttaccgagcaggactgtgttctaggccgcatgcttcatgctggagacacagcagggagaaggcctcagccatctcctgtcatcaggggggactggcagaaggccattccctgttcaattatagctgtgatcattgctgcacaggcagcgggtaatgagagtgccctaaccctgctggcccatcaggggaagcctccctcccactgtggttatctgcctctcgcagcaggcagtgccttgctgtggagcttggcagaacatggggaaccttaggcaggtttcagagactccaccgtgctctctgtgaaatggagtggagggcgggaggagcttatggcagcagcaccctccctccctccctccctggctggagtctggttgctggagctgtctgtttgccttgtgagccctccccattggcgcaccctaggaccctgctgacactagtttttttgttgttgttgttttgtttttgagacagggtcttgctctgtcacccaggctggagtgcagtggcaccatcatagctcactgcagccttgaactcccccaggctcaagtgactttcccacctcagcctctggagtagctgggatcataggcacgtaccaccacacccagctaatttttttttctagacgtggagtcttgctatgttgcccaggctggtcttgaactcctggactcaagccatcctcccactttggcctcccagagtgctaggattacaggtatgagccaccacaacctgcctggcactactactaaacagtccctggtagtgtaattggaggcgacggcagaaatgcctcgaggggacaaggcctgtttggagttgaattaaatgcctccttgcctggcagtgaattatcagtttgtagattatctgtgtttgttctttacttaccttttttgagcatttactatgggccagactcagtccttccctcaaagggatcctggcaaagtctttctttctttcttttttttttttgagacagagtttcacccttgttgcccagactggagtgcagtggcgccatctcggctcactgcaaactctgcctcccaggttcaagcgatttcctgcctcagcctccctagtagctggcattacaggtgcctgccaccacgcccagctaatttttgtatttttagtagagacggggtttcaccatattggccaggctggtctcgaactcctgacctcaggtgatccgcccacctcggcctcccaaagtgctgggattacaggcgttagccaccgcacccagctgcaaagcctttcttttttcctggcttcttacctgttgaccttatggagagagaggggcaggaatacattgtaaaaatcaaaacagaccaccctgttttatccagtagggagaaagagaaagacctgctgacttaccgaagtgtttggattgcccaggtagcttgataaccccagagaggaggaaacgagacgtacctgggctttgagttcctagatttcttttttgagggcaacattcttaatccttcaaacccatctttgtggctgtgtgtcctcagggtcagtagcagccttaggcctgggcacatgtggcccctgttcagactctacacctgaggggtaccttcctccaaattttccaggtcctcctccagtgcctggggctggctggggctcccagtaccattctggccacgggtgttgcaaacccaccctgggatcctttggggtactctccatccctctacgttgcacagggacaacagctgttctgtggagtcgtcctggggcccagttccgggagatggctgcagtatttctttctttctttcttttttttttttttttgagacagagtttctctcttgttgcctaggctgaagtgcagtggcgtgaccttgactcactgcaacctccgcctcccaggttcaagagattctcctgcctcagcctcctgagtatctgggattacaggcacgcccggctaatttttgtatttttttagtagagatgttggtcaggctggtctcaaactcctgaccttgtgttccgcccacctcagcctcccaaagtgctgggattacaagcgtgagccactgcgcccagcctgcagtatttctttagtgggaatcatgtgagattgggctgccagaatggtgctgatgcactaattttgagtgactcaagtttttatatagacgagtccccataatgtatttgtctggggccccatgcatcctagatctgcccaggggccacccattgggccctctagctctgcttagcagctctgcgcctgaaccagaaaagagcataagggcctattgtgtgtccccagggcctgaatggtactttgttttctgcctttggcgccacaggccaagcggctttactactgctgctgccgttctaacagtctcgtctccaatgagaaattcattcccacccgggtttcacgttgttttactgaatatcctgtgaggaatgggctttgagccagcttggggtctcgtgtgggttgctgggtgggggcttatcactgcggtaatgagagaaggagccttccctacccagtgacctcagctgtggcaggaggaagcccttcgttaacattgaactagggggctaaatggcaggaagggaatgtggtgggaattgttgggagacccctccccaccccagggtgaactgaggctgggggcagctgggcagaggcaggagctgatagtatttgccgtcctcttcccttgctgcttcttgccctccttccccaaccatccccattccctcttggcccactctagtggggaagcaggaaaaggatcctgtgaatcaaagctgcctattttgtgttgaggtcaaaggaatggaaagggtggagaggaaaccagcggagagcaggttgttagatttggaagtgcccacaggaagcggctgctcagctgaactccaccctttacggctgtcagtcacacagcgctgaggtcagccatcccacctactcagtgcaggaatcacgccgctcacctcgctgcctcttcttgtgtcccaaggtgaagaagcttgtttgttttattccaaaactggcattactttctcccaggccagcaaggagtgtcttcctagactggtggttctcaaactagggtccccaggcccttacacctcctcaagtctgttccaggggggtctgtgagtcaaaaggatttccataacaataccaagaggttctttgacttttccagtgtgttgacatttgcacccatggtgcaaaggcagtggtgggcaaaactgttgggacatctaggattgcgatggggattgtaggtcagtgtggcgagtattcccatcttagcaacaggaagtctctgacccatgaacatgtggtatctttcctttcctttagatttttaatttcttttgagggtcttttatagttttcagtgtataaggtttgcttttcttttcttttctttcttttttcttgtcttgctctgttgcccaggctggagtgcaatggcgcgattttggctcaccacaacctctgcctcctgggttcgagggattctcctgcctcagccttccgagtagctggaatttacaggcatgtgccaccacacccggctaatttttgtatttttagtagagatgggggtttcactatattggtcaggctggtctcgaactcctgaccttatgatctgcctgcctcggcctcccaaagtgctgggattacaggtgtgagccgccatgcccagcctaaggtttggatttcttttgctaaatttgttcctgagtttgtattcttttcaatgcttgtctttctattaatttaactttatattgtttaatctcttcctctttacgccttccttcttaactagactaaagacagggatgtgtcttatttattattacttttttaaagaggcaagctctggctgtgttgcccaggctgtagtgcagtggctatttacaagtgtgatcatagctcactgcagcctcgaactcctgcctcagtatccagagtagctgggactacaggcatctgccattgcacctgggttatggtgttttttttttttttttgtccaggctgctcctgtaaagaaggctggtaattattatccctggtctagtgggggaagaaactgaagcccaggatggcggggtgacttgcctcttggcacagcactggtaacagtagcagagatagggccatgactgtctgattcacatctcgcagctccttccagttgccatcctacaagggactgacattctgttcttagcctccctgagcttgtgtctaggtctctacctctcttgtattgaggccctagggcatgatggaagagagaaggactaaggctattattacaagggctgaccattggggtcatttttttggacatctctaccgtgctagactctcgtaggtatttcaaaaatacgttacctcattgggttctcatagcaactccacaagatggctcagatcattctgcattttatagatcaggaaactaaagttcagaaggttacgtaaattcccaagttgaagagcgacttaagtgttggagttgcaattaaacacagttcccagagctcaaactgcagtgctgggaggggacaacagtgggtttatgtgacttgtgtggaggaggaaggacactggggcattctgggacactgtgagactgtcagcactagcgttgggttgggtcaatccagagcctttgctctctggcctggagctggtatcacaaagtggttggtttgttgcatctttctaggggtcatggacagtagaggcctggaaaccttagcccctgtgacccctgccctgcagccttattctttgacaattaactctgggggtggatgctaatttgccacatgcagatcttgcttccaccggccgtatggtgagttcttaaagtgtggggccatcacgctctctctgcttccctatagcacctagtatcttttgtgttacatagtggacagtcctcacaagctttccgaataaatgaaagaaactctacttgcttgtcttgctccatagaagtcatacgacatcaatgtatgtgtggctagatttggggtggcagaggagaatgggggaccaaggccattagaagggtccatccagctgccctgatggcacaaggagctttctgcaggatggaccatgagccaagacaaggacgagacagatgtaagcactacccagagctgagcacagagcgactcgttctccacctggaacctccagctggaagcctggttctgtttgtcacccaggactaacagtgttgttgagcatgtgagcgactcgttcgccagggcagcagcgcataaccttgctaccgtttaagccagacacttactccccccgcttgtgtttttctcagatgaagaaaacacctataaagtcgtcataattgttggtttcagggtattttacaattgcatggaaggttaattgttgaatttttcaacaccgggctttctgtgtaaattgaagacagcatggatcatgctgtgttgctctgccgcagtgagtggtcaggcccctgcgtccccttctgctcatacccggtgttccagccataccaaactgcatggtttgtgaccatacaatggcccgtgtcctggccacaccactctcttcccttttcccttcccgccggtcctctgtcactcaccttgtctgtgagtctcaactcccatggtttcctgatacctgagtcccctcctcccatcactagttcagcactggcatttgcttcctttggctcccaccacacttggtttctcctctttgtttacgtgtctagtgccttccctgacgtgagctcctggagggcagggactgtgtcttcttgtccgctccggctccccagtgctgatggagactcaggcaggctgcgctggaccaaataggacacgtggtggtgatgacatttttggtccaatccagtagcagcctgtgaagtgctcattgcaggcagagctgagtaagctgtgaccccactctcaggcagcttctcttcgggggggagcggcagggacacctgttccgaagatcatgtcctgcatgatctctgtgtgctgaggaatgaagcatgagtggagatggctggggtccatgacgagtatgaccttgggcaagtcactgtgaatggcactcctgggtgaggcttaggctgagtgcaggctccatgcagatacttcctccagctctggccccacaccagcagcacaccagccagaaggcaaatctcaaggcgagtacgggagttggtggcacctctctgcctccagctgtggaagaggcacccggtgcctgtctgggtgctaggataaggacaagaattgtcacaaccagcagctgtagcactggacacggggaacagggactttctgccatttcccactttggcattccagctgatcctctactctttattcccagatagggcccctggtttgagtctcattctgagctcaccttccgggtagcccccttccttcatgggctggaagggaagcagaaagctgcttattgtcatcttgggaaaagatagagaagaggcggaaacagaggtgccagtgctggtcaggatcctggacctgaaggaatgtgcaggatccctccaccctgacttttcagttaacgcgtgttctcggggacatcggggtgttcagacctctgcctggcttggatcagggcgcacttacgttcccgtagcaggctcagcctacccgctctcttcagatgccagcttctgtcacacagtgagcgcgccgaaccatgcaagacctccgaccaattagcctcgggttcgggaggccaagcaaaagatctaacagtgagctattgactgtgcctcctccaaggagctggtcagagctcagcctggtgttttgcttccttgcgatggtggggtggtacccagtaggtgggaactctgttctggcttcttactggggtgccctttaggataacactttgttaaatgaactgagctgggtggtttcatagtatgttcaagcatgtgaacatctgcttgctgataaatcgtactgggtcaccagctcacactaatcaccaggtaacatgtgccctggtgagggatccagtcttctggccctgtggggagacaggcccatgatgtcaccagttcccaggtggacaacccaaggcatagtgaggtctcggcaggaaggaggaagacattagactccttcttttttcttctccccattgaatcttctgctcctttccttaggccagatgccctgtctctctcctggctggctttcccagccctggccctggccctcccttctttgtgaaactcgaacaccactgccctttcatctttccaccagaacttgtgagcagtggcttttgaccgccgctcttccagctcacccctgacctagtgtttgtttttttatccttccctcagtctactcaaggcccacccctaagccagagattggctcccaagcagcctctctctcctgggagcggtaaaggaggggacagttctggaaagtcattgacaggggattaacctagaacatcaattataaacaggcagcaggcctcaggcccagacttgggtgttacaggaacagtgtggcctctctggaactctgcagaccaactgccgtggtaagagaaccgactttcagaggcctctaggcactttgtcctgggtaggggtgcccacacatcctggccattgttgctcttccctctggaacttggcagctttctagcagttagaagagcagagggtagaaggatgggaacagtccttagagaacaggaatctaggggagggttggactagatcatttctcaagagctgtggggactgttctggtcaggcatgggcaagctgaggggcaggaggtaggcaaaccctacttgacctgagaacagatttgttgttgttttgtttttgtttttgagtctcgctttgtcatccaggctggagtgcggtggtatgatctcggctcactgcaacccctgcctcccgggttcaagcgattcttctgcctcagcctcccgagtagctgggattacacgtgtgtgccaccacacccggctaattttgtatttttcgtagagacggggtttcaccatgctggccaggatggtcttgaactcctgacctcaggtgatctgcccgcctcggcctcccaaagtgctgggattacaggcgtgaaccactgttcctggccgagaacaggttttgcctgagaccttggacagaagaccttggccatggatccaagagctctgggccagaacacccttgcatgatggtgacagttgagggaaaggccacatggttccttgtgtaaatggcatggctgccagtggtcatggggaggccctgctcatagttcagcaccagccggcccttcgtgtgctgtgctccagctccccagccggctcagtccttcacaaaatgccctggagttacagaacagaaaggcccggctttcctttaggaatctgggaaataggagggctgaggtcatgctctgttcaacatgtgagacctcccagacagcagtgcaggaaaaacatgttactacccgtattttgggagaccagacctctggcgtttgagtaggactcactgctcagatctaaggggagagaacatctcccattttgaagaaaaccttttcctcagtttaggaggaggagaaactgatcaggttccaaatggcctcttgttctttaactgcaaacgggccaggctccctgccaggtcatgggataacaatccaaggagaggggagaaatgcagtgtgcatgtgtgtgtacatgggcatgctcgtagggggaaagactggggggatggaggtgacgtggacatctgtgtatgcttcagctctatttccctctgcttagtcccaaactgctcgggattagcaattgttaagaacatgcctttctccccaccccgggagttctaggccaggggtggagggattgagcaccgtggctttgttctctgtcaggtggtgcctttctctgtgacaccgagggagacctgccatcaggagggagtctgaggccaggagacagtacttaccgatcaggatggatctttggtcttgtttgtgtgcttggtttcctggctggaatgaaatgtcagtttcatgaggacagggacctgttctctcctgcacaactttctctctgatgaccgacagtgcctggcatgttgtaaaggctcgttcagaagtgactgaatgaatgaatgcatactttttaggcggggctgcatatcgttcccttaaacctcctgattcatcttccgttgcttccgtgtcagcttctcactgggtcattgtctgctttggtgctgcccttccccacaactttgagagttcatgttactgcaggctccccgcccgcccacctctgcctgaaacttctcttttgggctcctgtgctgtgacatactagcagtatttgtttgcccctcttaagaccatcccttcagtttcattcctgcctcagtttctcctcctcacatttctgctgttccacctctgctcctgtgctcttctcaggaaagcaggtgagtggtgatgccctgggctaagctcgccagggcctgggcagcccaggcacccgtggttcgggtggggagggagcatgctggtggccggagctgggcttgtgggcagcagccctccccaccttgctgaggccaagctctttctcatggctttggctgtcacttctatgctgatcacccccaaatcattgtgtctatatttctctattggtgcttctgaccttccaaaatctgatcccaccctggcagtcagaccttatttgatgtcaaggattattaatttgtagcatgtattacatccctaatatggaccagttcacatgcattctcatatttcatcctcccaatgaacatacaaagtcaaataattattcttattttacagagtctcagacaacttagttcctctaggtaaccagattaattagcattagggggttgtgatcaggatttgaactggctccactggcccctgaccctgaacagagtcagcttggagtccgcccttggagacgaggacagccggtcctgtttctccctctcaccccagtgcactcacacagcaggcgttggcacccttgctaagggccaggccaagcgtctcctctgtgagccttcacttagctctcctaagctgctcggcctgcctcctctcccttttctctaacagcagtgcctttgcacacactatgtgtttgttatatgttggctgtgccagtcttgcctcgtcagcagatagtgattttcttaaaggcagaggccatgttttatatgatcctccatccctcaagtgtgtgttacaggcagtttgttgctcagtaaacacttgatacctctgatgaggtgaaatctaatcacagtcctttgcatatgtattgtggtttacagtttctgaaaccgaagagccaatttgaagtttcctgtaaaacagatcccttaattgtcagcgctctgtgctgagagggataaatctgttttgtagacggactaacaggtccagaggtagagtgaattccccaaggtcatatgatggatgatagcaaagccagaacttgaacccaaggtttaactcttaatgccgttcctcttaatgccgttcccttcccacagaatcacagcagcctgtggtccagacttggccaggtgacccctgccaggccttccatcccacttagtcatacagttccttatttgtatttgtcctttctctttcattagaactcgtgtctttttgtgtgtgtgtgtgttttgagacagggtctcgctctgtcacccatgctggagtgtggtggcacaatcacagctcactgcagccttgacctcccaggctcaggtgattctcccacctcagcctcctgagtagctgggactacaggcgcatgccaccatgcaaggctaatttttgtatttttttagaggcagagtttcaccgtattgcccaggctggtgtcaaactcctgggctcaagtgatctgcttgctttggcctcccaaagtgctgagattacagacatgagccaccgcgcccagccttagaatgcttgtctcttgagggcagggaccctggctgcttttcccattatccttccaaagctccagctctggggccatgaaccagaaatcattccttcaaggatgttgacacagtgagtcacctgagaaggggcagggtgcaggaggggtggggcaggagatcaggaactggtgtgggacattaggggtgggagataggccagaaagccccatgctctgtgtaaaagcttctgtcaaatgaagatgtgcttgtcctacctaccaggcgaggttactcttagtagcaagtgagagtgtctgctaaagcgccttctaaactgcagagcactagcaatattgttgttaaatataattatagtctgtagctgggcatggtgctgggtgtctgtaatcccagctacccgggaggctgaggcaggagtattgcttgggcctaggaggcggaggttgcagtgagctgagatcgtgccgttgtactccagcctgggtgacgaagtgagactctgtctctaaataaaaaaaaaaaaaatgtatatatgtgtgtgggtgtgtgtgggtgtgtgtatatatatatatatatattttttttttttttttttttttcctgagatggagtctctcactctgttgcccaggctggagtgcaatggcaccatcttggctcactgcaacctccgcctcccaggttgaagtgattctcctgcctcagcctccccagtagctgggattacaggtgcctgccaccacgcctggctaatttttttttttttgtatttttagtagagacagggtttcgccaagttggccaggctggttttgaactcctgacctcaggtgatccacctgcctcggcttcccaaagtgcaaggattacaggcgtgagccaccacgcccagccaaaaaatatattttttaaaataataataattatagtccgtagggatgagctcaacaacatggttggatagaatcatactggccttgtgagtattgaggagacaatcaggatggtgcctcacccaaggcctggcactccagctattatgaattattcttgttttcataattattataagacatgccctcttccttcagattggggaaaggagttggcagtgctgagaatgcatcgcttctggattgggactaagaagatgggaaaggcagtctggccctagggctttcgtagatccactcaccaccgcaggtccccgactctgaatacctccttcctcccagtgggggttttcagcaagctaatttctcacccctgaggaggaactgttatattcggatgaacacccccctgctaatgtggagcagaaaagtaaggcctggcgagtcagcagctgctcagcaggtggatgggctgcggtggtgtagcgggtaggcgcctgacagcccggcttgccgcagccgctgtgcttccctcccatccctggggtgtgcattttagggtaaaggcaaactggaagctcttgctatttgcagaactccaaaacaacaaaacaaaatgtccactcagctgggggttggctgggcagcaccactgtgattacacagttagcctgggggaagggctgtggtcagagtttgggggacacacaggtgtgactgtgatgtgatacagctggaggaggaagaggagggtgtgatcacaggcccgggagtggccagggcaagagtgatggtggaggagagtggctgaggttggcaggcagggaggagagattggtaactactaatcactagcatgatcagtcttgacaatctatctacaagggactcccaggtggcagggcaggacctgaggcacagctcggcatgacgggcagacaggggtctacgtggctttgagctctgagaccataggcaagctgttcatctgggtgtctttccatgcttacaataatattccccttacaagccctctgatgattgagatcatagaaatcactcagtgcagtggctggcactcagtagcagctcacacaaatgatcagcaattccgacacttgctatgtggccatcacagtaaaatcagcaatagtggatgcccagagctgcatctccgggaagcctctgagccagtcagtgtttgtgctcaaactccaaagcataggatgaaaggtcagatcatggggctatgaagatatgttctcctaggagtcacgaatagggagagaaaacagcagcaaacacagtcaaggccatgtcctgcctgggttgctgtttactttcctcttccaggaactgaagctgtttcccattggatttctttactatcgccttggctcatggactgggtactttggtaatcagttcgcccagagaaccaggctttcacattgacctaggttccacagtgacttcctccacgggatgtcggggtgtgtcatctagcagaatagcagtcaagactacccaggaatggttgagggttgcacactatttttaataaattgaattaaatagccaagaaaagtcagacacccaacaagggaagttgaggcaccaagcgacagtggaaagtcattactaccactaggcttgaaggggtcaggagaagaaatagcatttcctggctgggcgtggtggctcacgcctgtaatcctagcactttgggaggctgaggcgggcggatcacctgaagtcaagagttcaagaccagcctggccaacatggcaaaaccccatctctactaaaaatacaaaaaaattagccaggcatggtggcaggtgcctgtaatcccagctactccagaggctgaagcagaagaattggttaaacccagggaggtggaggttgcagtgagccaagatcgcgccattgtactgcagcctgggtgacagagcgggactctgtctccaaaaaaaaataaataaatagcctttcctgcaaacaccagtgagggctgaatagtggacactgggatgccagcaggaactgtcatagcgacaagacacagcctgggtcaggatggtggcatcaaagctggtagagagtgaggaaggcacaccccacgttctctctccaccgcctcctacctacccttgtctcccgcctgtgcctctgtctcatcggctggacctacaggaaaccagccaggaagggagcccaggtgcctccacccagagggctcagccccgctgggtccagagaagggcatacagggaggccgccaaccaggtagcctttccccaaaaggcaaagctgtggaggaggcatccactcagcaggtgtggaaagcaggggggatgagagctctggcatcctagggtctgagcggctgctgctgctactttttgggaaggggctgccaaatcaaaactagttactagttcaaaatttgatcataaagggcaattaggaaagataaggaaataaagaacatccagattggaaaggaagaggtaaaagtatttttattttcagttgacatgatcttgtatagaaaaacctagggaactcattaaaaatctatttgaattaaatgagttcagcaaggttgcaggacataagatcagtatgccaaaatcaattgtatttcagtagcagtgggcaaattgaaaatgaagaaaacaattccatttaagatagcatcaaaataaaatatttgggaataaatttaataaaagtgcaagacttatactctgaaaactatgaaacattgttgaaaacaattaaagaagacccaaataaatggaaagataccccatgatcatggatcagagacttaatattgttaagatggcaatacttcctgaattgatctgcaatccctatcacaatccaagatgccttcattagcggaaattgacaagatgatcctaaaattcacagagaaatgtaagggaaccagaacaaccaaaagaatcttaagaaagaagaacaggctgggtgcagtggctcgcacctgtaatcccagcactttgggaggccaaggcgggcggatcatgaggtcaggagatcaagaccatcctggctaacatctctactaaaaatacaaaaaaattagtcgggcgtggtggtgggcgcctgtagtcccagctagttgggaggctggagaatgacgtgaacccgggagtcagagcttgcagtgagccgagatcgtgccactgcactccagcctgggcaacagagcaagactccgtctcaaaaaaaaaaaaaaaaaaaacaacgttggaggactcacacttcctgatttcagaatttaactgcagtgtggtactggtgtaaggatagacatatagatatatagatcaatggaatagaactgagagcccagaataaaccctcacattaacagttaattgattttcagtaagagcgccaagacaatttaatgggggaaagaatagtcttttcaacaagtggcgctaaaacaactgtatatctgcatgcacaggaatgaactggaccccacctcataccatatacaaaaattaattcaaaatggaccaaagacctaaatgtaagaagagctataaggagaaaaataagtgtaattctttgtgaccttaggttaggcaatgattttttagatacgacgccaaagcacaagcaataaaagaaaatgaactgtacgtcatcagaatcaacctttgtacatcaaagaacactatcaagaaagggaaaagacaacccacaaagtgggagaacattttggaaatcatctatgtaacaaggaacttgtatctagactacctcaagaactcttggctgggtacggtggctcacatgggaggatggcttgaggttgggagttcaagaccagcctgggcaatgtcataagaccctgtctctgcaaaaagtaaaaaggaaaaaaaaactagctacttgggaggctgaagcaggaggatggcttcaggagcccaggagtttgaggctgcagtgaactatggtcgtgccactgccctccagcctgggcgacagagtgagactctgtcaagtaaaatcaataatattatgggaccaccatcgtatatgcatttcatcattgactgcaacatcgtgtggcacatacctgtagtcatatgatgggatattatttagccatacaaagaagtgaagtactggcacacaccacaacacggatgaaccttgagagcaatatgctaagtgaaagaagccagacccaaaacccacataatttatgattctgttgatatgaaatgtccagaattggctgggcacggtggctcacccctgtaatcccagcactttgggaggccaaggcaggtggatcacttgaggtcgggagttcaagaccagcctgaccaatatggagaaaccccgtctctactaaaaatacaaaattagccgggcatggtggcgcatgcctgtaatcccagctactcaggaggctgaggcaggagaatcgcttgaacccgggaggcagaggttgtggtgagccaagatcgttgccatagcactccagcccgggcaacaagagcgaaactccatcttaaaaaagaaaagaaaagaaatgtccagaataggcaaatccatagagactgagagtagatgagtggttgccaagggctgagggagctaagggggttggagcatgacagctaggggataggaaatgttctaaaagcggattatggcggtagatgcacatatctgtgaatatatttaaaaagccattgaattgcactttatttgtttcttgagacagagtcttgctctgtcgcccaggctggaatgcagtggcgcaatctcggcttactgcgacctccacctcctgggttcaagcgattctcctgtctcagcctcctaagtatctgggattacaggtgcctgccaccacgcccagcgaatttttgtatttttagtagagatggggttttgccatgttggccaggctggtcttaaactcctgacttcaagtgatctgcccacctcagccttccaaagtgctgggattataggtgtgagccactacacccggccattgaattgcactttatgtgtctcatctatatggtatgtgaattgtatctcagtaaagctgttaaaaaacaaaaccctggccctgaagggcagcgcagtcggctaaaagactgtgatttaatgaggaaactttcccaccgggctgtgaccgctggccctggctccctttggccgggtggaggtgctgtctgccactgagggccctcagctgctttttcaggatctcagaacatgggaggaccccagctccagaagaaaatcttaattccagtttaatcttaattccaatttaatttggttgagttaaacatttttggaactgtactgtgagctaggcaccaggctagctgctctcatgaaaaaacaggggccctggagctgggcagccttaattattcttgagtttgctacttcctgtgggtccttcccagcctcaattttcttttcagtaaaatgagggttgataataccccatgagattgtggtgacaattcagtgggctaaaaggaagatgcctggaatattgtaggcagaaaatgaaagtttctttccagtgctcctggagcaagttatctctaccaagtggacataacaaagatgagttagttatgtctgcccccgtagagctcaaggctggatacatgacctgtactcgctaaccagggcctggggagaagcaggccaggaggagggtccctgtcttactctggtcctgggttgggaaccggggaaggcttcctcagggagggggcaatgaagtgaggctttgaaggaggatagcttttcgcatgttgtattttattcgctttttgtttatttattttttgtaggcaggtctctctctgtcgcccaggctggagtgcagtggcataatctctgcttactgcaacctctgcctcccgggtttaagcaattctcctgcttcagcctcccgagtaactgggactacaggtgtgtgccaccacatccagataatttattatatttttagtagaaacggggttttgccatgttggccagactggtgacgaactcttggcctcaggtaatctgcctgcttcggcctcccaaagtgctgggattataggtgtgagccactgcaccccgacttagtcactttttgaatagataatcaagtacatggtgccaattcaaaagggtcaaggctgggcgcggtggctcatgcctgtaattccagcactttgggacgcctaggcaggtggatcacctgaggtcaggagctcgagaccagcctggccaacatggtgaaaccccatctctactaaaaatacaaaaaaatcagccaggcatggtggtgcgcgcctgtaatcccagctactctggaggctgaggcatgagaatctcttgaatcccgggggcagaggttgcagtgagccgagattgcaccactgcactccagcctgggcgacaagagtgagactccatctcaaaaaacaaacaaacaaacaaacaaaaaacaaaaggatcagcagtgaaagagaaacctttcccagaggcagccactgttaccagctcctgaagtgtcattctagaaatactctatgtttatgagtgtatgtgcgtatatataggcggacgcttctcatctaggcagattttcacagcatccacattgtggtccgtggggatcaggggcctcctgctaaggtgtgggttaggcttcaggtgttatgttcttgctgctttcgtgtcttgcggtcaggttcggcataggccctctcatcagtaagagtgaggcttcattttcctttagttccccttgaagggagccagcggcgctgtccatcctccttgcccctctgctcccttggcgtgccctctcccagggatttcctctgtctttctcctttgttccccgctcctctttctcgtttgcttgctcccttgtttgggtgcagcatattgacagcagcttcctaacaaagacctttgccttttcttgttattttactttcatacatggttgatagtttagctggatagagaatttcaggttggggccaggagccatggctcatgcctgtaatcccagcactttgggaggccgaggcaggtggatcacttgaggccaggagttcaagaccatcttggccaacatggtgaaaccccatccctactgaaaatacaaaaattagctaggcatggtggcacatgtctgtaatcccagctactcgagaggctgaggcagaggattgcttgaacccaagaggtggaggttgcagtgagctgagattgtgccactgcactccagactggatgacagagccagactgtctccggaaagaaaaaaaaaagagaatttcaggttggaaacaatttttccttgacaagtttgaaggattgctttgcacttttctaacttctgaaactgctaagaagtccaaaacctttctgatttctgatacttttgtcttttttttctttttaccctcctttgggaaagcttacaggatctgaaattggacacagtgccttggtgtaggcctgtgttcatctgtttcgtgaggctctcagcaagtccttccagtgtggaaactcatgtcctatcctgggagtttcttgaaacattccttttcttgccctctgttttttactgttctgtctttctgaaactcctattatttagtttttggatctcttggactgaccctctaatttttttccctttttcacctattttccatctctttgtctcttttcttcagtttctagaagatttccttttatctttcaacctttctattgctttgtcttattgtattttttaatttccaagagcttttttgctccccaaatggttctttaaaaatgtgtgtagcatcctatgttttcactgatgtaatcgtttcttatttctgtgagaatgtgaatgccatgtttgtctctaagttttcttctccctgcatagttggtttcctccaaattgctttctctgctctttcctttggtctccatcctctttgaatgaatctgcccagggacctttggttgcccactcataattattaggagggtctaaaatgctgcctgggagctggagcaggtgggggtccagttctgagtttaccagtacatgatctgggcaggctgtttgttggggaacctcagtgtcaacacctgggagctcagttggggaagggggtagcatgcaaagagtcacgtaacctgccacccccatttttggcaaggtccccaggccctcaactgtgcctcgaatttcccagtccagagaccccacacttttccctccccagaaagtaaacctctgttcttccagggctggagaggggaggtctctggcatgagatgggggaggtaggggtctaactgctatttttttttttttttttcctgagacggagttttaactcttgtcacccaggctggagtgcaatggcacaatctcggctcacttcagcttccgcctcctgggttcaagtgattctcctgcctcagcgtcctgagtagctgggactacaggtgcatgccaccacgcccaactgatttttgtatttttagtagatacggggtttcaccatgttggccaggctggtctcgaactcctgacctcaggtgatccacccgccttggcctcccaaagtgttggcattacaggtgcgagccactgtgcccagccctgattgctttttgaaagctttcagcctgccctctttatacacggcagcccgttcagcccattgtggaggtgggaggcctggagctgcagttccctggcctttggaggattcctggtggatggtgggaacccgggtgttctcagcctgctccagacccaggctgtgaggtcagctgacgcgagctgcgctccagcttctgcagtcatgttgctgttgtctcctctcctgttctgcccttgggggttcatagctttaaaaatatatatatatttgctgaagtcttagtgggatttcataagggagggagaaaaattagatgcatacctgagacaggagcaggacttgcatgggcaaaagctgggacgggaagggtgttctaatggtagagggagtgctctgagggagaggggcaggtgctaggatttctgagaacaaagaggaggcagctgggctgcagctggagaatccgggaggctggggcatggggggacaaggctggacaggcagggtgcactaattttgggggaggtccccaaggagacttgagtttcccacctacagacagtggggagtcagagaattaccccacttttcaggaagagtgccgtcatgcctgtatttggggatgctagctatccctagtacctaatgtggattggtagctagagctgtggtaatgagtaggaggtttttacgatagttaagtagtaagaagaggacatttcagggtcctcttcttagaaatgaaaagagggaaggatgtgagggattaaagaggtaaaactgcccagacttcttgaccagatggtaggtgagggaggggaagagctaaagaagaccctaagcttaacccttggtgaccagggagagggtggtgaggaaggaaggaggaggtgtctggttgggtttggtgtatgtgtgcagtttgggagggggagtgagggggtagggggcgggggctaagttctgctatagaataggcatttgccatgtccaccaaaaagcgtgattttacacccccacgcttcaacctccaagtgcctgtgttgatggagagagagaaagaaggtgttgagagcaggggtaaagaaatcagtcccttagaagacaaaagaataattttccagttgttaaatgagattctcaaaagaatttttatgttgatatcctcaaagattaattcatgttgcagaatgtcattggaactaccttaagacattgatagagtgcctgtctgctgtcttccttagctcatcctcatgttttgatcaaattaagtacttggacaccaggtctgtaaaaaagaaaagagccttctttatttgggttctgtaggcaaaagggagagtggagaagcgactctgtctacgctgctcccctcactccccgtctctgggcccttctgggatttgcatgccacccactgctctgtcaggagtggctcttagggaagtgaggaaagggccttgattatagtgtttgccaatttctgtggcataaatatgcccactgtggcccgtgtcaggctaccaacgtgatgtcatagcacagagctggagtcaggcaagcccgtgggagtgagtcgtgccctggggtcacagtgggggtcctcactgacacggtgcagctggacagcagaatctcatctttcaggtcgtctgacttgttctaagggtctgtcagggttgaatcatgcttgccaagtagcatcttaaaagatatttccactgcagcagccccagcccttcaacctgggcttctgtggccttctaattcttccttctctgcctcccctccacccacccccacatcatcagcagcagatccaacatgaataccaaacactcacagttaatactaaaagccaacaatttttttttttttgagatggagtcttgctctgtcacccaggctagaatgcagtggcgccatcttggctcactgcaacctccacgtcctgggttcaagcgattctcctgcctcagcctcccgagtagctgggaagctgggattataggcgcccgccaccgtgcctggctaatttttttgtatttttagtagagacggggtttcaccatcttggccaggctggtcttgaactcctgacctcatgatccacccaccttggcctcccaaagtgctgggactacaggcgtgagccaccgcgcccggcgacatttttcttaaagttcaatctctcatctctgatgcagctcgcactcattattgccatccttggagcagctgtggcaaacgagtagcttggatgtcagtaggaagtcttgtctctacaggctgacctgcctggactgttgctttgcccttttggttgtgcgttctggaacgtgatgcctgtgcttgtcagccttgatgagtcacattgaaaaagctcttagtcatcccaggccctggctgagtcagtgtattgggtgacacctgtggccaagcactggctgttttacaactgagactgtcccagaactcttaggcactctggtctcaggggaagtgttcttcatctagttcaaggccagtctttcacccgagcctcgcagccttgttcccggactcgccccaccttttattctcatccttccttcttcaacttgtcattccctctcaactccttccccttcctcttcctataacttgctaaacatcctcccaagcgtctgccatgggtataacagagaatggattcatgcctagaatacataaagatttattacagctcagtaagaaaaagacaaccagcccagcagaaaagtgggcaaatgatgtgaacaggcagttcacaaaaggaaaaacctaaaaatatatccacaatcataagaaaatagccaacttcagtaataatcaggggactgaaaattaaaatgataccattttatactacaaggttgacagaaatcaaagtctaacaatataacagttggtaaagatgtggggagatagacattctgttgtatttctagtggctgtgtaaattattaggataactaccttgagacttatttggcaatattgatattaaaaacttgcctattggctgggtgcggtggctcacgcctgtaatcccagcactttgggaggctgaggtgggtggatcacctgaggtcaggagttcacgaccagcctgaccaacgtggtgaaacccgtctctactaaaaatacaaaattagtcgggcatggtggtgcattcctgtaatcccagctactcgggaggctgaggctggagaatcgctcgaacccgggaggcggaggttgtggtgagctgagatcgcgccattgtactccagcctgggcaacaagagcaaaactctgtctcaaaaaaacaaaacaaaacaaaacaaacaaaaaacaaaaaaacttgcctattaggtgggcacagtggctcatgcctgtaatcccagcactttgggaggccaaggtgggcagatcacctgaggtcaggaggtaaagaccagcctggccaacatggtgaaaccctgtctctactaaaaatacaaaaaaaattagttgggcatgttggcgcacatctgtaatcccagctactcaggaggctgagccaggagaatcacttgaacctgggaggcggaagttgcagtgagccgagatcgcgccactgcactcaagcttgggcgacagagcgagactctgaaaacaaaaacaaaaacaaaaaaaaaccccatgcctattgtctgacgcagcaattccaattctaggtatatgtcctagagaaatttttgcacattttctatatggggtcaaagttattcattttttaacacttttaatcgactacttttatatagacacaaaaatagagcaaatagtataatgaactctatgtacctgtcgcccagcttcaacaatgatcattttgtcagcctatacaacacagttcttaattgctaaaaattggaaacaaccgcggcgggggaggtggctcatgcctgtaatcccagcgctttgggaggctgaggtgggtggatcgcctgaggttgggagtggagttcgagatcagcctgaccaacatggagaaaacccatctctcctaaaaatacaaaattagccgggcatggtggcacatgcctgtagtcccagctactcgggaggctgaggcaggagaatcgcttgaacctgggaggcagaggttgcactgagccaagatcacgccattgcactccagcctgggtgatagagtgagactccatctcaaaaaaaaaaaaaaaaagatgaaactgccttatttatttatttattttttgagatggagtctcgctctgtcactccagcccaggcaacaagagtgaaactccatctcaaaaaaaaaaaaaaaaatgggaaacaatctatttgtcactgccttagtctgggctgctataacacaataccataggttcattaaacagcagaaatgcatttctcacagtcctaaagaccagaaagtgcaagatcaagtgtcagcagattcagcgtctggtgagggcccactgcccggttcatagatcactgtgttctcacggacaaaggggaaacagagttgtctgatctcttctgtgaggcttctaatcccattcaggaaggctctgctaccagccgctaatcttctccccgaggccccaccttctgacactgccacattggttagggtttcagcataggaatttggtgtggacacaaacattcaggcaatagcagtccctcattcggcatgtacagattgcgatatgtctaatagaacattgtgcagtcattcgtgaagtaggtctactgtattaacatggagagatttcaaatatatattgggtaaaacaagttaaaatgattatatcatttatgaaaaaaattagaacatatggttatgggcacacaaatatccaggtgaaatcaacaaaggggaagtagtaactctgcattgtgggccccctgggagaaaaggagaaaaggacccggaatggtattaggaagaatcacaaaggaactgcacctgtttgcagagtgtggttttttttcccttttggtaagtttaacttttattttatcaaaataatacatgtgagactgggcacattagctcatgcttgtaatcctagcactttgggaggccaaggcaggcggatcacttgaggtcaggagttggagaccagcctggccaacatagtgaaacccccatctctactaaaaatacaaaaatattagctgggcgtggtggcgggtgcctgtaatcccagctactcgggaggctgaggtgggagaattgcctgaacctgggaggcggagattgcagtgagccgagatcatgccactacactccagcctgggtgacagagtgagacgctctcaaataataataataatacatgtggacacttctgaaagtcagattgtaccctgaggctcatttgcccccgccacccctgtcccactgccctccccatgagtgcctcccagaggctgccctgcaactcctgttccccacggcattgctctgtttagtggtctcctttgatggaagattgagctcacttttactgccctccccatctcaaaccctgccccacacatgtacccactttccctcccttcaccctgcatggttatatagaaacacttttaagtacattttcagaatttacatttttgttttgttttgttttttgagatggagtctcactctgtcacccaggctggggtgcggtgtcgcgatctcggctcacagcaacctccgcctcctgggttcaagcgattctcctgcctcagcgtcctgagtagctgggattacaggcatgcaccaccacgcccggctaatttttgtatttttagtagagacggggtttcaccatgttggtcagggtggtctcgaactcctgaccttgtgatttgcccgcctgggcctcccagagtgctgggattacaggtgtgagccactgcacccagccaagattttacattgttaacattaagttaatattcacatctgaaaatacagagtgtctactatggtggcattaacttttcattttcctggagttgatgttcatccccagacaagttgtgcgttgccatctcctcttcattctttcggagacaccaggtaatctgcctttttgtttgtttatttaaggccacatccccaggagctgctgtccaggtgcctggcgggtctccaggcctgtggacagcgagcgacctgggcctccctccccatcgccgtgggagttccctttgcctcctctgtgctggctgcccaggtgcctggatcccttgtcttccttattcttggtttatttagtcctttgttttgttcgtgcccatccctgggcttcttgggcagacaggctcacaggtggcacacctcccaaggcctggcgtgtctcaaaagattggtattttacccccactggattagtagtctaactggatagaggactccagcttgggaagcgttttccctccaaaattggaggacattactccagaagcttctgactccatgtcactgctgaagacagttgtgtgtgacccttggtcttcagaagtgtggtaggctggagatggcctccaaaggtacccaggtcctaatcctagttgttaccttagaaggaagaagggctttttcagatgtgatgaaggattctgacctggaaaggtgatcccggatcatccaggtgggccccgaatgccatcacaagtgtccttagaggacagagacctatgctgaggagaaggcgatgtggagacagagccagaggtgggagtgatgtggccacgagcaaaggagcccggcagccatagaggctggaaaagactcgggagggattcgttgcaggccctcggaggggcgcagccctgccctcacttggtttcggcctgtgaaagtgatgttggatttttgacctcccaaactgaaagagagtgggaggtctcttttggcatcccaaactgatctttcttctgagtgggacttttggcatcactccaggcgctccaagacctttccacatggatacgcgtccttcagtcccgggagactttccagcaggattcccctgcccctggctctctcgtctccccttccgggagtcccaggcagctggatgctggacttgctggactgagtctcttattttcttatcttttctcctattttccatatgttagtctttctgggtaatgtcccaaactatcttctaattctctatttattatgtttaaaaattttgcaactctatttttaatttcctagagctctttcttgttgcctttttaaaatagctgccgcctcttacttaatggatgcaatagcttttcttgtttctctgaggagataaattatagtttttctgagtatctgttctctatattacttttctcctcaatgttcctgttttttaaaaatcccaatttgttttggtgaattttttggtcatttcctcaaatatctggtggtggttcgctgaccgttcacactgaaaaatgagacaccaacacccattggcaagtctgggttggggtggagcttggtggcccctggtcctctcgctgggagatgagactgggctccctggggagcccactgcataccagtagctgcaggactcctggttcctggaacggaagcttccagttcgctgcctggaaaagagcccagtaagcactctgtggagccgagaggaccttccacacattccccaacagccatgtgatgcctcacctcctgggccagccctgatggccggggctggagccttgtatcttgggaaagacgctgtggcacagtggtcaaaggcaggaccctaggttctgaagccaggggcgtgcaccgtggcactgacacatcctagcagcgtgccttcctgccttcgtctctggagcgggctgggatgactcccaggtctctgcagctcagaactctttacacaggagactcactgtctagctgtctgttctttccagccggatactcttcaggttcaaagctgagtcactgtttctacccacattggcttcgcgttctttaatttggtgttgccatcgttcaccttaaaacccagggccacccttccctgctgcctctctgcctcccatctaatgggtgctgttgatgccacctcctaagtatttcttggcacagtccctcttcattcctattcccaccaccgtggttcaggtcctcattgtctcttgcccacattagaacatcttcctagctgaccttctacttctcatctttccttctcaaatccagcttccccagagctgccacagtggtcctgagctctcagttgcaaatctgtctccctgctgcctggtatttccatagcatcccgacatagaggacactgcccaagctgctggtggggcccactagctctggactgagtctcaggctcagcccttaggctcctctccctgcctgcactccctgcctcagcgggccacgccaggctgtttgcttcctgccttatctgcctttgctccagccgccccagcacctggacctcctcccctcctctgcctgcccccctccctcccctcttctccctctggacgtcccttcctcctcccaccctggagtctttccttcaggccatcttgctaactctgccctgctctccacgcaggcgtggcccgcctcatcatccttcacttctcatctctgctgcctctcactcagcctgccccagccagctgatcacagtcccaaatagcgacatgctctgaaagccaccgctgtggcctgcatcaggatgtgcggatgagaggggggtatttttaccatcattgtgcttctccagcccctggtgttaggatctgtataggatctggttatttgtaggcaacctgggtgtattagattcctacagctgccatcacagggtgccaaaagctgggtgaaaacaacggtgacttcttgcctcacatctggaggccagaaaccccaattcaaggtgtgagcagggccgtgctctctcggatggctctgggagggtcctgcctggccactgccagcttctggtgtttgccagcagtccttggccttgcctgacttgtagctgcctcactccagtcatgtggccgtcatctcctgtgtcttcacatcttcattctgtgtgtgtctgtgtccagatttccccctttttataaggacactaagcatattggattagggccaccctaatgactttatttttacttgattaccctatttccaaataaggtcacttttttttttttttttttttagacagagtctcactgttgcccaggctggagtgcaatggcgccatctcggctcactgcaacctctgcctcccgggttcaagcaaattctcctgtctcagcttcccgagtagctgggattataggcagccaccaccacacctggctaattttttgtattttttggtagagatgggtttcgccttgttggccaggctagtcttgaactcctgacctcaggtgatcagcccacttcagcctccgaaagtgctgggattacaggcgtgagccatcgcgcctggcccaaataaggtcacattctgacctaggtgctaggggttaggacttcagtgtatcttttttggtgggggacacaattcaacctctaacaccgggtgacacccgcttgtcctgagcttgacaggtcccgaagtccccaaggcctctgggaggccctctctaatccagccagcattcatgtcctgtcatcttggaacgaggggaattgagtggggagcaggtcctgtgaagctctccagcaggggtggggtggcctgaagagggtcgggaaatgtcctgggccacctgcaagtgtctgctgggtcctggcatcttcctccctgcaaagattgtccagttctgtttagaattgagtctttggtgcccctagcctctgtcgcccctcgcagccctgaaactcagcttccctggttcccattgccaggctgcgtctgagtccttttgggctttagtgacaaaataccacaggctgggtggcttttaaacaacagacatttatttctcacagttatggaggctggaagtccaagatcaaggtttcaacatatgggtgtggggggcacaggcacgctctgcattagtctgggaggtgctttttgctgaccttgtccttcagaccctctctctgtcctgtcaacatcactttgggctctaatcaatatgtatgggacatttgtgtgtcccactagtgtgtgtgtgctgttcccaggaggggccaagccttactaatctttatctgaatgctccataatatttctaggtaaatctttttttttaactaattgattaattattttttgagacagagtcttgctctgttgcccaggctggagtgcactgggaccatcatggctcactgcagcttcaaccttctaggttcaagcaatccttctgcctcaggcttccaagcagctgagactatctatgggcaccaccatgcccagctaattttttttttttttttttgagatggagttttgctcttgttgcccaggctggagtgcaatagcacgatctcagcccaccgcaacctctgcctcccacgttcaagcgattttcctgcctcagcctcccaagtagctgggattacaggcgtgtgccaccatgcccggctaattttgtatttttagtagagatggggtttctgcatgttggtcaggctggtcttgaactcccaaccttaggtgatccacccgcttcagcctcccaaagtgctgggattacaagtgtgagccacgtgccaggccacacccagctaattttaaaaagttttttttttaattttttggcagagacaggatctcaatatgttgcccaagctgatctcaaactcctagactcaagtgatacccctgcctcggcctcttaaagtgctgagattacaagcatgagccaccacgcctcacggtgaatcttaacagcctcatgccactctgcaacctcattgtgacctgaagtatttcttcactgattcattccctcagacatttatttagttctggtcttacgcactgtacagagtgccagggagatgtggggacaaaagagaccagggatcctgtgcccagggccctaacagtgtctattaaaggagacaagacgggtcaacaaatctttataacattaaatgctctttgctgaggacacagacgccacggagacctcatggagagccccctgagcaggacgatgggtggggcacagacaaggacagagctgagggaggtggctgcccggggaatatagggaaggcattcctgagcctactcctataggatgtggaggaatggggacaagtgaccttcccatgtgagccctgcccacaccccgtgctgcagggtcggcaggaagctggctcctcgtgcgccagggggcagtgttggccctgaaattctcactgctttccagtgaggctgggatggagcagccacctcactgcaggccctcgggacccctcactctgctttctctgagaccccctttgtcccccagtccacaagtcccgagaccatggcgccagtcgcctcggtgccaccctttccccctcggctgctcctttgaatagagggttgccagggcgatgaggagccctgctggcactgttcactgctgttcgtcgccgcagtgccacttggagcagccggcgctcctgggggcccagagcccggacagctgagcctcggcgagcacccgtgctgtgtctgtttccgtctttggtattgtctctctcctgtcttctgtgtctgtcacctgcattgtttccagcgtcctcccttctgccccccctgcccagaaatctcagcctcagtctgtcctctcttgggtgctttgatatcagccgtggcagccctgagagccaggtggagtcgttctttcatctgtccctcttggctgccagccctggggcccgtcggacatgtttagagcagagccgcctggggagagcggccccatccgtcagagctgccaccgccgcagccccgagtgctctgccaagagctctttctttctggttctgacctgctttcactggcagctgtggagcccagctggggctaggggcacagcctggtgcgggtgctggtgctgggggcagctgggcccataggaagtaggtgtgtggagctttgttggttcggaggttcctggggcctgtttctgaaccacacttctttcttctctgccctctgctgctctccagcacacctctgaggatttgctgagggacccaggtgctctgctgggctttcagaaccaacttgctggccacccgcccctgaagcagggcctggtctttcccttcctctgcggcctcttgcccactgctgccctctgaggctgcaggagacgctctgtgaggacaggaatatgtaggacgaagcgatgtggggcctcagctgcagcagctcttaggtggcgccctgccctggtccccagaaaggctgctgagcactggggccacgttgttgtctggaacaaaacttgggggatgatggcctgacagcaggattctgtgctccttctggttgcaagaggcatcctgggagatgtagttcaggtctgaagtagtgggatttcagggacattttgatgatttattagacaaattgaaactgccttggcttatctgggacatgtgactgctgacattgttcgtcagctctcgttgggaagctctgagtgccactggtggccctgctggaggccaggccagtgacagttttatcagaagtggggtttttggttttggtattttggtttccaagtgcctgtcacactgtgctcctgatgaaagccgtgacttactcctttagttgagtgaagagtccataggccaactctgatgggtccgagctcctgctctggagggggccatatgaagcgggctccaggccggctctgctggtggcctgggtgtgtcacttaatcccactgcacctggtcccttacctgtacagggaggtgatgaggggctgtgagggttactgagtgagtctgcgtgaagagccacagtggcccctgcctggcaaggagcaaggctctgctggggtcactgcccaccattgtgccctcctccactggcactggccgggcaccaggtggagctcagtgagtatgtgttgtgtgctatggaagcggcagctctgtcaggagcggggcaggtgacggccaggccctcgccctgcctcagcctgcaggtcgtcgtaggtgccttcctgactcccttctggaaggggaatgctgagttattgatctgaagctgaagctgggagggaaatggaagctgtggagtcacccgagaggcagcaggggaggaagcaggtgccccacacactactggcttcactgtggctcattcttgcttgcaaggagttatttacacgtcccaagtgacagtcaaagctgtcttatttcttggtctcttatgcacaacccgaggccaagaaaagggatctgtcagctggcatttgcagaaaatagcaagtgggtctctgggctgtcagctctctggagaggaaaacagggtgaaggatctttgggtgatggtggttgcttttctctcactcactcactactgtttccccatttctgaggtcagaaagggagagctttgcttgtgtgtatcaccaggagcaagcaagacagtggcatcccccgaggcgtgtaactgtaacctgagctggttgctggccctggcagcatcccagaatgcccttcacacctggggctctagcagcctcccttgaagagttgcggctcagctcgagggagcaggaaacggctctgtgggttctgttagtaaagccctctgcatttccagggaagcttctcagccaaacttgacaaccttgagaacttcttgattgccatccaccaaccaaatacccaaaagcagggtgcagcatgggactgcagcatgggactgcagcatgggaccgcagagggagcctggccccagccattgctgccccctgcttcctgtgcctggccatcgcctattctgtgccgtgctgtgaagatggcaggaagtgcctggaatggtgccagccagaagggctgcagactggtggcacttgctgggaatgtgccattgtgagttgaaaggctggcatactccagtgtctgggcttggtttcgtacagcctgaggaccgggagtgtcattaataccagaggcaaggcttctgggggtctcaggaaggccgtctcccaccctctgctgccacttccgagggtcaccataggtgcctccagctgcaggggttccttcttctataccccaagtgctgtgcagaggcccctgctcccttcggctttggggaatggtctagtattggggagcagggggagtctgcccacccagctcctccctttgaaccatcccagacccctcaagctcagcatacccagagtcggcttattccaccataaccttgaagaccctgcttcctggagagagggtggtgtgagggggccacgcccatcttacagtgcggtttctcccagccgatgttgattctggaaaggcctgggtttcagatctgggaaggcagtgccattcgataaggaaaaactgggttaaccaagttctaggaagggtgcaggcgccctgggaatgcagtggtgtttcagttcatctttatgtctgttgggccccatccgtgcctggcattgtgtgcgggtcagggagagacaggttggtggtgggggtcttgtgtgaccacagcggtgagcttagtttcagggccataactaggttctaaggagcagtgcagccctcaccctccgtcattcacagcagctcctgacagccttccccagccccacactgcctgctggccaacatttccgtgtcttccgcctcactcggcagcacatcccaaatccatcacagaaacctgccctcccgtctctgactgcctcctgtctcagaccacctccctcatcatcttgccaggtccctagggggccgagggagcaggctgtgggctgtggatcagctactctctgcgtgacccaacctcccgcctccctgcagccagcggcccatgccagcttctaggcctcaggttcacagcctctaggctcactgctgccccttcccctgattgcagcccaggcctccagcagccttgtgttggggaactttgtattctgggccagtaacctcaggcagaagagcagctgtctgtggctcctcagacaccctcctctgtgcactgaaggccggtacagggtgagtgctctgggacaggtgcccccctctctgcaacacctgacactcccaactacttttgtttggggtgggtcttcctttgcagaggaatgttggggacaggtttctgcattggcaaaagcacgtggtgtcctcgggcctgtgtgtttgctccaagtgtatgtgggcatcacacctgctggctcccctatgcagtgaactctgctaagcattgggtgcatggtcagcctggcttggtgggtgggctgcctgtgctgccttcaccccaggacggcctggcctgtggggaggtcagcatggagctgcatcatggtgcgagtgggagggcgcaagtgtgtgggccttccagctgtgtggggccgggggcttcctccctggccctctgttcatctgggaggggagggagttgggaagatagtgacagcagctgatgtttgtcacccaggcatggcgctttagctgtactgtctcagtcgacccccaggatgacctgcttagggtgggctggtggaaccccgttttacagatgtgaaagctggggcctcagaggtgcccaaaccatggagctggggcagcccccggccagtggactgtgggcctgcgctgggctgtgccccagaggaggctactctctgttccacttttccctgctctgacttcagccgaagagccctgatcttttcccttccataaacatctgcctggcatgctgccacccaaagagctcccgtgccccggggacagtcctcttggcctcaagtctaggcctgctttcgcttccctctgagggacacaaggactcacggaggcattcctgtgccccccgctgcccacagcctccggctcttggtggagtgggactgctaaggaatcctttacccaccaagaaaaaatgaggatccaatgcaagaatgtatgtgagaggggccgccgagggggcggcaacatgtcagcactccatcattttcctgcctgagctaagcagacacttggtggccacgctgtggggcagggtgcagccttccagaggctctggaggtgaccggcctttggcatatcttctgaggaaatctctttctttgcatggaaaaggcagtggggagtgagtgtggtgtggacaggggaggagagcaacaaaaatgacctgtttacccacaaaccacgggtaagtgcccctgtggtcgcagggtaaacccacccaggtgggaggaaaggactggggctccctggaaaaagcttgaaactgccctggaggtttgagaatctcggtgccagtgggctgctgccagctgtgaggctgctcacctataggcaggccagcaggtgaggagggggagggtgctaggctcctgggagacacatagccaagtcctcccacccaaggagtcggtgtagcaggagctcccttcgccttttcctgcggagctcttcctgtcccttctgtatatttcttcttttttttctaattataaataacgcatccccaatggagaaaatatggaaattttccatatggaaatatagaaaagcataaagaaggaggaaaacacaactctacagcaattccatagcacgtgggagtgaggagggtggcatgcaagcagtcctacagttgttgccattcctttaaaaaaacttcatgagatcatgttgtttaccattaaattttcttggcttcacattacatcacaagcatttcccatgtcatcaaaacctgtgcaaacacattattgttaatggttacataatgtctgtgggagccagggtgtggaatctttaaattgcttctcatgattttctgttgtaaataatgctgctttgaacatctttctgcgtacatcttggttcccattttggaatatttcctggggttggatttctggaatagtaatgactgggctcaggggcataacccgccaccatgcctagctaatttttttgtattttttagtagagatggggtttcaccgtgttagccaggatggtctccatctcctgacctcgtgatgcacccgccctggcctcccaaagtgttgggattacaggcgtcagccactgtgcccggctttttttgttttgttttgtttttgagatggagtctcgctctatcacccaggctggaatgcaatggcgcgatctcggctcactgcaacttccgcctcacaggctcaagcaactctcctgcctcagcctcccgagtagctgggactataggcgcccactatcatgctgggctaatttttgtacttttagtagagacggggattcaccatgttggccagggtggttttgaattcgtgacctcaaatgatccgcctgtctcagcgtcccaaagtgctgggattacaggcgtgagccaccgcgcctggccgggcataaataccttaaaggctcttgataagttttgcaaacagcttcccggagaagctgccgtgatgctcagcagtgcctgcgggccgcctcctgaaggccttcctggcgctcagcactgcatttacaaagctcccaggcaggagtggcacctcatggttgtattttgaatctcttgctttctcgtgggttcaagagccacttgtgtttgctgtcttgttgctgtgcttgtcccgaaggctcccctcgcctcttcctgactttgccctatgtggtaacttgagctcttttgacatggcctttcccagcgctcagcagagtagacatttggtgcccaggaggagggtgagatttacaccccacacctgctctctgatgccagtgccgcctgctcccagctgggaaagacctgtcctcctagtgggcagcatccgataactcgcctggagcagggcttagaggattgtagatctgcatgtgggagatagcagggtgataacgtctgacgttcatcctgctctgagcagggtgtctccacacctgagctcctcgctggtgctcccggcacctcttgagcagcaggtgctggggcatgcactccctaaggttatctcctccagcggcattagcggtgggtatggttcttttcacttgtcaatttgaaatgatttcagactttcagtaaagttgcaagagtaagacaaagaattctcgtacccctgaccccagttcccccaatactagcatttgcttcattgttcccgtttttccctgaaccatgtgagtgggtgtaaattgcagatgtggtgctcgtggacccttgagttcctcagtgtttttccctaagaatgaggctgttctctaacataaccacagtccactgatcaagatcaggaaattgatatcaacgcaatcctctttcaaacctgcagaccttatttaaattgtatcgttgtcccctgatgtcctcttagcaatagaaacccggatccaatccaggatcgtgtgtggctctcaccattgttgctttggtctcctttcatctgaaaccgttcttgcgtctttgtctctcacgacctttgacatgtttgaagagtccaagccagttattctgtggaatttccctgaatttgagtttgccccttgctttctcctgattaaattcaggccgtgcacggcagcgggaaccccatcaggaggtgtgtggtatcccttcggtgctagtgatattaaccttcatctctcggtcagcgtggtgtccgccaggtttctccactgtgcaatgaataaggacaaggtatattttagaaagaggaggagcccagagtccagcaaggttactctacccacgttcaccatagccgggtgtgacctgggtgcctcctggtcaccgcagtggccccttcccagcccccatcttaccctgcctctgggagtcatgctctgcccaactcgcgccccatcctcctgagagccgctcgcttctgcccagcgacccgtgcgtccctccctcctccaggcatcccccctgggctccttcttggctcttcctcctcggccagactcaactccagtgggcctgaagacgcaggcctgacccacttctcccaggctgttctctccctggcttcagacaccaccgcccctgtgatgctgcccaggttcttgtccctgctcttccccctctgtgagcttgcctcactcccagccctgccttttctgtcttgcccttcttatagcaggaaaagtcatctccacccacccatacaggatttcttcctctaccttgctttctatggggggtctctcgacgaatcttgtctgtcatagcccagatgtttcctaagccccaccccgacccccatagcttccccctgtcagaggctccgcgtctctcagctcagcctctgaattgccccagacatgcgtcgtctgtcagcccctgctgctcgccagtccagagagatcctttccactgtgcatcgatcatgtccctcctgtcctgtccatggctgaagggaggcctcaaccactgggccctgtctgtggctgcagccccacctcaggccgtgggctcacacttccctctctcaggacagcaccaagcctgttcttcctgagaacttcacaattgctatcccttcttcctggagctttctctgcggatctgtgcgtggccgacttctccccatccaggtcccagcttctgtgtcccctcctcagagaggccttttctaatatccagcccccaaacccctgcacccgccccagatcattcgcaaaatgtcacctgtttcttatcttccaggcacttgtgatctgaaatgttctgatttgtgtcttgtttttcttttctttgctcctttcactgccattcatcttccatgagcagaacccttcactgttgtgttctcgactcctaaggcttagaactgtgcctggcataaggtctgcccctagtggggttttctgtttttctcccctggctgtgggtctttcctcctcctcctcttctctttcttctacttatttccttgtttcttctcttttctttttcttctgtctttatttccccttttctaggttgttggctgtaatatggcactaaggtttttgcaatatttgtttcatttcttgagtatgtttttatgttccttacttaaaacaaaatggctgagtcaagtgttttaaacgttttctaagaaatgaatcagatcggccgggtgtggtggctcacacctgtaatgctagcactttgtgaggccgaggcgggtagaccacttgaggtcaggagttcaagaccagcctggccaacatggtgaaaccccatctttatttaaaatacagccaggcgtggtggttcacacctgtaatcccagcactttgggaggccaaggcaggtggatcgcctgaggtcaggaggtcgaggccagcctggccaagatggtgaaaccctgtctctactaaaaatacaaaaattagctgggcgtggtggcgggtgcctgtaattccagctactcgggaggctgaggcaggagaatcactcgaacccaggaggcggaggttgcagtgagccgagatcgcaccattgcgctccagcctgggtgacagagcaagactctgtctcaaaaaaaaaaagaaaaaagaaaagaaacaaaacaaaaacaaaattagccaggcatggtggtgcatgcctataatcccagctacttgggaggctgaggcaggagaattgcctgaacctgggaggcagaggttacagtgagcagagatcatgccattgcactccagcctgggcaacaagagcgagactccgtctcaaaagaaagaaatgaatcagatggttagatgaggcccagatgcaggggtgaaaagagtgtgtctggtttggcttgggctctgtgctgggcagctgtctttttagtctccactgtaccttggtttccttcattttacaaatgaagggctggccaacctctgaagcctctttgcattcagggatataagttgtcgtcagttgatttaaatatatatataatattatataatattataatattatatataatatatattataatatataatataatatataatattatataatatatataatattatatattatattatatataatatatattttatatataatataatatataatatatataatatattatatatatttatattatattatatataatattttatattttatatataatatattatatataatatatatatattttttaaagatggagtcttgctgtgtcacccagactggtacagtggtgccatctcagctcactgcaacctccacctcccaggctcaagtgattctcatgcctcaccctcccaagtagctgggattacaggcatgtgccaccatgcctggctaagttttatattttctgtagagacagggtttcaccatgttgcccaggtgggtttcaaactcttgagctcacacaaatgtgccttggcctcccaaagtgctgggtttacaggtgtgagccaccgtgcccaacctgaagtattatactttttttttttcctgggacagagtcttgatgtcacccaggctgagggcagtggcgcaatctcagctcactgcaacctctgtcttctaggttcaagcgattctcgtgcctcagcctcctgagtagctagaattacaggcgtgtgccaccatgcccggctaatttttatatttttagtaagaggcggggtttcaccatgttggccaggctggtctcgaactcctgatgtaaggtgctcctcccacttcagcctcccaaagtgctgggattacaggcatgagccaccgcgcccaacctgatacttttattttttttgagacggagtcttgccctgtcgcccaggctggagtacagtggcacgatctcggctcgctgcaagctctgcctcctgggttcatgccattctcctgcctcagcctcccaagtagctgggactacagatgcccgccaccacgcccggctaatttttttttttttgtatttttagtagagacggggtttcaccgtgttagccagggtgggccaacctgatacttttaaaagttatagtgcatattatgctgggtacggcagctcacacctgtagtcttaactactcaggaggctgaggtgggaggatcatttgcgaccagcctaggcaacatagggagaccctgtctctacaacaataaagtcacagttaggatatcaggctgagctgggggttccatttggggttggatttgctcccttctctagagccaggaaatgttgggcttggccaggcatcaggaggtagatggtgctagcctttctgtggggccactgtggggttgggaagggccctcactcattctgaggagcctcagtgctgaggctgcgctaacctgggctctaacttccctccctagatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagcaccagtggggccggtgagaggagcctcatggccgccccagccttggcattcttctcccactcactgccccaggccctggcttcccactcccctttctgcttctcctaggacctaggaatctaacttcttgtttctttgccctctaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggtgagcccagtggcctggctgggcctggacagcagggaccagggagtcttagttgccgcgggggtctcttgaggctggcgtgctcagcgcctctgtgcgtgggtgggtaaacggatgcagctcagcaggttaggcaggggaagaggctggccgaggccttggaagggactgcaaggtaccgtcctctccctgacccccacctgcaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgaatataacgggcaagcaaggggtggccccgcagctcctggagagggtccagcagggaggggtggcagggattcccgcctgttacagagactcccccacacctttctcccaacaggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggtgagtgaagatgcccagggctgggagcagggcagggcagcctgccgtgggggcaggggcggaccactcaagggatctggaaagtgggtggggttcatggcaggggagaggtagcgctgtggggtctgaggtctggctggcccctgcccgccctcgcaggagctggaggagaattacacccgggcctactcagaggctctggccgcctttgggaatggggcgctgtttgtggagaagttcatcgagaagccacggcacatcgaggtgcagatcttgggtgagtggtcctgacgccccgcctggggcagctggaggcgggagctgagaggcccagtcctggtgccgtcacagtggctggccttggggacagccctggggcctgtcgggcgcttttccagaggactctggaaagtgggctctaggggccgagctggcagttggtcctcacagccttggtgatgctggtgtctctcctggcagcctctgtaccgctggcagccggcactgactggcgacagtggttatgtgggggtgatggggcatttaggaggcgtgtagattccagtaaaagctaagcccagtttacctccctccccaggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgaagggtgggcttcccgtgttgggacaggagcctgtgctcacaggccggcaggcctcacagtggggcgctggttggggaaggggaccctgagtccccttctggggactggggatggggagaagagggtgaaggactctcctgggggccagaagtgggtttgtggcatccttcccatgtgcagttgaggcacctggcccagaggccaagcttagagtccaggatggctgagaagagggagggaaggagccccagccgcctcctcagccctgctgctacacagacctggcttctctgtggcatcagctcatccctgtcatcaggagaatgagattccgtggattctgtcaagattgaggaccattatgaaggcagtcctccctcatgtgcttctgtctcctacatcatgtttattatgatctgtttccttgctctgcaccctctgcccatctctgcttttctgggacctctggtcggggggtcctgggctgtggaggaggctgaggtggcaagctatctccccacagtgacctgccccaggactggcctggagagcacctgctgtggccaggtgtgcagcggggtcctgccccctcttcttccctggcctataggcagcagaggatgcgtcacctccccatgccgaaggccggggtgtgcactctgcagcaaggcctcagccacagctaatgcgaggcatcgaccagggtcgcgtttaagtcaggtcttatttactggcttatactatttcacattccagaacaggtttaagggaggtgattcagtctggtttatcgttttggtgagaccaaaagtgaaactggaattagggctgaaatttgagttagagtcattatctgttggtacctctcaaatgaatttctttgggtggtggtggccagaggtgactgcgcagtagactagaaggggactttctgaaaacacctccaagcagaagcagcggctgggagaggcctgggtctccgtgtctgggtggatgacacagccttggcgggcaagcccaggaggcagcagggcaaggtgccgagcctgggatgggtgggggcttctgcccatgtctcgtcccagataagctgggtgcagccatctgtggctccgggaaccctggagcctagtggactacttgggggacgtgtccaggcaggagcatgacctgggccctggggtctgtctgccatctgtgggggcagggtttgccacaggccattcttttacggaaccaacccaatgggtgggacggaatccctgtcctgagtccagtgagtttgcccaggccctgcctgtgccctcccctgctcacgtggccgcccccacaggtgggctacgagaacgcaggcaccgtggagttcctggtggacaggcacggcaagcactacttcatcgaggtcaactcccgcctgcaggtggagcacacggtcacagaggagatcaccgagtgagtgtgggcgggcaggcggggcgggaggcgcggcttctaggatttgcataaagtacaggcgaagtggctcctggggccagccagggggcttgctcactccccacattggtggagagcaatggggatccaggtacttagtgttttaaaagtcattattctaaaagcattacgtggttattataaaaatcagcacaaaggagcaaataaaaatgactgacagccctcctctctgtcaggacgctgccgattgctcaggcccaggtgctcccatctgtcagaggagtaaagcaaggctcagagacatttggagagttgctcggggtcacacagctggcgctggaacccaggcatctccggctgtctttggtttgctcctttcccggtttacctgttttactagagacatagtttgatgcaatagagatgttttatatagaatttttattctacttttcaaattatttaatatttgttgaaggcatttccccaggccataattctgtctgaatacttttagtggctgcgtactattccgtcttgtgtgtatttcttaacttacatagtcctcgattgttaggcaattagtttgtgtgtctggctttggtggttattaagcgtgtcacttatcatctgtgtgcctgaatgtttggcttcagctctgaagagttctgagggtaaacccttcaacaggattatctgattgaaggataagtagcatccctcggaacagccctctagagaggtggcactagcgtgctccctgcaggcactgaggatgacattttcaaaatccgcctggtttctaaatgacagtcatgatggccctcacccttcaaggtctctactatgagccatgtaatttcttgacgctgctttgggccagcccatctcactgtggagcatccctgaccccagttctgcccccagccccaaccccacctgagactgaggatgctgtcggggtggctgctgtggctcgccgggggcatggaggcccctccctccccttaggagaagcttagagacaaggccaacactttggccgagtgagactcttcccctcaagctgctgtgaactcctcggtcttgggtctgcttagagcgtcctgttagggatgggagtctgtctgctgtggagcacgggttttgtgtcagacagattggggctcaggtgctctcaggtcccaagccacgtggagcctgggtgagctccaacctctctgaccctcgagctcctcctctggtgggaatgacagggctctcagcacaccgtcgtggagatgaagcatgggaggagtgcagcctggcctgtggcactgagtggaagctgtcatctctgctgcgaagtgggccagcaggcagcaagaacacggggaaatcctgccagtgtaggttccaggctgccttcaccacaagcctcagtggcaatacatgtaaaaccttgagtggttttttttaagacatagtcttgctctgtcacccaggctggagtgcagtggtgcaatctttgctcactgcaacttctgcctcccgggttcaagtgattctcctgcctcagcctcctgagtagctgggattacaggcacacactaccaggcctggctaatttttgtatttttagtagagacagggtttcaccatgttggccaggctagtctcgaactcctggcctcgtgggattcacccactttggcctcccaaagtgctgggattacaggcatgacctgctgtgcccagcctggtttttttgtttgtttgttttgttttttaaacagctgttccacttggacttgtgactgcccttaggagcagtaaggctgagcttggaaaaccctgcagaggtggggaagcttgcactctccaagcatctctagggggttttgggcacaagtccagcaggaaaacaggcctcagaaggacaggtcctgacccagcacccactgtgcaaccctctcacagctgtggttaccatttcgaggagcccagccttcacagcacctgttcccttgcacactgcccccctcacaaccacccacacagcatagcacatatggccccaagaatgtgctatcctggccctctgacctagagatctgctgaggcttcaaatctaggctttaccaagggggagtttaggggagtggggaaaacagacctcaaggaaggaggaggcagagtacagggaggagcagcttagggctgtgtggacggcaccgtgagtcaggaatgcaggagcaggtggtcctggtatttcagcgggccatctccagctgccaggcactgtgtagtttagtcggctcccggcgggagcagggcaggggctggtggagccactggttgggaggaaccggctgttcaggctggcccagagcctatgggcaggagtcgcactgtgtgtggacgccccactggctgcggtgcccctcgtctatcccccgcctcatgtttccccctttctcccgtcctttcccccctccccccaatgccctacagcgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgggcggagctcgagcagagggagatgccagctcacctgtgcacaggttctgcctggtgcctggggctgcagtgccaagttgccacagcccggcagttagggaggacccgcatgtgggctctgaagtggacatagagtacacggaggcaggcagtgcccagaggaggggcggcgcctcccaggggaagagactgctgggcgcccaggtcaggaggaagccgtgagggtgggagcggggagcaggctggcttggtggagcaaaacgcagggacccagacacaaagccagcccctgaccctccagctcccacaggagccccacgcctggctgccgacggagcccaagcaccacctcccatctgagggatgggctgacatggcaggacctgggggtgggggtggcaaaggactgggcccagaggtcccaatggagtctgagccaagctcaggggcccatcaaggatgggggagggagtcggagatggcggcacaggagggagaccgagaggtagattcggggccgcgagatggcagccttggtgggggagagagtggtgtagggggcgctgaggcggtccacggcaggctcctcagcacagcaagactcgcgccttctccaggagggctccctgtacctttcttcctctcagcaccgggacccagtcattggcctccgaaacccatctcccccgcctctggtcccagctgtgggcaggagccctgcggcctgctcggtgcctgttcccagccctgcacgtgctgccagcaccgtgccagctgtgctagggacttgctccctatccaggggcctgagccccaaaggaggcaagacattgatggagctccagctttgctccagagtccaaggcagaggcccccgggcttgtgtggggcggtgaggggagcaaacatgagtttgggccaggctctgggcttctgagacaagggaggctggggaggctgggggtagggaccagagctctctggattctggaagcagcagagcctgtggcttcagcagggagctggccacctgccttctgtttctggaagagtctgtaggtggcggcagccccaggctgagtgctgcccggcggcccctgacttctctgcctccctccatccccacttccaagccctggctcttcagagcctgcctcatcacagagtatttttagccgacagtttctgctctcagctgagtgttcacccttaaatattttatgaagttcctttttattgaacacaggcctctgcccccgagaagcggaaatgggcagtgggtgtcccgagcccctctgggcggtccccccactccccttcttccttacctgggcctgacgggtcccccacctccggggagcccttctctgcggggctcactcgggcggcacgaacaggtgcaggcggcacgagccacctgtgtgtgtgagtgtcggcgcctctgtctcctcctctccgctgcccctcccattgccgtctggccctggccctgtcccgctgccccgctgccctctcctcgcccttggtttgcttccctgatgggtgtggaccctgcctctggcactttcccttcatttcctctcccacttcctcctcgttgcctcctctccctcccatcctcccttctggaaggaaaggaaaggaaaggaagggagcatgggtggatgttgaggccttccccaccaccctgttaaaaacaaaaacaaacccccggtcagccttgcctcttgcctcgcacatggtcctttggaggccctgtcgccggcctgccgtcccctcgctgtctgggagcccacggcgaggccctttagcggccgggtcagcagacctcaatccgtgctgtggaacgaacgtggatgagtctgaaaggctagagggttgctcaggcaggtgcagcaggtccgtgggaatagaggcagggctggcccctgcctgcccgggcccctctcccgctctgcggcaggcattcccttcctcctctgccccctcccagctcctcacagggagccagtagcagtgactgcgtggcacgtagagaagggacgcactcctgggtttggtggcagaaacagcaaaacctgaccagccagagctgggattcacctgcagacaccccacgctctgctctcagcagctgctgggtgcacacctggccagcctcggggtgggtggggcacttttgaccgcagtttctggcgcaggtcctcacgcctcacccttcccacaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaaggtgagaggctgcagcccccgcctgcctttgctcccggcccttggagggccccctgaccgttcacttccccaccaagggccttgcacatggcttcacctcagccttgcccctgactgatgggtcgaggtcagtggctctccttggctgcagctgcacgccagactccagctgttttcagagtctgcaggcgcctgggcaacccgctgccagagtccctggcagtggcctggccggagctcgtcctcacatgcctcctgtctagtcttgttccggggagacccacgctgtgtcccgcccctctggggtgagaatcacctggaatgtgtgttaaatatcatcaggcttcccttctggaaatcctgatcccacaggtttgggtagaggcgccagaacctgtgttttgaacaagttctccagataattcttttttatttttgaagtggaatcttgctgtcgcccaggctggagtgcagtggcgcgatctcggctcactgcaagctctgcctcctgggttcaagcgattctcctgcctcagcctcccgagtagctgggactacaggtgccccccaccacgcccggctaatttttgtatttttagtagacggggttttatcacattggccaggctggtctcaaactcctgacctcaggtgttccacccgccttgacctcccaaaatgctgagattacaggtgtgagccaccgtgcctggcctcccagataattcttaatttctggaaaatgtggatccccccccaccaggcaagagcccaagtcatgtagatgcggtcactttgcacagtgtcaggcccccgccagccccctgctctcctcacctggcctggtgcacacagtgtcaggtgcttcaggagcagccgagggtgggggcgcagcagagacatgagcaggaggcttgggaggcaacctgcccttggtgggctggcagctcggcttgtctttgggtggccttggtgggtgccctgcctggcatgaggactctaaatgggtatttaggatctaaagagccctttgctgggctctgttactggcgtctgtagctagagaggaatccacagccaggaaatgccgcctcggcctttgaagccagcacgtgtcccgtgggagccaccctcagaatggcaagaagagccggaggacaggggctttggccctcagcccctgtgggagttaccaccccatcttcttcttgggggtccccacagggcgggctgtgctgggcactggcaccggcccctctgccttggcctcgtgtcctccttgcagcttcttccagccctgcctgtcatcgaggcgcagttgcttgggggatgggggggcatgtgggccgtgctgtcccctcagggtcctgcaatcacttctcacatgtccacatggctgcttggtcgcaagagcccctggaggcttctgggcctatgcctgtgtgtgtggccagcctgtctcccaccttaagagggaacagcgcacttcctagaggccagggggtgttactcttccgtggggagcctctcagcctccctgttgggggtccctgtcgtgcacataggcagaggtgtgtcgcgacatcagctgtcgacatcacgcgctccccctgcaccttgctgcggctcctggtgtcctggcggggatgtcctgcggctgcttcggtgttgaggggatgcgtggccatgcacaggggtgacccaggccatccccctcgcctgcccctgcccgttgctctgtggtcctggctggctcctggggttgtgcccggttcctctgctccctcctcaccctcagcagctccccacgtgccaagctggtccctgggccctagaaccttgcgcctgctaggggtgcagctagaggtgggcttctgcaccctggagggcccggaaagatcttcctctttagaccgtcccccgccccccaggtggagaaaggggcactagagaccgtgaccacggggccagcagcaggataagtgtctctggtgtctgggggtgccaagtcctccccaaatgtgcaccaagaccaggccgctggctctagccgcctcctgagcctcatgctagcgcccagcgtggcagccctggccctcctgtccctttgccgtctgtgcccacccaccctgtcccgcgcccccgcccactcctccatggcgttcgctccccacacccttctctgtcgaggaccttgctcccattcatctaaaccaggctctcgaagcccacctctagctgcatgttctggggctgggagggcaggcacacgcgtgtgagccaggtccatgcacacgtgaacacacgtatgccttagagcacctgcctcacctcggctgcccggtggcagcgccttggccctcacacagaaaacaccagggagtctgtgcagcgtgtttgccgtggcctggggtgccagggccgccttctgagttttcatacagcacctgggggagcttgaccctctgcagggctgagggccacgtctgcccatgccccccagccagtgcctagaagcagatagttcaggaggctgcaggggctgggccaggtcggaggctgcccgggcctggccaggggtcctagcagagaaagcagggctcgtgcccatccggctgcctccctgcagcgagggagggcgaaggccgccttcccaggaaggcccagagcacatctgagctggcagctgcggtcctgctcggacccacagttctgacaggaaccttccagaggatcacgggctgatggcagagcagtggggttccctgcccttccagtccctttgggatggcgttttaccagtccacaagatgccctgggaggtggcagacacagctgtcagcacctggagccatgaggacttttcactgtacgctcagcccaggtccgttctcccagagggctgtaccgtcccccacctcctcctgttgcttagtccagtcctgtgtccgccccgcagaccctgaagtgccatggggaaggcgctcacacgtgctccccaggctttacactggatacggcgtcctgtcgccacctggcaggaaggggcgttctttgcacttacaggcgagggtaggccgcctgcccaagcccatgctcttgcaggtcagaagacaccaggcacagcccttggccgcagccctgggccgcccctgtggacaggaagccaggaggccccaggctgctgtgactgcccccaccggccctggtagccccacccttgtccgtgtgccaccagcggcccgtgtcctgtcctcccgtctcgggggacctagccagacaacaccagagactagcactgaggtgtccccaacaattttattataaataaaaacaagactcccagtgggtggctgcagcccctgcctcggtggctgtgagcacctgttggaggggcctgcccttaccctggtctggaggccagaaccgaggaaagggctccctgcccctccaagtacacaggggagcctgaggtactgagaataaaaaccagggagggactcccaggccaggcggcggccccgggccctctgccccacgaggctcatcccttggagcacacaggaagctgcccgtccatcacaccacactctcttccagccgctcggcgctgcctcctaccccccggcaccctgccccgagcagccccccatgcacagagtggctccgtcgggcccaagctcctcccaggcgcctggcataaccgtagcacccggcatctcccaggtccagagagcagctgcgctgcggccggggcggggggctccgcggcgggtgggccttgggtgtggggctggggcctccattggtctgggactggacgtggctgagcttgagggggaggcggccatttccggccccccggccccgaaccagcaaggccacagtgaagaccagtaaggcagccaccagcacaccccccacggccacggtcagggtcccgcccagcacgtgggcctgcagggcgtggcacaggggcgaggccggcagcgtggagaaatgggcacagcccagcagcctggtggccgtgaggtcagagggcccagcggccggtgacaaggccagcaggcagaggtcatagtcagcgccggggacgaggtgcttcagcaggaagtggtggctggaggctgggacaatcctgcaggcaagggcaggtggtcagagcccggggctggggtctagccccatcctcacctccccactcccgtgctcccagctccaaacacccctccccctggggccactcgggctcttgggttcactcaggaaggtgaacaggctggagagtgtggccaggagatgggtgtgtgcactggcacaggacgcaggcaagcgaggggaatggggtggggggatggcaccagcagaggcagaaataacacgcgggcgcgggccatgtgcttcagacagacccaaccgccacctgctgccggggaggcctgcacagctcagtgacacctgggacatctcggggtggggtccttctgccgccccttgagctccagccccctcaggcagccaggccaggccaggccactgctcctccaagagtccagcagccatggtcggggagggggtgtcagccccagagagaggaggggtggaagcaaagccttgtggggagcagagggcggaggaagggcgccgggagtgcagccgggtgtggggcacgcatcctcaccggtagatgagggtctcatcttcgctgctgttgtactggatttggaacatccacactgggtcggctggccgcccgggaccccagctcaccagccctgaggtggcggtcacctccgtcacctgcacggctggctcagactccagcgtcccctcaccctcggcagcagtgcgagcggaggcggcgatgtccgagggcccggggcggcccccctcggcactgctgttcccaccatggggcaaggccagcacccgcagttctactcgggctgtggcctcaccagcagggttggtggcgatgcaggtgtagcccccagcgtccccagcgccggtcaccccaatctctaaggtcccgttggggaaagcccgggctcgggaggagttgccaaccaaccggtcgtcaggaccgacccagtgcatggtaggcgcggggtcacccagggcccggcaccgcagcgtggcccgctggccttccagcacccagaggcgctgcgtgtggcgggcaatgaggggcggctcacaggagaactcgccctcgggcactgcccagaagtagcggccggccaggccgggcggggaggcgcacgtttccaggtcgtccggccgcgccagccgccgcagccacagcagctcacagttgcagtgcagggggttcccgctaaagctcagcaccaggggggcgggagaggcctctgcatcacgcccacgagagaaaagcgggtccggagccagcgtggccaggcggttggaggtgaggtccaggcgggagagctgaccgagctgggcgaaggcgcctgggggcagtgcgtcaataaggttatggtccaggttgagggtgtgcagggcaggcatggcgccgatgccggcccagggcacctgccggaggttgttgtaggacaggtccaggtcctccaggctctctaggaagtcgtcgaaggctcccggcgcgatgcggcccagctggttgccgctgaggatgaggtgctgcagattgacggggccccggaggctcccggtgcccagctccaccagcctgttgccgtcaaggtggagggaacgcaggctctcgaggtccccaaaggcgcgggccccaatgcgggtgatggcattgcgagacagtgtcaggtccaccagtcccgtcatgttgcggaagtcagggggccccagggcctggatgaagttgtcagccagccgcagctccactgtgcgccggtccacgttgggcggcacaaacagcaggcctcggtgggcacagagggtgctgagcgactcggacaggttctggcagacgcagggcagcgggcaggcggccgctccactggccagcagcagcagcaggagcggcggggccatggtgagcgccctgtaggaaggggccacagcccaggcacaggtggggctggcgcaggtgcccacttgggcccaggacagtcccagaagccagcttctgtgagcctggcccggggaggggctgggtcagaggcccaagagggccgccagagatgagggaaggttggggcctgcagggccaggccccccagagcaaaggtcacatttcccaagcagttaagggggagtccaggcgctggggacaaggtgaggcatgaggcaggaagcggaggaggaccgagagcagggagggtcccggaacttcctttcccaggcgtccccaggaatcgccagccgcctccccactccccgccataccctcccccgccagagaaggcgccccccgaacctcccgtggagtccgtggcccctccctggccggcccccgcgctgcgcccggcggccccctcacctggtgtccgtcgctcagggggcgcgggccggcctccctgcgagcccggccggcccccgccgactcctggccgctctcccgcggggacgaggcccggggatgaccggccgcccgccgcccaccctcgggcccatggcgctcgggcccgcggccccggctcgctcggttcccggcaccttttcccggcgcggttagcggtggcggcggcgacaggcgagcgggtgcgcgccggcgggcgcgcgcgccgcggacacgcacgtggagggcggacggggaggggcgcgcggggatccacccgggcccgggccggctcctgaggtcacggggacacgcggccgctgcagcgcccacgggtggcgcccagtcacgcccgaggcccgggccggcgcgggccctccgcgctgtcccccggcgctgccgcagcgcactcaccctggcacaggcgcgcgcgcccccggccatcctggcgccccggcatcctgcaccgcacgggcgcccgccgccgcggcgcgaacctcactctgcagacagccagacaaagcgcctgctcgcgggccccttcaccatctcccggagacgggcgtctttgtcacatgtcgctgggcaccctccccaacacacccacacatgcccacacacccacacgtccctgcacccacgggcagggccgagcgcaaacccgcactgttgctgggacccttgcgttcacagacacacgctgaaggtcataaccgttctgcatcaccgagtcacgtggagggtccccaaccggcacggggttcggccgtggggggggctggggcggcgcccctggcagggctgctgcggggtggggccgagagggcttggcctccgggcaggcgccccgcccccgccgccccgccctgtccccagctgcctctcgcctctccctccctccccagctgccccgcccgccccgcgggccaggcgttccggagccaaccggcctccgcctcgggccggattggtctgcgcggcgcggcttcccaaccgccgggggcacgcattgggaagctgtgcgtcctcgcagcgcctgcggcccctccctcccgctctgtcgccgccgggccatttccctggaagagcggctcggaaccagctcctctcagagaaagggctcccggcgtgaggtgggggaggttctttgcttcctggttgagaaagctggggcttcggtggctcggcgagcctggtttccttccagctgtgcccgccaccaccagtggtctgcccagttgggaaacaggaagtcaccacctccccgtgtctcctggtccttaagccacctaaacctcagccatcctcgttctccctccagccctgatccccatgggccaggtggcaggaaactcggggaaacccaagattggaattctgatcctgtcagcacagcagtgtagtcctgggcacgttacctgaccactgaaaacaagttcctcctgtaggccaggagagttggatggtacatacataagcatttcctaggggcgagaggggaggacagctgcagcttgtgaggggcttacaggcagccagaagccattctgtcaccactcactgggcctcagctgtggcgtttgtaaaatgagggggattcagtcctggtgcaggtcaactctgatgtgcagtggcaccagctatgtctttgttcctcttctccccatcaaaaatgttttccaccgggtgcagtggttcatgcctgtaatcccagcagtttgggaggccgaggcgggtggatcacttgaggccaggagttccagaccagcctggcaaacatggcgaaaccccatctctattaaaaatacaaaaattagccgggcgtggtaccgcatgtctgttgggatgaggcacgagaatcgcattaaccagggagccacaggttgcagtgagctgagattgtgccactgaattccagcctgggcgacacactttgtctcaaaaaaaaagttttcattcactctaaatatagatgtttaccagcatccaccatggccacccagtgctgggagccgggttcatcaggaaccagatgggcctggttcctgcccccatagagcttacagtatggaggagaggatgggcaacccgacagtcacaaaggggagactcagtggggaccctccacatgactcggtgatgcagaacggttatgaccttcagcgtgtgtctgtgaacacaagggtcccagcaacagtgtgggtctgcgctcagccctgcccgtgcaggttcctcagcggcctgctggaaaggtgagcatcagctctgccgagggtgtgaggacagggcgaaggcctccaagggtccttctcactctgcgcgctcggggctctttggatggtttcattagctgcctcccttctccagtgccatgccttggcccagctgaaatgtcagcatctcttcaggagaggcaggggcgaggctcaggggcagacaggcacagcactgctggcggggtcccactctgtggtgagcacctgacaggctggtgggggaggcacccttcctgtccaggcctccaggtaataggagcctaagagacggagagctcagaggagtctgggtggccttgagtccctgttgaaggtgccgacagggatcatgaataagtgacgcgtggaggtgttttcttcgcggtggaagccagggctgtcgctacacagccacaggccatgctttcacaggtcttggagcacctgtcacagtgctggctcgcatgtccccgtttaagtcatactcaccctggcccagcctcatgttgtcacccaggcatttaatgagtggaaccgagggcccctgtgcacaaagtgcactgacacatgcctcaggcagcaccctgcccccaagggttcccaggcagacaagcagaggatgaagccgatgggtgtgcttgcccacagcgggttcctcaggggactgctggaaaggtgagtgtcagctctgccgagggtgtgaggacagggcgaaggcccttgagaagttcagggagagcttcccaggcaggtgcaaaggtgtggagcgcaaggcaagtttgatgtggctggaggtggccacaatgaggaaggcggtggagggtgtggcctggagatggagaagaggtcacaaggtcccaaaatggccgtggtcgaatcctctggcttgaccagtggcatgggaggagtgggtgatgagggtgatgggatgcaggttttggtaactggggggacagtggggcacccactgggcacaggaggactgggtgcataggcaggaagctggccgtggacttgctgaacttatgcgaggggtgaacaaggaaaggcccgggaggcagttgcacctctgggtcttgccctggaggcagagcctgtcactggcgccacagccccgggacggggcctcctggggagcatgtggtgtgtgaggagctggggaggaagaggacaggagagcaagatggcttggaagcccagggaacgagcagcaaggcgggagcatgcccgctggactcagctgggaggagtgacttagagtgccagagtgtggtctgttgcggtcaaggccctctttcgagaagcgtggacgaggggcaagggtgactgctgtgggccacgctgctggagaaaaaggctgagccctgttctaggctgcggggaggcaggaagggtggccttcagcacatgctttggtgtaaacaagtatggagggagcaggcccagcccgtgacagcttagggggctctgctggagtgaggagagggctgagggacggggaagtgcccctctgcagggaggcccagaagctgtgctggcccagggcagcatcttcagccttttctctttcagccttttctcctctgccttccctgtctgtgctgcatggtgaccccctcccacccgcctctgtcctgcagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggtctggcccgagactgccctgccctgccctcccctcccctccgctctccaatctcttgctcctacctccttgccactccccatgaccaaagaactccttagtgccccctgcccctcacccctgccctcattctggccctgcgtcctcttgtcctgcaccctgccattcactgctctccttgcttctgatctgagagaccccacctttccatccacgtggtcctcaagacgtccccactgcctgtacccaggaggccctggctttggagaggacaggggccagctggaagcccggggatcctggagggatgtgtccctgtccctgagcccagccactctcactgctgccctcgactcagcctctgcccagcccaccctgacccactgcccgctttctccccaggccatgtcatggtaaacggtccaaccaccccgattcccgtcaaggccagccccagccccacggaccccgttgtccctgcagtgcccataggtaggtgagatccattctgtcaactcatgggggagacaggaggttgccacctgcaggatgggcaccaatgcccctgtctaccctaggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggtaggctggcatgctgcgcagcgcctggtaggaatgggcgcccgctctgtggccagtcccacaggcttaggccactggggacaagctagagacgctgacacgaagaacaccaaagaggaaggaccgaagaaggcacagcgccctctccggccaggcctggtgccggcacgaggttgcagagctgagaccaggtgcatcctgggaggtccagggtcaggaggagacacctgcctgttaattatagcacagagaggtagaggagaagatgggattataaagggggcatagaagggacacaaatgagcctggtctcccccttagagatcagacaagggaaaaatctgtgggggttggagcagggaacacaggtatggcgaagatgagcaggacctggtattggggccagaggcttgtgctgcagagctagctccaaggcctggtggagttccccaggcatgcagagctgatctgggcctctcggttcctgtgcaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagtgagcctggggtggggtgggcagacgctacctggtgtggcccagagggtaccgagccatgtcgtgatggcctctgttctccacggtcagcctgacaccaagtctctctgtggccacacgcagcaggggctgctgtttggaaatatcgagaagtgtaaaattggagttgcagaaccagacaggcttctaaatcactccctcactcctggggcagtggaaggtctgagacttgcctgggtcactcggtgcagggctgggattggaacccaggcctcaagactccttgctcagtaccctcttccacagcctgccactggcctagctgatcctccagggcctggtccacacttgtgtggccaccccccgcctgtggatgccacaccccctgccaggcgagaccctcagatctcattccccaggggccatagagtgggtcaggaaggagccagggaagactgttcagagggaggtggggtggggctcagccctgggctctctcacccttgcaggttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggtgcctgggccacttgtccgtccctccctctctgccccggccatgtccccgccacccacaggcacacatcctgccctctctaccatctctctctctctctctcccacttcccccaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacaggtaggaagaacagcagcccgtggccacacccctctcaaagccgcagccaccaccagtcccagtagtgttggacctgcctaggatccagatgccctgctctggccttgccgccttctgtcacctgagtcagacatgggacctgagctagccctgggtcctggaagagtcacacatttctaaggcctcctctgactctggcctccctgcagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgagcccggcccggtgctccttacctgacccagccctgcatgcacctgccactggcctccttgaggtgcctggcaccctaacctccagggccttctcctcaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtagggaaggcccagcatggtgtgagggtgggggctggatgcaggacttgggactgatcctctgctttgctccccaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtcagtggctctggcgcttctccacactccaccctggccccctgccccagagctctggagtttagcttggctgtcacccagcctcgcaagctttgggagcagaaaggacccttgagaccgggagctaggcctttaggaacgaggagccaaggcccagtgtggggacttcctatggccagggccgggggactgctctcccaccttggcgtccagctctgagtctgcacaccctccctgcaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggtattgtctcccccagggccagccaggcggtggggcttggctgggcccaggatgtcatgtcccctctgccctgtgtcttcaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgccctccatgctggatcctgtgcagcccccagcctgcaccactcagcagtggggggctgcctttcaagctccccatgggtgggcaggtcagttgtgtcgttctcctcagagggtagtgagaatgaccatcgtggccctgttttaagtcactattgggtgcctactgtgtatactccccaaacaggactagtagtactgaacttgcttgaggggtggggcctgttctaagtatttaacacctattaacacagggaattaaccttcatcctcttatggacacagaaatcaagtcaca

SEQ ID NO: 700 - DNA, 51437 bp, Homo sapiens
aagttagcaaccgaaggcgtccttagcagcagtggccgctgagatgtacgaacttccggttctccgggcagctgccactgctgtagcttctgccacctgccacgaccgggcctctccctggcgtttggtcacctctgcttcattctccaccgcgcctatggtccctcttggagccagcgtggcgggcctggcggctcccgggtggtgagagagcggtccgggaacgatgaaggcctcgcagtgctgctgctgtctcagccacctcttggcttccgtcctcctcctgctgttgctgcctgaactaagcgggcccctggcagtcctgctgcaggcagccgaggccgcgccaggtcttgggcctcctgaccctagaccacggacattaccgccgctgccaccgggccctacccctgcccagcagccgggccgtggtctggctgaagctgcggggccgcggggctccgagggaggcaatggcagcaaccctgtggccgggcttgagacggacgatcacggagggaaggccggggaaggctcggtgggtggcggccttgctgtgagccccaaccctggcgacaagcccatgacccagcgggccctgaccgtgttgatggtggtgagcggcgcggtgctggtgtacttcgtggtcaggacggtcaggtgaggcaaagcctcggtggggcacccccgtgggcctgagatacgcaggccggtgatctccagcaaggctgacttctgtgaccctttcccccttccccagcatcagggactcctgcttaagaatatgatattgactttcttaaaggcctgttacctttggagcaatttaaacctataactaattgctgccttttgtttataaatgagtgccctacctccaaatctcttcatctgacctacaacccacgtcagcctcaaagggcaccctttctctgaagtgaggataatctttattccctagaattttgactactctgtcttgtaatacttctacctttctagtctaaatttttgtatacctaactggtcaaaattttgccaatcagaatgcaaactctttaaagacaggatatctatttagtaggtttgtgagtcttacaaattatttgtacaatgctgccacttaataggaaatcaatatatatttgagtggattaatagtaatatagaggtgccttatggatattttatttttataaaattcaggagaagaaaagttcttccttactatcagtgtttcctagtattgccctttaatctgccacctaagtggcagagaatcaccttcctgaagagttgacatacagagccaagacctcaccattaggagaagccagcaaagagataaggtgagggaaagctgtctagcagtttatttcattataaaataagtgtagagggtaggtttgcagcttatgtttgtttattgttttcaaaattcacgtttttcccataaataccctctgtattgtaatttaacatatttctttaaactgattatttaaagcaaaagtttccttttaaacaagtcgttattatcatgaatggaaaaccaacatcacttggctagttaaaaaatagtgtaagccagtggttcttgacatgtgggccagggaaccacacaggtgggagtttcacttagacctcttcagggcatctacagtattaaaactattttcaaaataatacattctgttacaggcttatagggtacaagtagttcattgatattgtttcagattccacattgcaactaatctttaagaaactgcttgtcaagttttggtgtagtagtatcataaaggaataaccactcatatataaaaaggctattaaaatgtttctttccattccaagtttatatctgtgcgaagatggaattactttgtatgcttcaaccaaacaacacattgcaaaggatttaatgcagaagtaaatataaaaatctatccatttcctattttttgtttctattttttatctactcctatcaccttaagccagatattaaagggaattggaaataagaatctaaatgtcattctttttacgtttttttcttttttgaaaatatagttgtttttcataaaagttatgttaacttgtaatgtgtttactattattttaaatcagttgataagtataggttttctcaagtttaattaatatggtaaagttgatatgtgtaattcacataaatataagttattttgggttcctgaacaattttaagaatgtaaagaaatccaaaacagcaggcgtaagcaatatttgagaaccacagctgtaagaaatattatttgagctagatattgttggttcacaaaggctagcaaatctgcactcacactctaagtgttaaaagcatattaccaccaaactgagactttcttcttaatataaagaaagattaaaagaatattgaaacaaattattttcctcactatataactgttatttactgctgtctgtacatagttcctataaaaatgcatggccccttgaatgttgtatctcttatacataaaaatgataagtataatgataatttggggggaatattccttccttgtttttttccttttgcttccacctttttaattattttaaatacacatatttattaccattgattttctgtcattaatgttgtaaaacttggacagatacagtccttccaatatgatcctattggatgacttggtaacatgatgtgtgttaacagccaaattctgaactatggctaataaaaagtgcattctttaaccagcatctaacatattcatgcagtccaagtcctacatttagttggctgcctggcatccaaagcttgaatgatgctaacaatgtctgggcagtgttccgaactcatactttttgcttccagattatggttttcttcattatcttggtgaatgctcattttggctcccattttcaaactatgtgtgacagtgcactgaaattagttatttgtgccaagggagaagaatgggccaaaatcattattttcttaactgatttgaggtgatgcagaaaatattttacttgtaaaattttattacattgaactacatgagactttcaaatagttttgtttttatctaattcatttataatgaatatgtaggtaataataacttcctttttgagtctggaaacattccaaagaacagtcaggttctcactgtagaaatacaaaacatatatatatatatgtaagtgtatatatatatatgcaaggaacacggtagggacaaagtagattgcctaaaatgaacacttaatctctatgaaaagagacttttctgtcttattctcccctatatcctcagtgctaaacatcatgtgcaatatatgatgggcactgaataagcagttgcctaatggatgagcactcttcatgtattatattgctgaacaggtaggtggtaaggatttggaaatttaaggataattgctgtttactgacggaacaaagaactgcgaagatctcaattaatacttttatttccttcctctcagtaggacattctctccacagtaaaatgtataaggccagggagcgggggtggggggaaatcactgtagatggttgttggttttagcacgtatggtaattatataaagcaatttttgtcatagctgaataatgattcttgccttaaaagcagggaattatttcctttttcatgccatgtcgttggtttttcgttttttattcaatttggtatattggaaggaaatcgatgcttaaaagtttaaccctctactttttttaaaaaaaatctctatgctctttagcaagtctcttccaatttcaagaaaatatggtgctcatgctcatatagtggagatgagcatgaaatttattatgatagcctttatttaagcagtcaatatttattcaactgaccagtactgggcactggggatacagttttgagcaaaacaaacatttctgcttctataacacttatatactagaggagcagaggggcattaaccaaataatcacatagataagtacataaaggatgctatgaaaaggcattaaaatgcagatcctattaatacatattatataggaaataaagaatattaatttaatttgaatgcttacccaaccctatacgctaagacacaacgttaggttttttcaaagaaccatactttgtaactgaaagattatttttgagcttttacttatcatcctaatagctgatagttaattgataatttatgtgtcagatataataccgcatactttatgtgcattttgaaattcttgcaaaaaccttcaaagtaggtaatatcattcttactgaggaaatttaggctgagcaagtttaaataacttgcccaagcgtgcacatacaggacctgcccaaacccagctctgctggaacttacctaacatgttcaaccatcatgctgcttcctgtgatcatttaaagtaaccaatttaaagcgatattgcacataaagatggctagcttatttatggagaaaaataaagtggatagtatatgcccagtgcctttctgtttaaaacacatgattttgttggatgttaaacctccaaattttacctttttgaaaagtgagttaacatttattgatcatcatatttgtgccaaggtgaaataattttgtttcctacctcaactccctgcattccttccctcatccaaagattttcctgatttactacacatagtcagggaatggtaatattttaaagaaacgtctgttaatatggtcacacatatttccaccttagtggagcaagtcactaatgatttatgcatgtgactttaatcaccatttctcttttgtctggttacttaagaatatgagttgttttctttttctcctagaagtcttgtggtaccagccctatttacaaaattataaaacatccatagaaatcacttaatttaagcaaaaccaggagtacttttgactatttaaccatttatgtatttagtgactgtcactaattcagtaaatattatttaccacctattgggtgccattactaagctctgtgatgagggttagtagtgcacaaggaaagtccctgcattcatggaacttccattataattgttcatatctccttggaaagtggagttttcctaacatgtgtaaattgtcctggtttgccattatttatttagctagtcagtgtatatcaaatgttttctatataaagagacccagaaacttggaaatgtatttaacaagtactagttcgcaagtaatgaatatttttttgcaaaggtgaaacttcccttcacaaaatgtttactcatacacctaaaatattttaaagtgtcaagttagtttgctatgtggtcaagtgccaaaataccaagatgatgacataactgatatgtcagggatcataatccctgatatgattatcatatcataagtgaagtgataatagaatgctctgtttttaagtgatatttgttatgtgtgcagttctgggaggtaaaagtggagatgtactagtttgttgggggcgttgaggccagagcaatgcttgctcatgtaatgccacatatagacattgatatctatacggggtaaatgtatgagactacctgccctgatactatccaccttagacactgcctagtgatctcaagagctgaggagatctttgcttcaccacatcaatagccatttgcttgtatgacaccctggctcaggagatttgtaggacaatgctgaatgtggactatgtaaagtagtttgacaagttatcatatgggccacctttaagcccacacaaatctgtttctgataaatttgaatgactgttatatctctcaaacttctgaatattagggcttcaaagataataaagacatcatatttgtgttcaaggagcttatctagtgaaggagtaccactgctttttgtggtaataaactaaacttttgggaatgtggcagcaagagctgaagctatttggagaaggctgctcttaaatatcattcctgttagacaaagccatctgaaaagccacttcataacataacaaaaactattatatttttgtagaagactaaatatttatctctaatcagcataaatcttttacaaacttgccctgtaactgaatctattttcagttgaccttttctgcttggatatatttcatttcactcttaactgtgcaggcagggagaagtattggatgagagctgtagaaaggggtccatttaagaatgaactatccagtcttgtttaaatgccattagtggggaaagagcaagtacagaaggaaatattgaagatatgggaaaggaagatacctaagaagacattaaggagggaatctaaataaagctcttgtcataggacaggagagagattttccattgaaatgttcccatttccatgcctttcattctctcttatgctttttgtagtctggcttctaattctaccactctagaattactcatgcagaagatggttaataagcacattgtctcagtttcatggatattttccccttttctgtagcactcagtgcactggttcttactttgacttctgagacatctcttctgattttcttcttacctccttgagtatttcttgcctagcttcttcatgaatttcttattccatgaactcttcttcctaattaggactcttctacaagctaatgtctggagagcagggcctctgtcttactcatctttggtccctaaaggcccaatctgattcctagaatacaacgagatgcattgaatttttgtggaagagaatgactttcacctcccaactgacagtgttttctgggccctgctttcactgtccatgttccctgggtgatccatccaaaattcatttccttaatggccacctctaagctgttaattactttctgagttacagacatgtatagccagccaacttcttacgggatagatgattcagacttgttttcaagtttaagcttgaaacagtatttttatccctggacaaatcttgctgtactctctttataaggagaataacaccatcatctacacagtttctcaaactagaaacctaagtcatcccatgtctctcttttgcttaccattcacatacagtcatccaatttcaattgctaaatatttcttgactatattgctgctttatgagctcaattgaccttacattagtttaggttcacatcactagattattgtgctattgtttctaacttttctccacttcacctgtctctctttcaatttaccttcaacactgaacagatggtgttccctctgagatgtaaatctatcatactatgtgtgtgcttataatcctttattgctacactgtccaatatggtagccagtaggtacaggtggctatttaaaaacttatgttacctgggcacagtggcttacgtttgtaatcccagcactttgggaggccaaggtgggaggatctcttgagtccaggagtttgagaccagcttgggcaatatagtgagatcctgcttattatatttatatatatatatgtgtgtgtgtgtgtgtgtataatattcacacacatgtgtagggggtatatgtgtgtgtgtatatatatgtgtgtgtgtaatatatatgtatatacacatactgggtatagcagtgcaggcctgtaagttccagctgtttgggaggctgaagtgggaggatcactcaaacctaggatattaagactgcagtgtgtgatgatcacactactgcactccacctttcatgacagagcaagaccttgtctcaaacaaagttaatgaaaaataaaatgtaaaattccagtccattagatatactagctgcatttcttttatttatttagagacaaggtctggctcagctcactgcaacctctgcctcccgggctcaagccatcctcccacctcagcctcccaagtaggtgggactacaggcgcacgccaccacacccagctatttattgtattttttatagaaatttggttttgccatgttgcctaagctggtctcgaactcttgagctcaagtgatctgcctgccttggcctcctaaagtgctgggattacaggtgtgagccacttcacccgccaactagccacattttgagggctaaataatcacatgttgttagtggcaactgtattggacagaacaatgcagaatatgtccatcactgcagaaagttctattgggtagcacaattctatggcatttcatgggatcaatgttcatactctttagtatttaattagctccttaatcagattttttggtgtttttgacatggagtctccctctgtcacccaggctggaggggagtggcacagtcttagctcactgcaacctccacctcatggattcagacgattctcctgcctcagcctccccgagtggctgggactaccggccatcattttttattttatcttgtcttccagtctctagtgaactatatttttatgcaagtacatttttcaaggatggaattctttgcattctttctttattctcttgtttaactcctggttgtctttgaagatgaaatggaacatgtactctactgggaaatctctgtgattccagaccattttgagaatacctgtgttatgacattatttccaggggactataataggtggttctgtttctgtcttcttttctacactgtttgctttttataccttatttagaaaatagtagattttcacgttttctgaattaatatcaaaaggaaataagaaataatgtatcaggctgggcatggtggcttatgcctgtaatcccagcattttgggattctgaggcaggcaaactgcttgaatccaggggttgagaccagcctgggcaatatagtgagacttcatccctactaaaatgaaaaaaagaaaaaattagctagttgtggtgacctgtggccccagctactcaagaaactgaagtgaatcactggagtccaggaagtcaaggtcgtacccctgcatttgtacccctgcatcccggaaacagttgaggccaaggtcatacccctgcatttgtacccctgcatttgtactcctgcatcctcaaacagatgagatcctggagagagagagagagagagagagagatcgagagacagagagagaaggagaggagagagagggggaaaagaggagaaagaaagataaaggaaaagaataaaaaagaaataatgtatgtgaaatcaaaacatgtaaatgaagattaaaaatgtgaggtagctgtgtgagagtggtgttaacatcaatcctgcaataatgtagtcattttaactcatttcaattccatactggagcctcatgatatatgcttgtgcagagaagtcagtttttttaacaggtgtatatttgcatgtatttacccaagataatgtgcagattattcaccagtgtatatctaacatgactgcagtcctcagggtattagagtacaaccagaaaatgcattcctctgtaattgatagaggttgaatgtgggacaaaatggagaaactagattgagatgcttctggttagttattgcaaagtttttctgaaaacaaaatcaatagcatttgaacattactatcaactggtagcaatgctcaggtggtatctaccaatacactctaccagtgtttctggacccattgctacagcaagcgtctattctgactagatggtccttatgccctgccagttgttaaatagctaaatatcttgagtatcacctctactcctacacttcaaagttcctgagttcttttgtcatgatctccagtgcccattgtagtatttctcttctatattattgcatttgattctaattttatctttggtgaagactacatttaaaaaattacttaggtttgatcttttctaaaatatgagaaatatggtaaaatgttgaaattgggttgaaagatatgttggtaatttgcattgttcagtatgatataaaacatatctagagaaatacttaaatcataaattgagaatcttatagtaattgaagttactttcttaagaaatcaggttttccttggcgtttttggatagatttttattgctatattctttaataatcctttttttttctggaagaagaaagtggtatagagttgaaaattcatagaacatgaagatattgactgttgtgagattttggttggcatgtaatgtcaattctttctgtgtagccaaactgtattatgtttttgtaatgtaaaaggggtaatatatactatggtttgactttagttatactgtaattttatgtattcaccagttatctcaatagtaaagcaaaacatccaaaagataaaactgtctctatgtttctatgctaattaatttacatacatatgagtatatgtgtaattttccatgcatgcctttattcctctagttaatatgatagttttagttttaactttcttttattactgaaatctatagaacataaattcacattattaatatatgttacatgttaataaaacacatgacataattataaccttgtgttatcacttataattgtttaaaggaactattatttttcctgtcattatgtatactgtagacaccttaaatttatatagatgtatacaaaaaaccttataaaattatttgataagtgttatttcagcctcaactctgaggtgagtagataatttttcaaattaggaaactgatatgagaagctacgtattttaatcaggatagtacaagctacagttgaacaaacaacttcaatctaaatgacttaatacaataaaattctatttttcctttaagaaaattcagctgcagatttgggctatcctccaacacagttgtcctccatgtggtaacagcaatttagctggctttaatgtttggtcttgccatgccaacatatgtccttcacagttgtcagagcttggtgagagacaccagagaatgcacaggagctttcaaatgccttaacctagaaaaggcacagttacatctgttcatgttttattgaccagtcctagtcatgagcctactatgggaagtgagtaggtactatgtgtggggaggcagggggagggaggtcaagatttgatgaacactaataatatctaccgtatgaagtgatagaccaaaggtcatattgctggaagagtgcccaagctcctgaagaactcagatttggaactctacttttgccatctcttctacattattcagtgagttcttgaagtaattgattgattatatttttactctttcattggtatgaatttgcatcttaccaaatagtaaaacaaatttctattgagcctggaaataatacacagtaaatacttttgccattagcttgagctgcactatctccctgtgctatcttataagttatatgcactataccagatacacattgatacccattgcaaaactatcccaattcttcaaaaagtgatgctgccataaacagtcaacgaaatgcatctactcattaattacctgttcttattttcttctcactgtcgactgcttactgtgtatatttttttctatcctatagcttctggcttctcttgagtttttgttttcttgtgatctactatgacttgtcattctctttattctatataatgttattttgactcctttagtctttatcacccattaaaactgcctcatgttcctgtgtgcatatatatgtgcatattttcttccatattgacttcccaaagttgatattctgatggtttatcttatctttgtaggctaggccacatcatccatcacaatctagcctagggattgacagtcctagtttagaaagttgctcatcccaggcttgtgttagttttcagtgggaataagtgatttttcatggtagaaaacatgattaaccatttctgtccattcataaaaaaaagtatgagtggagtagtttttctgaggactagggacagtggacatgacagattgcatgatatgtcttgtacattgttttaacaatgtagatttccatatttttaatggtgggatcctaatatataaactaactaaaagcaacaatgcactgattggccacacctccacagaaacctaggacactgaagagcccagtttgaaaacagtcatgtttttcaatttgggctgccaaatctctgagagaatgtgatggaaattatatgatgatctgcaaggagatgggaaaactgtgctaagctgagaaaacaagtataaaatgaagctatgaaaagttagtgagctttttggtggcaatgttattttagattgaaaattgctgatgaaacatttgattggtttattcaaagtggacggattgctgatagaacccgcctgaaagattcttaaagggtatcactatgagtatatacatccagatgatatacagtagcagtgtggctcagagaaactaatatgttaagtgtccttatcatttaggaggtttttagctataaataataaaatatccaattaaaagtgagttaaacacaaggaaatattttttttttgtcatttacttatcatgtatatgaataggcctaggtttggttcactggctttgggagattattaagaattccatatttttccactcttgcctttctataggatggctgcctctgctctaaatattctgctctcactcaatagtatcttaagcaggaaggagggaagggactatgaacggaagacttctgtatgcttttgttttgttttataatcagggagaaaaatctttcctggaaaccccactaacagagacatccccttctatctcatttgtccgaactgcttcatctgcttactcctagacaatggctggcaaaaggaaaattatattttcatgattggtttgaatcaattattatggccattatgtactccttagggctgggctcaattgctctctaaacaaaatcatggttctgttaagccagaagaagaaagttgcctctaaacaaagcagattctattacagtgatcaaaattaagagagagattcatcagaacaacaactaatcaaaacaacataattgtacttgttaatgcaagtagctgccaagttattattattattattactacataaggatgaactagaaaatatggctcaactaaaacaattatctagtttggtataatgtgagatagttgttttgaagattagcaggctgttttcacctaattttttgaccttcattaaaattacttagattcattaggaatacaatttgtctcaatattttaaaactcagactcagtagtcagcttactcgtgtatgaatcttagctctaccattcactgtcccacatttaattttctctactttgtgcctttctgtggatgaaatgaaggtacttaagctataggattgttatgagaatcagataatatttatgagttgtttagcttaatgcctggcatatgtgcatgcgcagaacatcagctcttcataatcgcatgcttttacatctagaattcaaattacaatttatctgaggagttttactataatgtttttaatacctctgtctcataaactattaatactatcactattttcatttttatactttaattttctcacttatgaaatagaagctttaaatatgtatacaaatattgttatgtattataaatatatgtatatttgtattatgtataacttaaatctctctctgtatttatatatacgtatatgtatctatgtatatacctctgtggtacctaactgctaaagctataatcagcaagatggtagaactgacagggctgtagatagagtcagtgtaaggggaataaaaggagattataggataattctgaaagggttggtcatagaaccagtgagaggctacaaaggatgaatcttgggggtactgaactgtagatagaactttaaggttgattgggaaataaatccatgctgaacttttagaaatggaggtcagaagaattaccaagtctcacatcctgagccttaggtcctaaaagggaagacaaagaaatccatgtcaagacaaagaggagatatgacaaggaaactatgtgttacatactttcatatggaatacttcaaagccaaactatataacgttgatttaggatttactttacctgggggtgtctgccaacatgccttcaacaggagacaaacataatcacaggaagtgattgtatgtactgaattacaaggagttgggagagaaaaggtatctatcaaggaaaacaaggttgcagtgtcctgaacatacatgaacacgcttttgattttttttttttttttgacctttgggtgttagcagtaaacacttcattagaattcagcagtagcagtatacctcgttgaaggaactttctagttaaggatgcacgtggtcgagattgtggtaggggcagagctggataactgtcaagctaatagagagggtttttttaaaaatatgaaaaaatgctaaaggaattcaaaactacaataatctgcgaacttcaacatggagtcatatacattttaatagctcctgagagtttatatcaaagtcactaattataatgatcctgagaggttaaaaagagacttttaaaatatctcattttcttctgtataggatggcaggaatatctttagcattgaatacagttctatatagaatgctgagaagttaaaagtagtacaaaaagccagtttggcttttgaaaggataaacttcagttattcatagtgtatatgaggaaaactgtgtttttagaatatggtaaatttgcataccaaaaggacaaaaataaaactcagcataggatacaaactaaatattagggattctagttgggttagagtatgacagttgcctggatcatgcctaaaacatcctaaatgaaatcttagagctcctgatgtgagtacatgtttaatatatttaaatattccagtactttatttttttgtcctgagtcagaaagctgttgcctccagaggtccatattacgattttaaatttggctagctcccttagattttgttgtggtatgtatctggaaatgatgttctttcaggcttgttttattccaagggtgataatttatatataaaaatttagatatctttcttatacagagaaaatggaagatatattgccaatctatatattttactcaattaatttgtttagcaatatttatcaggcatcaactttatgacagaagttgtgtgctgtggctactgtggtgagtaagaacagatacagctcctgctctcatggaatcaaatgtctggtagggatgacaaatagttacttaaataagtatacaagtgaacttttcataagcactttaaaggacatgtatatagtttcagtggaagccaatagtagaggtttgtgacctagttaggtagaacagaaaagggtttcctgaggaagttatatttaagctgacagctgaaagatgagcaggcattcacacagcagtattgtggtaggtgagagaagactgtgaggccaatggcagagaaagcatggccatcatgaggaactgagagaaggctgtgcggctggagttcagaacctggagtggaatgtggagcaaagaacaagatgaggctaaaaatgaaagatgagccatcctgtgctcatctttgtaggccatatattatagactgattacttaatgttgagtaataggaaaccattgaaggttttagagaatgaagggaaggttaatggatagccggagtaggcagagatagtgaattaggaagctattttagtcagcagaggaagagatgataggatagcagtggtatggtaagcaatataaatgaatttaaattatttttaggaagtacaatcaataataccttgtgattgtggcagccatggagatacactaatcagacctccattcaagagaacatgctacgggaagcaaagtggcttgacatcttcctgctgtcacagatttgggtccatcacagcattcatgccaggacaataacccctaaacttgtccctagccgatgactgagtggagcagagcctggccatcctgactaacagggaactccgctaatgggcagcctttgcttacaggcatgccactggcctggtgaagactcttccagaactgcactgcaagctacagctctttctagctggtcatccttcctttccactctttcacaggtgtcagatctctattaccctttgtaagatctccttaatttccctttcctctctctctttatccttcacaggcccttccctaacaattctcttgtattctatattaatttgttagagctgttgcaaaaaagtacaagtgggctggcttaaacaacagaaatttattgtctcacagttctggaggctagaaatccaaaatcaagatactggcagggctggttccttctgaggtctgtgagggaaggatctgttctgggcctctcttgatctttttaatgatgttttcatgttcacatggcgttctgcctgtgtgcgtgtctgtctccaaaatttccctgtttataaggacatcagtcacattggatgagggcctaccttaatgatctcattttaacttgattacctctataaagaccttatttctaaataaggccacattttgcagtaccggggattaggacttcaacatatgaatttttggaagacgcagttcaacctgtaacatgcagacatatcccttattagtatctgattcttgaagaagtggaagtgacaactgatggattgggttgtggaaatggggaataaagatgagaatgatgtcagattggtcaaaagaatttttactatgtgtcatatattcaattgggttggacttcctgatgaaaagtatagacaactacaattgtggttcactaatttttattcatttatgtttcagcagtaaagaaattttcacatttattcttggtcactagtttacttttttctaagaatagtcaagaaaaaaattttattttagttatagattattattcactgtttcattgttatgtctaaccacatgggggagtgtgtatatgtgtgtgtatagtaaataatatattcctcagtctagctttgaatgtgctataaaagaaattaaggaataatattaccctacagatgcttagttaaaaaaaaaagaagaagagaaaaaatcaaatcaggtagatacagcaaattacagcaaacttaaatcaggtgcatatatcaggctacagcaagttacattgattggtgttctccctttcatagagcagtgaaattaaatggaattttattctgttgtgtttattttatgtggtatcatatatttctacataaaattttatcaagcttactttagtggtttagttttattttgatactctaacttatatacatgttattggaagagaaatagttcttactaacctgagtgtattggaacattaaggaatctgcatctatattaaggcagctatttgaatattaacttgaatacctagaaagcatctgaccaggatcatttatctgtgcataccaggtgatgagtgaatataattctatatgaataaccatatagcttttttcttttgccggcttaggcttccatactttcctctgtacaaatttgtagataaggtctctatttttattttcattagaagctggcaaaatttgtttctatatttccaaatgcatttactatgtctagtagaaaagtgcatatctttgtctatatctacatgtgtgtgtataatatatatgtaattgtcaacacacatatagatgagtttgagtgtcatgagcctaatgacattcatttgtaagaaaagaactctggctattaaaattgcacagatattaaagctctgctttttcttttgtttaaaaataatacacaatgcatattaaaagacaaagtagcctttttacttaaaattttggtgtgttttattgtgtattttatttgatgcttaatgtttgttagtattttcagtagtgtttgttgaatcacccaagttatttgaaagctttgaaattgctttttttcttccttgagatgaatcaccccatatagtaatacagcatgtgtgttttattatagttgatgtttttatgtggacatgtagctgtatgaccacataattatcactgcctataactttggactgagcaaagacatttttagagaaattacacttctagtttaaattttatttaataatatatagcattttttactcattcttggatgagtcagtacatatactaaaacagtaaattcatttagatttgaactgcatcacccatttatttgatgcctaacaacattctgtttttatatatgaaataggttcctgtttctaaagagtttggattcatttttagaagatagtatttacatacacatgtaaattaaaggatagaataaagaataaaatgttcaaaccaatgcagccaaatgtttaggctatatacagatagggaaaatagtattattaggcaaattagtttgaccactcattgtaagattaggaatcgttaaagactttgaatgtagagaagaacatcagatgagctgaatgttaaagtccttaagctctacattcatatcatttttgtttgtttgttttgagactagccaacatgtcttgtgactaacaatgacaggttaacatattgactatttgatatatatgacccgggagaatctagtttatttccaaaaataatttcacatgacattaacttcattgactaaaaatgtcagaatgtttggaatccatatggtttcaaaaactgagcaaaagactgacaaaaggaaagagaaattataactttcaatatccttaacttatatttccaactagtttcactcactcttatgtaatcactttttaaaatcaaacaattgcatgcagatatcattaaatgatatgtttcaaaagcaccaatagtaaactaacttccctctatttttctatctttttttttttttttttttttttgagacagagtcttcactctgtcgcccaggctggagtgcagtggcttcatctcagctcactgcagcctctgcctcccaggttcaagccattctcctgctttagcttcccgagtagctgggattacaggcgcacaccaccatgcctagctaatttttgtatttttactagagacaggatttcaccatgctggccaggcttgtcacaaactcctgatgatctgcccgcctcagcctcccaaagtgttgggattacaggtgtgagtaaccacgcctggactatttttctatttctactttctaaagacaatacatttattatttcttttctttgtttgctaattactttcataagtctaaatcagaggttagcaaagtatggcccacaggccaaattccttcttctgatgtttttgtaaggcctaaagctaagaatggtttatctatctgtctatctatctatctatcaatcatccatctatatatttttaagggtggtaaacaaaatgaaaatttaaatgaatatgtcgcagagtgtgtcctacagagcataaaatactatctaatttttttttaaattttggatgggttgcgtagcttctttttttttaattatactttaagttttagggtacatgtgcacaacatgcaggtttgttacatatgtatacatgtgccatgttggtgtgctgtacccattaactcgtcatttaacattaggtatatctcctaatgctatccctcccccctacccccaccccacaacaggccccggtgtgtgatgttccccttcctgtgtccatgtgttctcattgttcaattcccagctatgagtgagaacatgcggtgtttggttttttgtccttgcgacagtttgctgagaatgatggtttccagcttcatccatgtccctacaaaggacatgaactcatcattttttatgggtgcatagtattccatggtgtatatgtgccacattttcttaatccagtctatcattgttggacatttgggttggttccaagtctttgctattgtgaatagtgtcgcaataaacatacgtgtgtgtgtgtctttatagcagcatgttttatagtcctttgggtatatacccagtaacgggatggctgggtcaaatggtatttctagttctagatccctgaggaatcgccacactgacttccacaacggttgaactagtttacagtcccaccaacagtgtaaaagtgttcctatttctccacatcctctctagcacctgttgtttcctgacttttgaatgatcgccattctaactggtgtgagatggtatctcattgtggttttgatttgcatttctctgatggccagtgatggtgagcattttttcatgtgtgtgtgttggctgcataaatgtcttcttttgagaagtgtctgttcatatcatttgcccagtttttgatggggttgtttttttctttgagttttctttgagtttttttcttttgagttcattgtggattctagatattagccctttgtcagatgagtagattgcaaaaattttctcccattctataggttgcctgttcactctgatggtagtttcttttgctgtgcagaagctctttagtttaattggatcccatttgtcaattttggcttttgttgccattgcttttggtgttttcgacatgaagtccttgtcggtgcctatgtcctgaatggtattgcctaggttttcttctagggtttttatggttttaggtctaacatttaagtccttaatccatcttgaattaatttttgtataaggtgtaaggaagggatccagtttcagctctctacatatggctagccagttttcccagcaccatttattaaatagggatcctttccccatttcttgtttttgtcaggtttgtcaaagatcagatggttgtagatatgtggcattatttctgagggctctgttctgttccattggtctatatctctgttttggtatcagtaccatgctgttttggttactgtagccttgtagtatagtttgaagtcaggtagcatgatgcctccagctttcttcttttggcttaggattgacttggcgatgtgggctcttttttggttccatatgaactttaaagtagttttttccagttctatgaagaaagtcattggtagcttgatggggatggcattgaatctataaattaccttaggcagtatggccattttcacgatattgattcttcctacccatgagcatggaatgttcttccatttctttgtatcctcttttatttcattgagcagtggtttgtagttctccttgaagaggtccttcacgtcccttgtaagttagattcctaggtattttattctctttgaagcaattgtgaatggaagttcactcatgatttggctgtccgtttgtctgttattgatgtagaacaatgcttgtgatttttgcacactgattttgtttcctgagactttgctgaagttgcctatcagcttaaggagactttgggctgagacgatggggttttctagatatacaatcatgtcatctgcaaacaggggcaatttgacttcctctttgcctaattgaataccctttatttctttctcctgcctgattgccctgaccagaacttccaacactatgttgaataggagtggtgagagagggcatccctgtcttgtgccagttttcaaagggaatgcttccagtttttgcccattcagtatgatatcagctgtgggtttgtcatagataactcttattattttgagaaacgtcccatcagtacctaatttattgagagttttcagcatgaagcgttgttgaattttgtcaaaggccttttctgcatctattgagataatcatgtggtttctgtcattggtacatgttggattaagtttattgatttgcgtatgttgaaccagccttgcatcgcagggatgaagcccacttgatcttggtggataagctttttgatgtgctgctggattcggtttgccagtattttattgaggatttttgcattgatgttcatcagggatattggtctaaaattctctttttttgttgtgtctctgccaggctttggtatcaggacgatgctggcctcataaaatgagttagggaggattccctctttttctattgattggaatagtttcagaaggaatggtatcagctcctccttgtacctctggtagaattcggctgtgaatccatctggtcctggactcttttttggttgataggctattaattattgcctcaatttcagagcctgttattggtctattcagagattcaacttcttcctggtttagtcttgggagggtgtatgtgtcgaggaatttatcaatttcttctagattttctagtttatttgtgtagaggtgtttatagtattatctgatggtagtttgtattgccatgggatcggtggtcatatcccctttatcattttttattgcatctgtttgattcttctctctttttttctttattagtcttgctagcagtctatcaattttgttgatcttttcaaaaaaccagctactggattcattgattttttgaagggttttttatgtctctatttccttcagttctgctctgatcttagttatttcttgccttctgctagcttttgaatgtgtttactcttgcttctctagttcttttaattgtgatgttagcgtgtcaattttagatctttcctgctttctcttgtgggcatttagtgctataaatttccctctacacactgctttgaatgtgtcccagagattctggtatgttgtgcctttgttcttgctggtttcaaagaacatctttatttctgccttcatttcgttatgtacccagtagtcattcaggagcaggttgttcagtttccatgtagttgagtggttttgagtgagtttcttattcctgagttctagtttgattgcactgtggtctgagatacagtttgttataatttctgttcttttacatttgctgaggagtgctttacttccaactatgtggtcagttttggaataggtgtggtgtgctgctgaaaagaatgtatattctgttgatttggggtggagagttctgtagatgtctattaggtccgcctggtgcagagctgagttcagttcctggatatcctttttaactttctgtctggttgatctgtctaatgttgacagtggggtattaaagtctcccattattattgtgtgggagtctaggtctctttgtagttctctaaggacttgctttatgaatctgggtggtcctgtattgggtgcatatatatttaggatagttagctcttcttgttgaattgatccctttaccattatgtaatggccttctttgtctcttttgatctttgttggtttaaagtctgttttatcagagactaggattgcaacccctgccttttttgttttccatttgcttggtagatcttcctccatccctttattttgagcctatgtgtttctctgcatgtgagatgggtttcctgaatacagcacactgatgggtcttgactctttatccaatttgccagtctgtgtcttttaattggagcatttagcccatttacatttaaggttaatattgtgatgtgtgaatttgatcctgtcattatgatgttagctggttattctgctccttagttgatgcactttcttcctagcctcgagggtctttacagtttagcatgtttttgcaggggctggtaccaattgttcctttccatgtttagtgcttccttcaggagctcatttagggcaggcctgatggtgacaaaatctctcagcatttgcttgtctgtaaagtattttatttctccttcatttatgaagcttagtttggctggatatgaaattcgtggttgaaaattcttttctttaagaatgttgaatattggcccccactatcttctggcttgtagagtttctgccaagagatcagctgttagtctgatgggcttccctttgtgggtaacccgaccgttttctctggctgtgcttaacattttttccttcatttcaactttggtgaatctggcagttatgtgtcttggagttgctcttctcgaggagtatctttgtggcgttctctgtatttcctgaatttgaatgttggcctgccttgctagaacttccctatccagggaagttctcctggataatatcctgcagagtattttccaacttggttccatcctccccatcactttcaggtacaccaatcagacgtagagttggtcttttcacatagtcccatatttcttggaggctttgttcgtttctttttattcttttttctctaaaattctcttgtcacttcatgtcattcatttgatcttccatcactgataccctttcttccagttgttcgcattggctactgaggcttgtgcattcgtcatgtagttctcttgccatggttttcagcttcatcaggtcctttaaggacttctttgcattggttattctagttagccatttgtctaattttttttcaaggtttttaacttctttgccatgggttcgaacttcctcctttagctcggagtagtttgatcgtctgaagccttcttctctcaactcgtcaaagtcattctccttccagctttgttccgttgctggtgaggagctgcgttcctttggaggaggagaggcactctgatttttagagtttccagtttttctgctctgttttttccccatctttgtggttttatctacctttggtctttgatgatggtgacgtacagatggggttttggtgtggatgtcctttctgtttgttagctttctttctaacagtcaggaccctcagctgcaggtctattggagtttgctggaggtccactccagaccctgtttgcctgggttttttatagagaaagtttagacctctggtctacatggtgtgtgtgggtgtgtttgcacacatacacacacatatacatgttaatgtaacaacctaaacatacttaatttctcactgtgaaagaaagagtactttgtatttcatactgcttcatttttgctagtactaatatttactgaccctttcattggttacatttgtaactttaaatgctatgcttaactctctgtttcctgttccatcactttagacgtgtatatagatagctctataggtaatgactggtggaaattttctttgtttgtactcacacttagtaacattttgtaaattttaacactgagaccaggcactttacacccaggtgctaatatcatacctgatgcttaataagactcaattatttgttgaaggtatgtttgttttccaggagcttcactgtcatgtttgaggagtctcatgttgctctttacagttgatgttatagcccaagtatttcttatcccacatatgtcaaacagagtaaatcagaatttatgtaaactgattttatttgtgataacttgctgaaatattttctatttattttcaaactccagtggacactcttgtgaaacacattttgctgtctgtggagttgaagttgttgcattggagatgacttaggcattccttgcagggtcacagttttggtcgccaaagtagaagtcactcagaccctcaacaattaattgaagaacatcttaattgatacatcactgtgctaggaagtggttatgtagtggtgaataaagcagtcttggttgctgccctcagagaacttagtgggagagacagatgaataaaccccacataaacatatacatcagcacataggaatgcaaattaaggtaaatgatttgaaggaaaagaacaagttatttgagacacaaactggaagtaggactctaaatcttgagatttcattcatatggctaataatgaatgttaagcacccttgaatcttttgaatttctctaagccagtggttctcaaacttgaatatgcatcaaaagcataagaaatgtttgttaaaagacaggtttctgggccccatcttcaaagtttgttattcactaggtctgggctagccatgaagatttgcatttctcgtaacttcctaggtgactgtgattctgctgatccagagaaccacactgcaagaaccactgatctcagataatggtttatatcacattggaatcacatttagaacctcaacaaaatattcatatttagttcttttttgctgtacattttgattcagttatgtcctaaacatgggactttaaaaaatactcccaggtaattctagtgtgcagctagagttgtgggctatcagtttagtctgtgaatatgcatatacatacagtttcttagaggggcatctaaacagtggtaagaaagcggggaggacatggggaaaaggctggagcaggaggtttcagtaaagaagtacctgacctaagcctttaaaaattaaggtttaaagtacggtacctgaatttaaggcttaaaagttatttgtcaacaccatcagttgacacagagagaagagagtatgtcagacagaagaaacaggcgatggcacataaacatgtaggagtaggttttgtttcatgaagtttaatcctaggtggtaaatttgttgcatatctgaaatgtaaccattctgatattgtttgctatgtcagaaacagaataataatttattttataaataaatataaactatgccatattaaataatttttattcattaatttgttctatttgataggatgagaagaagaaaccgaaagactaggagatatggagttttggacactaacatagaaaatatggaattgacacctttagaacaggatgatgaggatgatgacaacacgttgtttgatgccaatcatcctcgaaggtaagtattccagtagtttaattccatgaatcaggaagcaagtccttgccaagtaaactgaagaagtaaagtagactttcatttaacagcttatattccaacacagtttcttcagttctgtttactgaagttctttttgctatctaccccatagctcacattcacgttgttttgctcaaatagatacaaacaatagaataccatctcaaaatattttttttaatttattcttctgtttttatcttttattttaagttcaggggtacaagtgcagggtcgttacataggtaaacttgtgtcatgtggttttgtcgtacagattatttcatcacccagttattaagcctaggacccattaacttcttcattcttgcaatatgtattaacttgggtgtgtgtgtgcatgtgtgtttgtgtgcgtgtgtgtttgtgtgtgtgtgtgtgagagagaaatacttattaaatttaatttcctttttgtattctgaagatattttctttttagtttgggttctagtgtttgtaaatagtgctgccttgcagaattgggggactaattgtttatggtctgatcatgtagctgtaatatatatactgagatctattctcagtaagtgttaagacctttcctaagaggtttagataaataaaatgacatgagtatagaataaatgccaatgtaaatagaatggggaaaaaagccaacaaagattcaacctaataaggaaagacatcttggaatccagagggattacttgggtgaaggagaattagagtccagagtcaggtacaaatgcaaagaaaacagaaatcttaggattacagaaaagaagatgactcaacaaaaattggactactaagtcctgtatatctatatttatatctatatatgtctatccatctatctatctaagctgtttatatatatgcacacacacaaaggaacttttagtaatgctgataatttgttcatttaatacaaatatgttcatgaattatacattttaatagtattacagcctgaataggcaaacatgaacaaaacaattgcatctgttcttcaggcactcactttcaattaaagacgcatataagatgaaagaaaagggacagaaactgatattccatgcaaatggtaaccaaaacaaagcaggggttgctaaatttatatcagacaaattagattttaagtcaaaaactatctcttgagacaaaaaaaaaaaagatcattacatagtaaaggagtcaattcaccaggaagatatgacaattagtatgactctatcagagcacctaaattataaagcaaatattgacagatctgaagtaggaaattgacagccataaaataatttatgggactttaatatcccacttacaataatgaatagactatctagacagaaaatcaataaagaaacctctgacttaaacaacactgtagaccagtggacctgacagacatatacagaactttgcacccaacagcagaagaattcacattcttctcaagtgcccatgggatgcactctgagataaatcatcttaggtcacaaaacaagtcttaacaactttaagaagattgaaattattccaagtgtcttttccaacctccatggaatagaaatagaaatcaataacagcaggaaaacaggaaaaattataaatatgtggaaactaaacgatatagtttgaataaacctccaggccaaatctcatgtcaattgtaaccctccatgctgaaattgaagcctggtcagagatgtttgggtcatggggactgatccctcatggcttggtgctgtccttgtgatagtgagttcttgcaaaatgtggttgttttaagtgtgtagcacctgctcctccttgctcctatatttgccgtttgaagtacctgatcccatttcaccttgcaccatgagtaaaagctccctgatatatgctcagaagccaagcagatgtcagcaccatgcttgtatagtctgcagaaccacgagccaattaaacctcttttctttataaattacccagtctcaggtatgtctttatagcaatgaaagaatggactaatacactgaacaacacactcttgagcaattattgggtcaaataggaaatcaaagggaattttaagagctattttgagacaaaaaaaaaatggcataacaaaacttatgggatgcagcaaaagcattgctaggagagaagtttatagcaataaatgcttatgctatgaaagaagaaagacttcaaataaacaacctagctttaccctttcagaaagtggcaaaagaaaaacactttaagcctaagcctaaaattagcagaacgagggaaataattaagattataatagaaatacattaaatagagttgaaaaagacaatgagaaaaatcaataaaattaagattttgcgtatagaaaagataaaatcaataaaccattagctagactaagcaaaaaagaaaaggctcaaataaataaaatcagaaataaaagagaagaaattacaatgggtacctcagaaattaaagaagacatgagactactatgaacaattatatgccaacaaatttgataacctagaaaaatagataaattcctagaaacatacaatctatgaaacttgaatcaaaaagaaattcgaagtccaaacagacaagtaacaaataaggaaattgaatcagtagtcaaaaccttccaacaaagaaatgtccaagaccatatggcttcatgggtaaattataccagacatttaaagaagaattaatactcgtccttctcaaattattctgacaaatagaagaagaagcactttaaaactcattttatgaggctagtgttatcctgataccaaagccagacgaaggaaagcaaaccgcaggccaatactcctgatgaacatgatacaaaagtcctcaataaaatgctagttacccaaattcagcagcatattaaaatgatgatacaccatgattaagtgggatttgtccctggaatgcaaatatctttcaacacatgcaaatcaatgcaatagaacacattaataggttgaaagaaaaaaagccacaagatcatttcagtagacacagaaaaagcatttgacagtgctatccacatagacaaatgaggttgcatcaaactaaaatgcttctgcacagccaagtagataatcatcagagtgaaaaggaactttaataatgggacaaaatatttataaaccatatatgtatatacatatatatatgagttaatatccaaaatttataaggagtgcatgtaagttaatagccaaaaatctcacataatctgattttaaaatgggcacatgacccctgtactctgttggtgggaatgtaagttggcacagctgttatggaaagcagtacagaaattcctcaataaattaaaaatataattaccttatgatttagcagttttgctgctggatatatatccaaaggaaaccattattacatagagagatctgcactcccatgttcactgcagcattattcatattaatcaagctgtggaaataacctaaatgtgcattgacagatgtattagtccgttttcatactgcttggaagaaatatcggagactgggtaatttataaagaaaaagaggtttaatggactcacaattctgcatggctagggaggcctcacaatcatggcagtaggcaaaggaggagcaaaggcacatcttacatgatggcaggcaagagagcatgtgtaggggaaccaccctttataaaaccatcagatttcatgagacttattcaatatcataagaacagcatgggaaaaacttgcccctgtgtttcaattacctcccaccaggttccttccatgatacctgaggattaagggagctacaattcaagatgagatttaggtgggggcacagccaaaccatatcaacagataaatgaatttgaaaagtatgatatatatatatatatatatatatatatatgtacatataatatatataattacatgtatgatatactattgaatattattcagccttaaaaaaaagaaaatctggacatttgcaacaacatggatgaacatggaggaatttatgttatttgaaacaatccaaacatagaaagacagatattgcattatctcacttatatatggaatctaaatagtcaagcttatagtagtgaatagagtaggggttaacaggggctgcagagaagggaaaacaggaagatgttagtcaagggatccaaaattttagttatgcaaaatgagtaagttcatttatgcaagatgaataagctatgcaagatgaataacttgtacagcaatgtgaatatagttaacaatacaatacagtagtgtatacttttaagtttgctaggagggtagatgttaagtgttcttgatacacacaaaaatatgttaatctcaagaggtgatggatatgttgattagcatgattgcagtgattgtttcacgtagtatatgcacatcatgcacatcataacatcataacattaaggtaaacaccttaagcatatccaatttttatttaccaattatacctcagtaaagatggagaaataaaaagttcatgaaacagttgtaatctatgctaatcatcaattctatagaccataaaaagtcattttgaaaattttaagacaagggaaactttgattacaaagttacgttttgaagattaccctgactgcatgggttgaaggagaccacgataaagagtaaggtgacaaagaagaaaagtagttagatggtgcaaatgcatgggatgacttgcattacagttacagcaggaaaggcagagaggagtgaattatttaagcagctttggaaggtattaattaccttccttaattaccatcttaaccaagatgtaggtcctgtttcgaaagtgaaagaacaagaattggttataataatggtaaagcatgtttcagggataagaatgaaatcatcttgagttatttagtaatctgacccaatttacttaataaataaggcaaaacttctttaatatatatctaaataaagtgacaggaacagcacattactatttacctattcattaatttatctaacaaatgaatgatgtagcagctatctatttgccaagcactggtctatgtgtttgagatacattagagagcagaacaaaacaaaacaaaacaaaaaaatctgactttgtgaagtttgactgccagtggggaaaagatgagttagagaggttaacagtttatttttcatcttcagttttccttctatatctatctgatttttttcttcgaggagcatatattcatgcgttacttttttaaaaattatttttgtctggaaataattttaaacttacagaaagtttacaagaataaaaacagtacaaaatattctatacttgttttccagatttactagttattagcattttatcttattctcttgatctttttttctctcataatatgtatacagaagaattcatccctctcattttgtatttatctgatgttctgatgtttcctcataattagattcaggttcttcattcttagttgaaatactacttagttaatgctctctcctaaaagtatcatatctggaaacacagatgtccacttgtacttcattagcagtgataatttttatgcacctgtttaaggttttccttaatttctccactgtgttaatgacttttcccctccataactaataaggaaacattttacaatcatgaaaatatcatatttctcatctaaatttctccctatgtttaacatctgttcatcacaattcttgcctgatctaatcttcgttatgaaagttagaacataattattttcaaacttcattatttgttttctgtttaccagtcagcattgacattctcctataagtaaaaaccttcccttcttccttgtctatctatcatcaatatgtaatgatgattttctctttttcaaaggttcataattcattgctgtacttattttagtgcacatgttgtcccagatgtggtcagtgggagcgtcttcaaaatggtttctgtccttgtaactcggtcccatgttttttaagtgcctccttactttccagcctcatcagatgttctagactcttttggattcagccttgaaatcaggcatttctccatagagccctggtttctttgaatgggcactaggtaaactctttgcaactgggttgactttgtttctgggcctttcagcacacagttccattaaatgtatgtatttatgtatataatacataaatacacctgtgtccatgtgcttgctatacacacatatatgtgtactttagatattatcacttcacacttcccattccagtttatctctcctgggttcttttttgcctgcttcctttccatagttgtgtttttctactgtcatgagatctctggcttcaatacttttactaattggttcagtcttataataaaactgaattagtttctgagtttctttgcctattaaagaattgctttgcttaaaaaaaactttctaaaaaaaaatgaaagtttgcagttttctcctcactgtcccatcatgtccagtactaaggatatatagtcagatactgtgttcataaataatttggcttagttctttcccacactcctcttcagtgtgctcatagtagtcatttgaaatataatttaatttattttagtttgctttctgttttaggtttcttcttcctttcctatttttattttattttataaggaaaacactaacatgcttccaaaagttaatactatacatgaaacttaaacacacacaaaaatatacagacacacacaaaagttctagtctgtcttgtatactttccactctctactccattcttcccacctcatcctttgaagacaaacaacttcattattttctggtttatcttccctatagtttttttggtaaaagttgacagaaacatgtatttcttatgtttacctcatttcttacataagatgtaatatgctatatatgctgtattatacttttttgttgtatttgatattttctataagtcatgccatatatgtatgtattataatcacaatagagtaatatgtagctataagtcatgccatttactatgtcatatgtatatgaacatatatgacatagagttacatattactctatagaggctattattatatatatatatttacagctgcatattattcaatagtggctatagcataataaccatggtttattcaatcacctatggtttgacatttaggtagtttttagttgttttgtaattataaatagtactgcaaggaataactctgtgcaaatgtgtttttgtattgttggaggtggattttcagggtaaatttctgggagcagaattatgggtcagataatgtgaaatcagttttaatgatgagaaattgaaggtgcctataagatgatatcctactgggcagagcaaattggatagattcattctttcattaaaagcactgattaactaccatgtgccccaggcactctactaagctctggggatgtatacaatagtgcacaaaaatggacaaaatgctcagcctcaggcatttaacaatcatatatacacatacatatatatggagatatatatatatatatctccacagtgcagaatgaaggagtcttagatatggagttgggattcacaatttttgggttttgactaaatcgggaataatgctcttctctaagccagatttacttttctcttttaaaatgagcaataaggatggatatttcagggcataaagaagcaaagaatagtcatacagtttttctattctccttttattctcttcttgaaacaatatcaaacatcatttaaattacactcacactaattctagacatctgtgctatttttttcagagtctaaaacacagaggtcgggtgactgtaatttggggaaggtggccacatttctaccacataacagcatttttaaagaggtgtgagaagaggtgtgtttattcctattaccttctgtggcttagacatttttttcggtaatgagatatacattccaaataccattactttatttgaagaaggaccctatctgactttttaattcaatgggcagaactcgatctgattttttaatgttgatattagagattaaacatgcattacactatcaattcattaaacattttaaacttttcttgtgtgaaagctgcacactgatcttattgtggctcacttcagtaaaaaatgatactcatgtttaataccattttcccccaagtaaattggaagaaaaagtctatacttatgtggagatataagatctctttagtcattgaaataggaacttgaccaaggatttcccagaacagctatataatgcctacatcttaatctcttagatcctttaaatctgttcagttacatgacaaagatggccaaagattgcagagggaattaagattgctaataggtggattttaaaatagttggatatcccggattatatgcatataatatatcaaattatttttattgctgtagcattgtaggaagtaaatatcagataaggcttgccccaatattaagtaggttagctgtcagtttttttgatattgcttgttagcataagtaaatttcttactatttctagattgctaagagtttttatcatgaatagtgttgaattttatcatatactttttctgcatgtactgaaagtgattgtttttttcctttctgtaaataaacatggtgaatttcattaattgattcttgaatgttaaaccaacataatagtcctgagacaaatccttctttgtcatggtacccttctatatatcgttgggttcaattcactaatgttttcttaaagtatttttgtctgtagtttatagagtttatatgtacatatacatatatatgtgtgtgtatatatatatgtgtgtgtgtgtgtcttttatattatctttatcatgttttgatattagggtttgcgtttctcataaaatgtgttgggaagtgatccctttgcatctatgtatttaaaaaatctgtgtaacactgccattatttcttccttaagtatttgatagaacaaatgagtgaaactgttaagtgaagggacttttttattggatgggaagagttatttaatatacatagagctattcagattttctgttacttctcatgtaattgtaaattgctttatcaagaaatttgtccataatacactggactttagaaatcaattaagtggtgaattatgtgcgtaattttcacataactgcttttccttgtgattatttaaatacttaaatgtataaatatatattccaataaatatataaatatatagaaatatttatttaaatttatatttctatattccagtatataaatatatatgtacttcaatatataaagtatatacctaagtgtgtgtgtgtatatatatatatatatatacacacacacaccctattactttactgttactttattataaagtaatagaaaggttgagaaatgtggcatcttttactgttgttattgtgatcagtaaatctactttccattgccaaggttgctacaaataccctgcaatggatacagtaggttttacaaccatttttacagcaaagtctctgatggctatagttacatgtgttatatgttactgtactgattatattagccacatattttgtaaaccaaggcaaattcaagtctgccatcaaagaatatcaggaaacatataactgttgcagtttgggttttaccattgaactgaaaagatgattcccttgctgactcagatattcctgattaatttttttaagaactgttgaaagttttacagaagtactttaaaatattatctatatgatttaataaataaatcagttcagtagtattcctgcttaaggaagttatattaatctgtgtaattaaatgtagtaaagttgattcaagtaaaggtttttttttcttttttttatgtaatatcttttttttttttacgtcttttttttttttaattatactttaagttttagggtacatgtgcacattgtgcaggttagttacatatgtatacatgtgccatgctggtgcgctgcacccactaactcgtcatctagcattaggtatatctccccatgctatccctcccgcctccccccaccccacaacagtccccagagtgtgatattccccttcctgtgtccatgtgatctcattgttcagttcccacctatgagtgagaatatgcggtgttcggttttttgttcttgcgatagtttactgagaatgatgatttccaatttcattcatgtccctacaaaggacatgaactcatcattttttatggctgcatagtattccatggtgtaaatgtgccacattttcttaatccagtctatcattgttggacatttgggttgattccaagtctttgctattgtgaataatgccacaataaacatacatgtgcacgtgtctctatagcagcatgatttatagtcctttgggtatatacccagtaatgggatggctgggtcaaatggcatttccagttctagatccctgaggaatcgccaccctgacttccacaatggttgaactagtttacagtcccaccaacagtgtaaaagtgttcctatttctccacatcctctccagcacctgttgtttcctgacttttgaatgattgccattctaactggtgtgagctggtatctcattgtggttttgatttgcatttctctgatggccagtgatgataagcattttttcatgtgttttttggctgcataaatgtcttcttttgagaagtgtctgttcatgtcctttgcccactttttgatggggttatttgtttttttcttgtaaatttgtttgagttcattgtagattctggatattagccctttgtcagttgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcccaggttttcttctagggtttttatggttttaggtctaacgtttaagtctttaatccatcttgaattgatttttgtataaggtgtaaggaagggatccagtttcagctttctacatatggctagccagttttagagaataaaatacctaggaatacaacttacaagggatgtgaaggacctcttcaaggagaactacaaaccactgctcaaggaaataaaagaggatacaaacaaatggaagaacattccatgctcaagggtaggaagaatcaatatcgtgaaaatggccatactgcccaaggtaatttacagattcaatgccatccccatcaagctatcaatgactttcttcacagaactggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccgcatatctacaactatctgatctttgacaaacctgagggtttttttttcttaatagaatgtgacatttcctaataaaacagcacttgaacctgttttaaactctctgaaaacatcctaactacatggttaagacagtcatgtataaaccaatcattatttttatttgattaatgaactgtatatgtgagcacaatgtaccactgaattggattctaaaggacaaagaagcatacagttccgcagatttccaaacttataatttatttttattttttttatttttttgagatggaatcttgctctgtcacccaagctggagtgcagtggcactatctcggctcactgcaacctctttctcccaggttcaagtgattctcatgcctcagccttcccagtagctgggattacagatgtgcccaccaagcctggctgatttttgtatttttagtagagacagggttttaccttgttggccaggctggtctcaaactcctgggctcaggtgatccacccgcctcgaccttccaaagtgctgggattacagatgtgagccactgcaccgggcctcaaacttaaaatgttatttttaaactgatgacttggtccagctttcattcttggagtaaatattttatttgaagttactaagtcctatttcagctatcttaacttgtttagcaataaagcttttggctttacttctattcctatttacttctctcttgttataattcttcacccaaatttgactcttattgaataaaaattagcaaagaacctatattctaccagggaggagggggcggggataatattcaaataactaaaagccagagcagaaaagaatatctaagtaaatggtgcagtttttcataaaagggaatttttatttctggcctggacagagtgaagtaacagaactacagtaggagtgattgtgacagctgcttgttaataaaacacacccttactgcaggacgtattagagactatgttaggatccaaattcactatgaaatcactaaaaacatttcttgcagagtagttcctattgttctcatttgaaagataagaaaactgaggcttagttcaaatgactttgtctgcaatatcctgcaattaatctcattccttttgtttaatatttatttgatttatacctaaagaggataattctaaattctgttccttctgtcttctatactaccacttgtattactgttaatttttcaaatacagactcccaaaataaagcatataagtagaatgatttgtctgccttttcaattgcagtacagaatataattagtctacagtataacttttatatatatatatattttattatactttgagttctagggtacatgtgcacaatgtgcaggtttgttacatatgtatacatatgccgtgttggtgtgctgcacccattaactcatcatttacattaggtatatctcctaatgctatccctcgtctctccccccaccgcataacaggccccagtgtgtgatgttcctcttcctgtgtccaagtgttctcattgttcaattcccacctatgagtgagaacatgcggtgtttggttttttgtccttgctatagtttgctgagaatgatggtttccagcttcatccatgtccctaaaaccataaaaaccctagaagaaaacctaggcaataccattcaggacataggcatgggcaaggacttcatgtcgaaaacaccaaaagcaatggcaacaaaagccaaaattgacaaatggtatctaattaaattaaagagcttctgcacagcaaaagaaactaccatcagagtgaacagggaacctacagaatgggagaaaatttttgcaatctactcatctgacaaaaggctaatatctagaatctacaaagaactcaaacaaatttacaagaaaaaaccaaacaaccccatcaaaaagtgggcaaaggatatgaacagtctacagtataacttataataattcttgtgagatcatcccttactggtgctgtcttcttgtttaactgtttttaaaattagtccctcttcattttccaaattctatccacagaataacaggaagcaagtcatttccagagaggcaaatgaatttccttgcttacaattttatgaaactagctttttgtagtcagctctttctgagagtggtgttttttaatgtggccttaaatacatcaaactattaacaatgattgttattggtcattaagatgtagagtaattattttttctgtttctttatattaaattgagccatatgaaaataccaatatatggtttaatataaatttcctaaaggaagtgttttttttcatgtaacagaatgtcacagataggggcctcaccaggcacagtacctcaagggtcttgctcctctcctctgtgattcccttggttccgctcattgtcctgtgttgtttttattcttaggttgataagaggatcatactagcagttcctataattgcaaccagatggtaactttaactggaagttagggccacactcttttatgtctctttcttaagaatgagaaaggtttccctaaagtcctccaacacagttgtttcttatttttatttttttcacatcattgtccaggattagattatgagatcattcataaactaagacatggggaggaaaatggaagtaccatgattagttcagacttaccagttgaggtggaatggatattgagtagctaaccaccgttccaccaactgtgtcttgtatgttaaccattgaagttcaatacagtcaaatggggaaaaattgtaggtttctgggaaaaaaaatagtttgtgctgcttaatataacttttcttgaatttgctattgttatcctaattttgttagttagaggcaatttttttgtttagttgctaaatcattttgcacaaaggaattataaaactgaaaaacaaatctcagttcttggactgttggtagaattttcagcttttccagaaagaaaaactgatgaggagtcagaggccgcatatgctgactaaaaattactctcgcttttctcgaagcaaaatggagacaaattctcataagcagtctcaagaaacacaagtttaaaagaatgctttacagcatgaatcaacaaatggaaacaataccttcttgctattttgtttgatttagtaaaattatttttaaattaccctgatttgattattacacattgtatgcttgtatcaagatatcacaagtaccttataaatatgtaaaactattatgtatccataataaaaataattaagttttaaaattattttaaaatcatttaaataataattttataatgatataaactagaggacattttgacaatcttggtaacagattctaaaagctaatattgctgtcatttcaggctactttagtaatttctgccaaatatgtaacttaaaaagccctaaatttgctttttggctactgctgttatgcttcattaaatatactattgtgttatatgtgttgattacattttgtgctcaatgcgatacttggccataaaatatttcctggttattaacatcagtatatcagaatcagattgcagattcaatataagtatttagtgagaaatcctcgttaagaatatcttattcaaacagttatcaatttgaaaatactgtagttctaatttctaaaacactgtcttaattgttgggtataacatagtatcagaataaacactaaccttagtcaaagtaaatagaatataagattgtattaaagtactaatatttactttagaaatttctatttagtttgttcactggtatgttggtagtaggatagttcctacttaattttttctcttaaagggaactttgctgtgtttgtcattaaacaggtagcaaaaaggaacttttatataattttttccaaaatttttctgaagattaaatttggctattgatgaaaaagaaatatttgggattggagtcactgaatgaaggcatggattctaaggcattattatttatgaatagcagtttcatagagaaagaagaggtatccaggacaataagtgtgtaggatacagcatagcgcatactaatagaatgtcttggttgtttattattttatagtctgtttgtttgtagaagaaataggaatccattgctataaccagagtagcatttttatttttagtaccgtggaaattctgtaaatgatagaaaactgagcattttacataggatctaatcttcagatttcaatgactaaaccctccagaactgagaagtattataataaaataaggagcaacaggacataatcatatagactgaagtgcttcttgagcttctgttattgactgaatgcccttagaccaatctcttgaatcttgattcctcctcattaccaatttgcctgccaaataatatagttggactgcacttctaaaatctttctcagtttttggtctctgtaattgcctgttttaatcttgtagactaccctaaaaagacaatccttagtcttaattgaaagctatttattttatccaaaacaacaacaaaaatccaaaaaacttaagaacatccagcaaataattgatcaggatgacactagaattcaggcttcccttctaggccaaggttttttgtccttctgaaatatttccaagctttatttgtagttttgcactaataaagaaggatattgtttttctttttttaatattttttctctatttttttgatcaccatcatcccattcagtaccaagcgatattcctcacagttaataaaaactcaacacatgtttggtgattaaaagaatgaatgtaattttaaaaatatttttacctattaagcttagcagcatgcatagcccaatgtgttgcatacctatttcaatatttgtacctgttaagcttagcagcatgcatagcccaatgtgttgcatacctatttcaatatttgtacctattaagcttagcagcatgcatagcccaatgtgctgcatacctatttcaatatttgtatttatgaagcttagcagcatgcgtagcccatgtattgcatacctatttcaaatatgttgaaagccatcaaggcattaaatgttgtggttacttatgtttgttttcatgtgaaactatatatttgaaatagatttatgtgtactggtaatccatgtcactgccatataatgtgattgagcaagaatataacattcttagtttttctttattttatattataatggtggaaaactgaaaattccagttagttcagttgttttcagcttaaattttgtcaattcaggatgtaaatatcatcctgataaagattctaccccttttttctcctctctcttcacttcaaattgatccaagttctgtggagacacacttcattattcagttaatctaagacaccattaattttaagcagatcattaagaaagaaaagaaatagctgtcagttaaattgtgaaattatgtagcgattttttttttttaattaagatggagtttcggtcttgtcacccaggctggagtgcgatggcacgatctcgtctcgctgcagcctcccgcttccaggttcaagcaattctcctgtctcagcctctcatgtagctgggattacagatgcccgccgccacacccagctaatttttgtattttttagtagagatggggtttcacaatgttgatcaggctggtcctgaattcctgacctcaggtaatctacccacctcagtcacccaaagtgctgggattacaggcgtgagccactgtgcctggccatgatatttttaaattatacaagaattgtgcacactagcctcttagtactttttcactgtgctttctttctgaagaatttggcaatttatgtttgcagttgtattgcttggtgtataatagtttctcaaaacagaaactagcagagttttcatttatccagggtatctttccatcttaagagatatttgtttttggcaagcatgtatgggattcatgtcatcatttagtgctaaatatttgcttcactgatattaattatagtttactattctcttttatgtatttctacacacaaaaaaattcgcttcagtggtgattcatgaaataaactttttgaaggtattttaaacctcattaaattcatccttataacaccaaaaatgcatataattcactcaaagtgacaacaatgcaaagagctttgatccacaaatacagccaatggcaactatgtaagaattgcccctgtctgacagctactgtaagatgccatcaattgaaagatgcatctgaagttcagagatgttaaaatgtgaaaaatgtgtgtcttataaactctgaaatatagtaccgttcataggaaaggtcatacttgctgtattagggttctctagagggacaaaactaatggaatatatatgtatgggaatttactaagtattaactcacacgatcacaaggtcccacaataagccatgtgcaggctgaggagcaaggaaagcaggtccgagttccaaaactgaagaacttggagtccgatattcgacgacaggaagcatccagcacaggagaaagatgtaggctgggaggctaggccagtctctcacatttttctgccgcgtatattctagccatgctggcgctgattagattgtgccaccccagattaagagtggatctgccgctctgagtccactgactcaaatgttaatctcctttggtagcacccttacagacatacccaggatcaatactttgtatccttcagtccaatcaagttgacactcagtattaaccatcacacttgcagtcttctatctttgctggccacagctgagggatagcttgtcctgcttggttttggagcacagcctctatccctgccattcttgccaaaagagcgtcctgttaacagacccactaagattataccgtgtactcctggttctgttgcagagtttgtttgtttgtttgtttttgttgtttgtttgtttgttttgagatagattttggctctcgttgcccaggctggactacaatggcgtgatctcagctcactgcaacctctgcctcccgggttcaagcgattcttctgcttcagcctcccaagtagctgggattacaggtgcctgccaccatgccaggctaattttctgtatttttagtagaggcggggtttcaccatgttggccaggctggtctcgaactcctgactgcaggtgattcactcacccgggcctcccaaagtgcagggattacaggcgtgagccactgcacaaggcctgcggcattttttttgagtcaaccagtctaccttctacaacttctatatcacctctccagagagtaggaatccttagctacttttctcataccatattgattctccacttttttcagactgctgtggaattcctgagaaagagcaactgagggatagcaacatggatttcactgagtaggtggcaattgagttaaagttatttttttaaagatataagttaatcaaataagagcctatgaaggcccagcatggtggctcatgcctgtgatcccaacactttgggaggccaaggtgggcggatcacttgaggtctggaattcaagacctcgcttaaggctggaagaccatgcttaaggctggaagagaattggcttaattcttgataagttaaaaataattccaattgggcatataaataagaatgccttcttcaatattacatttggtcgtggttgagtcatgccagggagggagtggggagtggtggttcctacagtagcccctgaacagcatgaaaacatccagaatagaattctgaggaaattcccactcaaggaatgaaatactctaaatgagagagctggtcatacagtcttataaatataaacaggttcaaggaaatgttgggcacaatgtaatatgattgctagatcataatagttatgctaatttgcatatgttttgaggttaattacgagtctcaaaacgcctttctgaaaccatatcttaagagactctttatgtggtaggtaattttctatttgaaaaaaatcttttagatattcctcagggtctcatatatagtcaagttcaaaaggctatttagtgatagaatttggattaggttctagtaattttgtgttctcctagtttatgaaactgcaattttgattttacagattgactttttttcatagtctacaaattcattatcagtattatcatgggtttcaagcgttaaaaggacaagggctgtacaaaagaattctaagtgttacatgtttttttttaataaccttcagtatattttttaaaggattaaatttactttcaaagtaaaaatatattagaacctcattatcttatactaatcatttagagaactattacagactgctgactaaagattcagataagatgaaaaagagcattattcattttcagatgtttttccaatgaagttctaaatgttattgatgattataaaggaagatttattaagtttgtaaaatatgcacattttgtttttttttttaatttggtttgatcaaatgcttttcattacgatggctcttactagcagaaatatttttggaaggcaggatttaaattaagtagtagtaaagttgtataattagaattaaaatctataaaaatttgtatgtcaaaatatagttttatattataataaactagttaggcaataagagagtaaatgggcaaacttgccccattgtagtgtttattggaaatcttgtctttagtatggataatttttgttaccgtattataaatttccaaagcattgattgttttatagattatacctagtagcttgtagctttagtaatcctcatttctgaaggttagaaataggaacaaataactgtatttataggaaccatagaaatgaataactgttgttggctcttgaataacatgggggctaggggcaccaactacacagtcaaaaatccacgtgtaatttttggactccccaaaaacttaactactaataacctgctgttaactggaagacttactaatatcatgaacagtcaattaacatgtattttgtatgttatatgtattatatactctattcttacaacaaagcatgctaaagaaaagaaaatgttactaagaaaatcataaggaagagaaaatatatttactgttcattaagtgaaagtagatctcataaaggtcttcatccttgtcttcacgttgagtaggctgaagagaaggaggaaggaggggccgatcttgctgtctcaggggtggtagaggcagaagagttgaagcaggtggaaggggaggcaggcacacttggtgtaactttacagaaacacatctgagatttttgccttttgatttctctaaaactgtttctattggtaccaattcttcttccacagcttgctttagttttagtgtccatatcatagaaaggtccatgtcataaaagaagttgaaagcagtcttgaataattggaattcttctgccacattgactactgccaatttgttttctggtacagcttcttctacatcttcttccttatcatgtggcactggttcagaagcactcatctccatcaagtcattttctgttcattgttccattgtaatgtcagttagctcttgaattactccaagatcctcatcttgacatcttttattaccgattttttttttttgcaatatccacagtttctttcatgatttccttgattggctctattgtaaatcctgtgaagtcatgtgcaacatcttgaaacagtttcctccagcagaacttactgttttgcacttgatggctctcaagtctttttcaataaaatagcagcatcttcaatggtatattccttctagactttcatgacgttctctctattgggatctcttccatagtgttgaataaacctttccatagcgtactgggtgtaataagcctaagcatccttatggcccccttatctcaaagctgaattagaaacattgtatttggaggccagtagaccacttcaatgccttcagtgttgaattcctggggttctttgtggcccaggccattgtccaaaatcaaaagaactttaaaagtcagtcccctactagcaatgtacttctggacttcagggacaaagcatcagtggaaccagtccagaaaaagagttttcagtgtccaggccttcttcttgtacaactaaaagactggcagctggtgtttgtcttttcccttcaaggtttggtggttagcagctttgtatgtaagggcaatcctaatgagaaactctactgcatttgcatgaaacagtactgttagcctatcctttcagtcttaaatcatactgctcacttctcttccgtattaataagtgtcatttgtggcttttttttccagaacagggcactttaatctgtattaaaaactgtttaggcagatgtcttttctcctcaatgattttctcagtggtttctggggactctggtctgttgcctcttggtcaacagaagctgcttctccttttagcttgacaatttttttaagccaaacctctttctgaaattattaaaccatcttttgttggcattaaattttccagctttagatcttccaccttcctgttgctttagattataatacaatgattttgctttttctcaaatcatgttagagtctgtaggtttgcatttcttacagcaatcatgcaaccacacaaaagcttaattttcaatatgagataaaaaagttatttcaaaaaaaatgcaaagatgctgtgcttgctaatgaagctgcagtgacagtttcacatttttttttcctttgttacagtggtccttaggctggattcattattctggaaatggcaggcaacccctgctgcagatctccatctacaatacatatcaagcaatccaacttctttttttttttgtaatgtcatgacttttttctgcttccagcaaaagcaattccatcatcaatagtggcattttgtatgggtgtcatcatgttattcaaggtttatgatattgcactaaatgcagtagaaactatgcgagaatcatgagagatcacttttactgcaatacacaatttactggagatacgaattgcccatgtggagatgattagtgtcacgtggtattttaaataaataccaacaacgcttgagctcaccataataataactagaggggactgtgaaattactacagtagtacactatgtactatagttaattttctacagttatgatttaatactacatctttatatttacttacatatctctcgactgcaaatagcaccatgtatagtctgtgcttatgtgcataagttttgataaattttaacatagtagatttgtatatatgttaggatcataaatgataaaataaatcagcatctacatttattttatccattcatggcatacttttttcttaaatttttaatatttcattttctttatttgagacagagtcctgctctgttgcccaggctggaatacggtggcacaatctctgctaactgcagcctccgcctcccgagttcaagtgattctcctgcctcagcctcctgagtagctgggattacaggagtgcgccatcacacctggctaatttttgtatttttagtagagatgggctttcaccatgttggccaggctggtgttaaactccttacctcaagtgatctgcctgccttggcctcccaaagtgctgggattacagttgtgagccatcacgcccggccttttttgatatttctaaactatgtagttcattgtaatatttttcaaattgtctcagatctcaaaaaaactttagaatatatttattgaaaaaaatctgcacataagtggtactatgcagttcaaacccatgtcattcaacagtcaactgtattgtatactcaagtcaactaaagtcatttatgaatattatatgaggataaactttattatgaatataacctagtctttactcacagtagttaaatataaaattcctttaaatagttagaatttctgtttaatagataatttctgaaataatttagacaaaataagcatgtgttattggtgttctttttaataatttttaagactaagtacttttattatattcttccttcccctccaaatctttctgaatagttttaaatgtttttaaaattgttctagaaaggatatttatggtatttttttctttttcttgcagataagaatgtgccttttgatgaaagaactttatctttctacaatgaagagtggaatttctatgtttaaggaataagaagccactatatcaatgttgggggggtatttaagttacatatattttaacaacctttaatttgctgttgcaataaataccgtatccttttattatatctttatatgtatagaagtactctgttaatgggctcagagatgttggggataaagtatactgtaataatttatctgtttgaaaattactataaaacggtgttttctgatcggtttttgtttcctgcttaccatatgattgtaaattgttttatgtattaatcagttaatgctaattatttttgctgatgtcatatgttaaagagctataaattccaacaaccaactggtgtgtaaaaataatttaaaatttcctttactgaaaggtatttcccatttttgtggggaaaagaagccaaatttattactttgtgttggggtttttaaaatattaagaaatgtctaagttattgtttgcaaaacaataaatatgattttaaattctcttaaa

SEQ ID NO: 701 - DNA, 24898 bp, Homo sapiens
aaggggtgcgagccagagtcgtgggtaaaccccccgctcgctggttgggcgaccttttgaagtgacagggagagaagaatttttttctttaatcccaccgcctctcctcgctgctcccttttgcactgaggcttaaggtttgaagactcgagggtaaaattgggccgctttcattctagtttggacaacggtttcatcttcagcaaaagcctctcattcgtagccccccccagctggaaaatggtctgctctgcgaatcggtaatggcggcggggcggggcgggtcctcccggggaagggcggttgctcatgaatatgcagttctcttgctgaatatgcatgaacaaaccaagatggcaggaccagtggcttgtccggaagtagccgatgtttgtcaaacggcccccggagacgggtgggcatctcctggcctgtaatgccgcgctgtaccgagccatgatcctagatccatggcctgagcctctcgaagagacttcagctgggaggcctgctctggaaggagggtggccactgtccgggagagatcacgggaccgcgacaatccgagaaaagcagattagccatggggcgggccacgaaagtcctgggggatttggggtcaaggcatctgaacattaggaaatcctccactttgtagaatatttcaggaataaaatggggggcggggatcccaaggggttctccaatgagaacggtcgtaggactttccactctccctccaaagcagagacgacaccactgcaagccacattcagagtaatccttgtttgatgtcaatgtcacgtcaccaccccaaggggggggcacaagcacgaggaaaggaaacctttgccgtgaggggaggggtggggaggcacgctcccctcccccaccgcagctgctggctctgtctttgccggaacactccagccccaatgctcttctctttgctgctgagtgaagtcctccccgtggcccacggcctccctgcctcagccgtttggatctgctcctcagactttaccccttagttatgccctgattccaggacccagcctggtctccacatcccttggtcccaggctggccccaggtcttccaggtagtccctctccaccaagtccccaagtcacccttgactctgagaggtatccctctcccacaccagttcttttccagtcacttctcctcccatgtttgtcttcagtctttgcctctatttatccctgtccctcccaacccccgggctcccaagttctatctcactcctccaccttcccttccctctcacagctgaggttccaggctgtgatgatggcaatgctgcccagcacaacccctgcccccacgatgtcagaaggtgccacagtctcatggagcatataatactgcagtataagggccaccaccacctcggaatgcaggacagcgcacaccagggcagggtgggccttggtgaccgcatagctcacacatgtgaaggagaccaaggcgaggatccccactgcccccacacaactccaactcgggagatcactgggcaacacggggggctgcagcacaaagaggcctggcacagagcccagcagccccaccaagccagataggaaggccactgttgggaggcaggagggaaagtgcagagaacgatagaccagaagccccagggacagcgccagtcctcccacgaaagcctgcccatagcccagggcggtgtagacacccgtgatcccctcctgtagtgtccagagtccaggtcccacaatgatgattagtcctaggatgctgcccaacagtccacaccagtcgtagccactgagaccctggctctcaaggcagagggtgaggacggcggagcagacggtggaagaacctttgcgaacagtggcagcgttgccagcgggcaccacctgaaccgcactgtaggcacatccaatgctgaggacgttgagcagggcatagaagtaggcccggcctcggatgtcaggaggtcccagaagggggtcgccacgcagtttaagtagcagggcaatagggaggtggaagaggcatcgacagatgagcagctccagcgagggcaggttggaagcctggtaagccatatgagaaagggggcccacgaagccagcaggcaggcccccacccagcagggccaccagcaggccattggtggcatcagagggctggcagcactggtgccagcggaggctgggtggagcggagggcggcgatgggtgtgtggagtcaggcgggttcaagtaggggtgactgccagcctgttagggagaaaggagctcagggtagacagcagccgcagcccaggcgacctggggcagggcagatgccaggatggggtctgggaccctgtgggactgtacagtgttgggctatcttgctgaggaactcttcggagctagaaagggcctaaaagatgagtgagatgttataatgtgggcctggagcaggaagcaaggagtgagcagtcctggagcatcgtttccctgggtaagttgttcctgggaggagaaaaaggacccaggatgctctctcggattgaggaaggggaggaagcctcagatgctatgcatctgtatgatgccacaggttccagagacatctgggtacaccattatgaattctatttgtgggtatctctgagacagctaagttttaggaaaggaggggaaatggagcaaccaggagctatagggagggagtactaggcccctggcccccacactcaccatctttccttggactttctcctctcctcctggctcagggagcctgggcccctcagagctccagccattgtgacatggttggagtgggggtggggttcttccctggaactctcctgaggtggtagcacgcctattttcccgctgagtccaactctgcttcttttctttctttctttctttttttgtttgcgacgaagtttccactcttgttatccaggctggagtgcaatggtgtgatctcatctcactgcaacctccacctcccagattcaagcgattctcctgcctcagcctcccaagtagctgggattacaagaatgtgccactacacctggctaatttttttttttttttttgggacggagttttgctcttcttgcccaggctggagtgcagtggtgcgtgcaatctcggctcaccgcaacctccacctcctgggttcaagcaattctcctacctcatcctcccaagtacctgggattacaggcatgtgccaccacaccccgctaattttttatttttcgtagagatggggtttctccatgttggccatgctggtcttgaactccttacctcaagtgatccaccccaccaccccccgcctcccaaagtggtggaattacaggcatgagccaccgtgcccagcccaactctgcttcttttctatttatgtctccatgactccaaagtttgtctgattcttttattctttttatggctagctctgtggctttacattaatttgtttatttatatcttgcatggtttcagagaggtttttttgttgttgttttttttttgagacggagtctgtctctgtcgcccaggctggagtgcagtggcgagatctcggctcactgcaagctccgcctcccaggttcacgccattctcctgcctcagcctcccgagtagctgggaccacaggcgcccgccaccacgcccggctaatttttttgtatttttagtagagacagggtttcaccgtgttagccaggatggtctcgatctcctgacctcgtgatccgcccacctcggcctcccaaagtgctgggattacaggcgtgagccaccgcgcccagcctcagagaggttttaaggcaaggagctgtgaaccctggctcctccatctccttagtttttaattttccagcaccagggaggagttcttgggattgtccctgtggagtttcaggaatgtgttttttctgtgtgtgcttccacctggtgttttgttgatgctgtccccagaggccgacaccaaggcctctgcatttatgttcaagtatacagatgtggatctatctgctggtggggacaaagtacccagccagcttcatgtgttcatttgcgctggtggtcgttcgtgtgtgccccgtatgcagggccagggccttctttttccgcggcctgctgagctttcctgcgcattcctggagagggtgtgtgtgtgtgtccagggctggccctctttgagtgtgccgaccctgggtctgtgagtcccaccgggcctgattatgagtctgccatgtcatgtctgcaccctgagagcctgtgtgttatgctttcaggcagtgtgcaccgctgagtgaagggcgtgcaggaggaagggcggagggagccctttccctgggggtcggtggtcttgcgcccctgccgggatgctgcagcccggcccgcgccccgctcggtgtccacccgcccggtggcccagcgcggcgcagtgtcatgccgcgggggtcagtcctggggaaggccgtcgggcgctcggagctttgtgtcggtgtcggctgcgctgcgccggcctcctctcggcggcggcggcggcggcgctggggggggactgtttccgggggtgggggtgggggtaggaccggggcggggggagccgatgatgtcagcggcggcggcggcggcggcagcggggccgggccggggccaggcgctgggggggccagggccggagctggagccggagccggagctggaggcgggcaaaaccggagcggccgggggcggccacggtgatgagccgggcctggcggacgcggcgccatcgcagtcaggtgggccctggggcgaactgggcagggccagggcggaccggagccaactgccaggccccctctccgctgcccggcgctgcgggagccccgaccgcgccccgcgcccagaccgctctcctttggggttgacctgggggcgcaggggtcgggggctgagcctggccccgcccccgggcgcgcacgacgctggggggcgactaagggggccctggtatggcgtccgagcgaggggcggccgtgggacgcgatcgcctggggccgtggaaggggaggtgctcactccctctttgaagggttaattctgcagcctaatggccccctccccccgtggggcagattgggggtggggtggggcgggtgtgagcccgggcaagcgctgcaagctgctgggagggtgatggcgtaggagccaggcagagagggggaggggtgggccgccgagcgccccagagttggggtgtgcggggtgcgcagggcgagctggggccccggaaccgccgcgccgtcggggcagggttgtggctgtgagtcttggagatcgtgtgtcttgtgctgtgtggtggggcaaggtaaacctctcctgggcaccaccgtttgctggcagccaggggtctgggtagggccctccctgggccatggagatagaaagccaggaagggtgtccagtgttgtggggcagagttacaagacgagccctgtggctttgggtgacagatgggtattctgagcagggcacagcatgctgggtgcagagtttgttcgatgtggggctgtatgttttctacagcatgtgttttctcgcatgtgtgtcttgtgctgcacctatgacctgtttatgaactgttttctgcagagctggcatgctgtatgtgttgcggagggtgccaggatgcagtgtatgtgcccttttggagggggcggttgtgggcctttgagtcagaaggcgtcacgtctgggtcccatttctgtggccctgctgaggtgtggtccagtggtgaagagggcgatggatgggtttgcgtgtctgtgatgagcgcgttgcatgggggctgcgcgtctagaactcagatcccaaagatcatgagaggagcgaggaaccccggggtatgtctcaggggcctgtgggtcagttggcactggtgtgaggggctcgaggtggaatgcgccagttgtgtttatgggatcatgggcagccaagcgaggggaaggttgtgtgtttgcaacattctccacaggattcttttgtgacgttgtttgtaggagcctgtctgggctgctgagctgggaggcaaactggtcagaaaacacatgtggggagggaggtggcgtgacaagggcagtgtgggcctcagacccaagaggccagccgcaagcaggctgtgtgtgcgtgcctgccgtctgtgtgcttaagtggcggtggggctgcggaggggatttggtatgaggaaggcgggagataaatgcagggtagcgcatggaggccggcgggaggcatgggtgttgtcagatggcccagctaatctttgcagggtctgtatgtttgcccctcatgagcctgcccagcgtgtcagggtcacccggaggagaggctgggcggccacaagggaagtaagcttagacagagaggctccttggccatgtttatgtaaaggctgggtgtgactcttgtcactaaaatggaaaaaagaaacgtgaagttttcagcctcctcctgcttcaccctctccctctctctgccccccttgtgggtatctctgacgcacactgggccccactcctgcgacggtggaagggcctcagaacagaattcgctcactaggcagattcctcagaacaggttttcctcacctttggggactgggcccttctaggggtgtgtgtgcaagtgcattccaagcctgcacaccactgtctactgtgcccggccccactggaaggatgtgtgtacgtgggggaagggagggtgctgcggacaggccctccggcatggggggctgggaaggggtggctgccgtgggagcctgctcaacaggtgcacagtgacggtctggtgaagagaaaggagccatggtccagggctgaggagctctggcgtctttaccattccctcactggcacttgatctgaaggaagctcagttcctcatctgcagaatggggctgattgtctgccctgcgtatcttccaaaagcacatgggaaacggacccggaaagtggctatagtctgggggctgtgcctatgccagcccctgtcagccctcccccaggactgggaattcccttcttggggcttcgctgataataatggcagcacacacttgcttagcactgaccgtgcaccagcctgtcctcagggcacttatatgtggccactctgtcctcagaacaacaccctgaagtaggcactctacctccctttttcaagtgaggcagctgaggtccagagaagttaagtaatctgccccaagtcacttagctagtaagaggtgaagctgtatttgaacccgggcaatcaggttgaagatcttgtgctcttaactactgtactctgctgccttctggaacattcagtggatggtcctttctgtgcaactccctccaacactcttctccccagttgctgcagaacttagcatttgcagcagtccatttcagaagacccggatgctcagggatccccagctgagggcatgagaacctgagtctctgctgctgtgtaaggtggatgctggccataggagcacaaaaggttgatgagtcagaggaaggaatgatcgttctcatcctgtggatcagggagggccaagaaggaggtggccttggagtcagatcttaacgttttggagggattttgacaagcttggggaaagagcatttctggcagaacaagccagcacaggcaaaggcatgaaggtgtgggtcatgtagaagctggagagcacactgggtgtctggggttttgttcatttgtttagaaactgggtctcaatatattgcccaggctggactcaaactcctgggctcaagcaatcctctagctgcagcctcctgagtagctgggactatgggtatctgccatcacgcctggctcacgctgagtactgtgtgtttgaagaggataacacaaggcaagattaaaaaggaagattggagctagaccagagcccttgactgcctggtagaagaatttgaactttcttctagagtcagtggggaccagtggaggttttgagcccaggagtgatagtcctgaactgtggttagggacgttgaccctcagggggaggagggctggatggaggaaggtaagcctggaggccaggggatagctgggaggccataaccttggaccacgtgagtgttaacaaggacctgagctatcgaagggaagatttccagagccattcccaagctcggcggcgatttcagccacacttgatgactgctggatgtggaagtgagggaaagggtggagtcagacatgacacatttagcacttagcacgtgagaccttgtgcggtggtttatgtaaccagctggcgggccataggcctcttcagggccaggtctagcagtatggcagagggaaagattgagcatctggggtcagctgggcctggattcgaatcttgactgctgcttacaagctgtgcgacctcgagtaaggtatatccctctctgagcctcggtttcctcttctgtaaaattagaataatatggccgggcgcagtggcccatgcctgtaatcccagaactttgggaagccaaggcaggtggatcacctgaggtcaggagttcaagaccagcctggccaacatggagaaaccctgtctctactaaaaataaaaaaactagctgggcgtggaatcccagctactctggaggctgaggcaggagaattgcttgaacccaggagacggaggttgcagtgagccgagatcacgccactgcgctccagcctgggcaacaggataatataaaacctattgtgggtggctgtactgagaatatcattaaatgaggtaatgtgtgtgaggccccaagaagagtatgaggcaaattgtgaggactccagagtggtcaacttatttatggtttcttttaatttttttttgagacggaatttctctcttgttacccaggctggaatgcaatggcatgatcttggctcactgcaacctccgccttccgggttcaggtgattctcctgcctcagcctcccgggtagctggggttacaggcgcccgccactacgcccagctaattttttattttcagtagagaccaagtttcaccatgttggccaggctggtctcaccatgttggctaggcaggtggtcaatccctgacctcaggtgatccacctgccttggcctcccaaagtgctgggattacaggcgtgagttggccatacctggccttttttttttttttttttttttttgaggcagagtctcactctgtcgcccaggctggaatgcagtggcgcaatctctgctcgctgcaaccgccacctccccggttcaagcaattctcctgcctcagccacctgagtagctggggttacaagcgtgcaccaccacacccagctaatttttgtatttttagtacagatggggtttcatcatgttggccaggctggtctggaactcctgacctcaagtgatctgcccgcctcagcctcccaaagtgctgggattacaggtgtgcgccactgtgcctggcccagaagtggtcaagttataattgtcatccctatctccaggccaactcagtccagcgtggacgatggcttccatcctggaggatggactttgaggacaggttcattcatttaccagtttttttgttttgtttttaccacctattacgtgctaggccctattctaacgacttcagatacggcaatgaacaaagcagacaaaattccctacccttggccgggcgctgtggctcacacctgtaattccaacactttgggtgtccaaggcggtgaattgcttgatcccaggagttcgagaccaacctgggcaacatggtgaagccctatctctactaaaaatacaaaaaattcgctgggcgtggtggcatatgcccgtagtcccagctacttgggaggctgtaatgagagaatcacctgagcctaggggaggtcaaggctgcagggagctgtggtaacaccactgcactacagcctgggtgacaaagcaagacctcatgtcaaaaaaaaaaaaagtctggccatggtggctcatgcctgtaattccagcgctttgggagggaggccaaggcgggtggatcacctgaggtcaggagttcgagaccagcctggtcaacatggtgaaaccctgtctctactaaaaatataaaaattagccgggtgtggtggcatatgcctgtagttccaggtttttgggaggctgaggcaggaaaattgcttgaacccaggaggcagaggttgcagtgagccgagagagatcatgccactgcactccagcctgggcaacagagcaagatgccatccatctcaaaaacaaaacaaaaccaaaaacattcctaccttttaccccttggagcttacattccagagataaataagaaataggagctgggcgcagtggctttccactatgatcccagcactttgggatgctgagctgggcggattgcttgagaccaggatttcaataccagccctggggaacatggtgaaacctcatctctacaaaaaatacaaaaattatctgggcatggtggcaggtacctgtagtcccagctactcagaaggctgacaggtgagaggatcatttgagcccaggaggttaaggctgcagtgagcctcaatctcaccattgtactgcagcctgggcaacagagcaagatcctgtctcaaaaaaagataaataattgaccaggctctgtaatcccagcactttgggaggctgaggcgggcagatcacctgaggtcaggagtttaagaccagccaggccgacatggtgaaaccccatctctactaaaaatacaaaaattatccgggcctggccaggcgcggtggctcatgcctgtaatccctgcactttgggatgccgaagtgggcagatcacaaggtcaggagatggagaccatcctggctaacatggtgaaaccccgtctctactaaaaatacaaaaaaaaattagccgggagtggtggtgggtgcctgtagtcccagctactccggaggctgaggcaggagaatggcgtgaacccgggaggcggagcttgcagtgagccaagatcgcaccactgcactccagcctgggcgacagagcgagactcagtctcaaaaaaaaaaaaaaaaaaaatggtggcgcgcgcctatagtcccagtgactcgtgaggttgaggcaggagaatctcttgaacccgggaggcggaggttgcagtgagccaagattgtgccactgcactccagcctgggcgacagagctagactctgtcccccgccgcaaaaaaaaaagagaagcagttgggccagtttcagtggctcatgcatgtcatcccagcactttgggaggccgaggcagaaggatcacttgagcccaggagttcgagaccagcctggccaacatagagagatccaatctctactaaaaataaaaaataaattaactgggcattgtggtgtgcacctgtggtgccagctactagggacgctgaggtgggaggtcatgagagcctgggaggttgaggctgcaatgaaccatgattgtgccactgcactccaacctgggcaacggagtgagacctcatctcaaaaaaaaaaaaaaaaaaaaaaaaagaatggccaggtgcagtggctcactcctataatcctggcacttggagaggcagaggcgggcagatcacttaaggtcaggagttcaaaaccagccttgccagcatggtgaaaccccacctctactaaaaatacaaaaaaattagccaggctgggcgcggtggctcatgcctgtaatcccagccctttgggaggccaaggcaggtggatcacgaggttgggatttcaagaacagcctggccaagatggtgaaacctcgtctctactaaaaatacaaaaattagccggacgtggtggcaggcgcctgtaatcccagctactcgggaggcagaggcaggagaatcgcttgaacccaggaggcggaggttgcagtgagcccagatcgcaccactgcactccagcctgggcgacagagctggactgtgtctcaaaaaaaaaaaagaaaaagtgttactaagtgccaaggagcaaaataaagtagggtcgggagataggaagttttagaaggtggggagtggccagggaaggcctcaggggaaggtggcttctaagtcaaggcttaaaggaagttggggttcactgcatgaggctatctggaggaaagaacattccagccagagggaaccgcaagatgtagggcgtctctggtgtccatgctcagatccccacctcagtggcacatctgaggtcacacaggcactgaagagtagagaaatggtaagaacaaacaaataaaaaactctaaaaccacagagccaccaaacctaccaggaagcccaatttgtgcctttttttcttcactacttctccccaccattttccaggactgagttctacaaactaaatattgccagttgttagctcatttaatctttacaacaaccccacaaggtaggaactattaattgtccccaccgtatggacaaagaaacagatacagagaggttaagtaacctgcctggggtcacatagctagtcttttccacttcctataaggccttgcagggcagtagccaggatagggcagtttaactcaagctgcgtccaaacgctgggttggctagcaacaaaaccagaggcaaataaccccatcactacctaccttctacctgaaagggaggagtttagagtatttgatttctctaagcctgttgtctcactggccattttgagtgttgaaatgagatgatacagataaaatgcttagcattatactttgcacatcataagtatttcaagcctgggcaacgtggcaagaccccatctctacaaaagtaaataaataaattagccaggcattgtgacataagcctatggtcccagatactccggaggctgaggcaggaggatcatttgattccaggaggtccaggctgcagtgagcaatgttcacaccactgcactccagcttgggcaacagaatgagaccctgtctcaaaaaaaaaaaatttttttcataaatggcagctacagagaccatgatgacaatgattgtgtgtgatcttaagggccagtccagcattgggtgtctctagttctaagaagccctgacaggtctcgtccaagtactgtggtagtcagcacacggtcacacatgcatagcccaccacatatggttgtgcaggttggcaggcccagccagtggggtgaatggggactggaggcaaagcttgactttgcccacctacacagggctgctacctcctggaggaaagaaccttgcttctaattttcagaaaggcacccaggtaggatatttgtgccctagtgggtgccataaacacgtccttcgttaatatatggtgaagtcatcaggaacacaggctttggagccaaacttcctgggatcagatcccagccctgctactagctggtcatacgtccttgggccagctacctagcattgataagccataatctgacattttatttatttattttgagacgaagtttcattcttgttgcccaagctggagtgcaatggtgcaatctcggctcactgcaacctttgcctcctgggttcaagtgattctcctgcctcagcctcctgagtagctgggattataggtgcccacctccatgccctgctaattttttatattttaagtagagacggtgtttcaccatgttggccaggctggtctcgagctcctgaacttcaggtgatccatccacctcggcctcccaaagtgctgggattacaggcatgagccaccatgcccagcctattttatttttttgaggcagggtcttgttctgtcactcaggctggagtacagtggcataatcataactcactgcagccttgaactcctgggcttaagggatgctcccacctcagcctcctgagtagctggaactataggtgcacaccaccacacctggctaatttttgtattttttgtagagaccaggtttctccatcttgcccaggctggtctcgaactcctgagctcaagggatccacctgcctcagccttccaaagtgctgggattacaagtgtgagccactgcacccagcccatggtctgtcattttatttatttatttattttttgagacagagtctcgttctgtcaccaggctggagtgcagtgacgcaatctcggctcactgcaacctccgcctcccggattcaagtgattctcctgccccagcctaccgagtagctgggactacaggtgcctgccaccacgtccggctaatttttgtattttcagtagagagagggtttcaccatgtttttcaggatggtctcaatctcttgacctcgcgatccacccgcctctgcctcccaaactgctaggattacaggtgtgagccaccgtgcccggcctattttttatttatttttatttttattttttgagacagagtctcactctgtcacccagcctggattgatctccatccagcgcgatctcggctcactgcagcctctacttcctgggttccagcaattctcctacctcagcctcccaagtatctgggattacagacacccaccaccatgcctggctaattttttttttattattatttttagtagagatcgccacattggccaggctggtctagaactcctgacctcagatgatccgcccgccttggcctcccaaagtgctgggattacgggcatgagccaccgtgcccggccttaaagagggaaagtggccaggcatggaggctcacgcccataatcccagcactttgggaggcctaggtaggcaggtcacaaggtcaggagatcaagattaccctggctaacacggtgaaaccctgtctctactaaaaatacaaaaaattagccaggcatggcggcggacgcctgtaatcccagctactcaagaagctgaggctggagaatcgcttgaacctaggaggcgggggttgcagtgagctgagattgcaccactgcattccagtctgggcgcagagcgagactccatctcaaaacaaataaataaaatttaaaaggagggaaagctaactgctacctttcagggtagtgataaggaacaaatgaggtaatccaaataaaacactgactcttggggtcccggtgagccagtggttctcatggaggcgagtaggaggcctgggcatcagcctgtgaatgcagtgaggccccttccgcaggatgcctgacctacgacctacctgaaattcaccaactgacagggcaacacttgacccagaacctcatcagtccctggcagacagggttgttaaaactttggaatatcatccctgtttaccatcttccttcttcccatccaggagaggtgtcaggaaaatattttgggggatgtgaaatggggtatatgtggggaaaaggcctttgagtccagacagtatgagtgataaatgggaaagaagatttttcaggggatgggaattgtatgaggaactcctgatgccggacacctctgaagacacgtggcccacggcatacggaaggacaccctcaaagatgggtgacagctcccaggctttgtggagggcagaggagagggtccggagagctctgctctcaagtctgcgggcctggatctctaaataggtgccgcctgtcattaccagcgctgtgtgactttggataagtctggcttttgaactcaaaccttcaactgaaaagagtcttcaaggccctgatggtgcctgcaggggaaggtggctgcgcggtgctttctctgctgctgactgcctgagcttgcgtttcagttgtctgctcttccctttgttttttggggggtttttttttgagacggagttttgctcttgttgcccaggctggagtgcagtggcgtgacctcgtctcactgcaacctccagctcccaggttcaagtgattctcctgcctcagcctcccaagtagctgggattacaggcacgtgccaccacgcccggctaattttttgtatttttagtagagatgtgggtttcaccatgttggtcaggctggtcttgaactcctgacctcaggtgatccacccctcttggcctcccaaactgctgggattacgggcgtgagcccccgcgcctggccttgctcttccctctggacgagtctcccagcaagaggtgaggtaggagttgtgattctgccgctttttaagtccagatccctagggcatcaggtctctgagtaaggcgtgggaccaggcctcctggtcttgtggcctttccagtgccctccagaggctggagcaagctggcagttgtgtatgggtcagtggtcttcaatggttgcctggcagctgcgccagaaacccccttctaagatttatggggctggaaggatgtgaggatgtcctctcctaatttgaatatctaccagcttaggtccaatttttaaaaactcacaaattattttgatatgtaaatgagaccattgtgataaatgacaacatgcaaatctttgacttcctctgagccctggagattgggccaaagggacttgagagtgctgtgacaggcttccctgaacctatggactggacctgtgctactatattgtttggaggtgaattgggaatatgcaaattatcttgtcactgtacttctctgggcccgcagaacaaggctctgcaataatctgcgtgacctcccaggtttgactggacacagctaaacaaataacctggcagaggctccggggaggggtctgggctcacccaggtgtcctctctggccacagtactgcacccctccccacttcctgggggcttttcctctcacttccctccttgaggaccctcttctgctcctcctctaggttcccctgacataatttctgtttctccgcagaaggaagaggcccagcagaagggactcgctgagccaccccccgccccactccatgttggctgtgctctcaggtgagaaggtacccagaggcctacagtgaggacaaagtagacccaaggcagcaggccagcaggggcggccattttgtctaggctggggagttctgtgaaatggctatcaggagttgtggagcttcctcctccttcccatgagagagatttgcctcacttacatctctagtctgtgacttcagaggtcatgaccccttgaccttcaccatgacctgaggtatctctggcctcttccagcctcagaagtgagttagacatactggtcttggatgctggccagacttgggtggctaagggccaacccctgacttctgtgaccagaagtgattcagccttccactagtttctgaccagcagctcctgatcctctctctgcctgattttagaagcccctgccctctgcccagcctctgagactctacccggcctcttctcccactgtctaggctggcaccatgcccccccctgcagaggtgacggacccgtcccatgcccccgccgtcctgcgccagctcaatgaacagcggctccgtggcctcttctgtgacgtcaccctcatagccggagacaccaagttccctgctcaccgcagcgtcctggctgcttcaagtcccttcttcagagaggccctgctcacttcagccccactaccccttccaccagctactgggggcgccgcacccaaccctgccaccaccacagctgcctcttcctcctcctcctcttcctcgtcttcttcctcttcttcctcctctgcttcttcttcttcttcctcttcctcttcctctccccctccagcctctccccctgcttcttccccaccccgggtcctggagttgccaggagtcccagcagctgcgttttctgatgtcctcaacttcatctacagcgcccggctcgcactgcctggtggtggaggggacggggcagctgtagcagagattggagctttggggcgccgtctgggcatctcccgccttcagggcctgggggagggaggtgatgcctgggtacctcctaccccagcccccatggccacctcgcagcctgaagaggacagctttgggcccgggcccaggccagctggggagtgggagggtgacagggctgaggcccaggcccctgacttgcagtgctccctgccccggcggcccctcccctgcccccagtgtggaaaaagcttcatccatcccaaacggctgcagacccatgaggcccagtgccgacgaggggccagcacgcgggggtctacagggctgggagctgggggcgctggccctggtggtcctgcaggggtggacgcctcagccctgcctccaccagtgggcttccgagggggccccgagcacgtggtgaaggtggtgggcggccacgtgctgtatgtgtgcgcggcctgcgagcgttcctacgtgaccctgtccagtctgaagagacacagcaatgtacactcgtggcggaggaagtacccctgccgctattgtgagaaagtgtttgctctggcggagtaccgcacgaagcatgaagtgtggcacacgggggagcgcaggtgagtgatccaggctggcgggggagcggctggaggctggcactcagcggtcataggaacaagggcggcagtgggtggggcttggggcctagaaagttatcctgaaactaggctagctgcagtaatcccagcactgtggttagctgaggtgggaggatcgcttgtggccaggagtctgggacgagcctggacaacatagagaccccatctctacaaacaatttttttttctttttttttttttttttgagacagagcctctctctgtagcccaggctggagtgcagtggtgccttctcggctcactgccacctccgcctcccaggtcccagttcaagcaattctgcctcagcctcccgaatagctgggattacaggcatgcgccaccatgcccagctaatttttttttgtatttttagtagagtcagggtttcatcatgttggtcaggatggtcttgaactcctgacctcgtgatctgcccgccttggcctcccaaagtgctgggattacaggcgtgagccaccacacctggcattttttttattttttttttttgagacagagtctcgccctgttgcccaggctggagtgcagtggcgtgatctcggctcactgcaagctccacttcccaggttcacgccattctcctgcctcagcctcccgagtagctgggactacaggcgcccgccatcacgcccggctaattttttgtatttttagtagagacggggtttcaccgtgttagccagtatggtctcgatttcctgaccttgtgatccacccgccttggcctcccaaagtgctgagattacaggcatgagccaccgcgcccggcggcatttttttttttttaagacggcattttttttttttaagaccgagtctcgctctgtcccccaggctggagtgcagtggcgcaatctcagctcagtgcaacctctacctcctgggttcaagcgattctcctgcctcagcttcccgagtatctgggattacaggtgcgcgccaccacgcccagctaatttttgtatttttagtagagacagggtttcaccatgttggccaagctgttcttgaactcctgacctcaggtgattcgccaacctcagcctcccaaagtgctgggagtacagggatgagccactgcgctcagcctctacaagcaatttgagaatttaaaaaaaaagccatcctgaggcccctgctcaccaccactcaccggtctgcctccctccagccccagttccttcagctgaggtttttttttttttttttttttctttttttgacagagtctcactctgtcgcccaggcgggagtgcagtggtgcaatcttggctcactgcaacctcacctccagggttcatcagctgaggtttgttagggcctctttgtgccatgtcctggcttgctgctgtggggaaggcctagaaggaaagagaaaactcccctcaccagaaaggactgtggcagcacaggcatgtccgggagtcattacactattccgagcagggccttgtgtttccacgtggtgtccctgttcgtaagtcgtttccccattctgccatttgggcttgagaagaaggctccgtgagttaggctgcgtcccagatggaatagctgaggcctagagtctcacagccagtggaggcactgagctcagacgggcaccctgcactgaggctggcctggtgagggaggcagcacaaggctacgggagtcacaggtttgagtgcagggtgtaggaggacctgggaggcttcagggcccttgactcaagtgcctgtgttcctgccctattccctgctgtcctgacccaggtaccagtgcatcttctgttgggagacctttgtcacttactataacctgaagacccaccagcgagccttccacggcattagcccgggcctccttgccagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatgaactgtgctccaca

SEQ ID NO: 702 - DNA, 9694 bp, Homo sapiens
gtggcagctctggttcccccgcccgggcccggctcgggttacgctctgggcggggactccgcagcggctccctagttagggggcgccccggtgggttccagctttaggggtcgcaggagcggctctggcatcacctcggagctgacgaagcgggaagagccccgcaccagtgctgcccctacagagctctcggcggggggtggaggtgaggttacacctcgtccctacccccgccttcccctccgccgcagggatccgggacccgcccccgcggagaggacggggggctgcggggaggggctgtgcggggagcgggcgggttccgcaggcccctaggtggggcggggcccgagccagagtcgagtccctgaggcgggtgggggaaggagagacgggtggcgcgaccctctgtccccgcctcggggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacaggtgagtgggcccgggtgcgttgcaagtggccgggggcgttgcagacccgctccctgaaggcgctccgaggctcagagaagaccggatcgaactacaattcccatcagccgactccctcggccgccggaaccggggtgatcggggttgtagtccgctccggagggggtggcctgggaggcgggagggcctgcggaggcgggtgcgtcctcggggtgaccttcccaccgatccccacagctaccacctggtcgggatcagcttcttcatcctggggctgggcaccctccttccctggaacttcttcatcaccgccatcccggtgagactcctggcggcgtggcagcctcgtggccacagccagcacccctccctccagccctttggatgaagcttagcgggcgcttcctcaccgcgcacctgtgacccctcgttgagctcattatgggctgaagctcggagaggggaatgcttcccccgtggctaggaaagtagaacttcagcaatgcccacatctcagaggggcaaggccaccagcccacagggtctggaatgagcaaaggcgctgccacccctctctgtgtgtcgttattcctgagtcagtcaccccaaaagtcggttatcgaacgtttgattttctttgaaataccatgaatttcattcattcactcattcattcaacaaactttttttttttttttttttttgagacagagtctggctctttcgcccaggctggagtgcagtggcgccatctcggctcactgcaagctccgcctcccgggttcacgccattctcctgcctcaccctcccgagtagctgggactacaggcgcccgccgccacgcgcggctatttttttttgtatttttagtagagacggggtttcaccgtgttagccaggatggtctcgatctcctgacctcgtgatcctcccgcctcggcctcccaaagtgctgggattacaggcgtgagccaccgtgcccagcctcattcaacaaacttttaatgtgcatctactgtggagcaggcactggggacacaggaggaaacagcagggaggctcttcagggaaggcagaaatgtggggtttgcattgtctttgggaccgggttattcatctgtattcactgcaacaactttgcaaatgcttcttgggtactggctctgtgctgggccctggaaacccagagatgaatcagcccctgggcttgagagcaagagggggccaaagagctattaataatgtaacatgatgcgtgacattccaggcttgcagcagagtgcagtgggtccccaggggagggagaaagttccttctgcttcatggaagaggagatttgtaaattgggagtagggtaggcaaagtgcatgtggaggggtgtggtcagtagggcattccaggccgaggcgacagccatgccaaaggcaggcaggcaagagacgatcagcctgtttagagggagatccacagccagggctgcctggagcttagcaggatggagcagaagatggggcacaaagggagactaggatctgattctgaagagctgttccatttggggctttgccctgcaggcaatagggaggcatgaatcggggtgttgaggagtgaggaggttaagcagaggagtggcaggctatgtgctctagagagaatgcagttgttcagcacctaggccaaagcctggctgacagtaggcgctcaataaatacccgtggaatgaatgaatgtagcagctgctgcaggagtggggatgggggctggaaccagggcactgaagaggaggggccgtccaaggctggatcgaggctcttgctgggggctcttaatgcttaggctgtgtcccagacttcagccatttaactcagcacacattcatggagctccgactgtgtgccggctgctgggaacagaacaaggacaaggcagacaagtccccacagacattagaaagcaatcacaagtgagggggaaggcagcgggggaaggctgagaggtgctgaccctccaccacctccccacctggcagtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtggtgagaggcctgccctggctcctgcgccctctgccgaggcagcttcattgaggccctcccctgcgccccctgccccccagccctactgcccagccccaggtgtcgagcctccttccccagccccctctggcctgggccccactgatgcactctgcctgcttctgagcagcgtcccggagacggtgcgcattctgggcagcctgctggccatactgctgctctttgccctgacagcagcgctggtcaaggtggacatgagccccggacccttcttctccatcaccatggcctccgtctgcttcatcaactgtgagcacctccaccccctctccagccagcctatgcagggcttcagcctggcctcatcattgaaagggcccagcatatccgagaagggcagacagcatcatggtcgctcatatccctggtgaagaaactgaggcccacagggaggggaagagtcacttgtccggtgacctaggagcaggcctcctggtcaacagccccacagaccaatggctgcacctcagaagaggactgaatagcgggtgttgcccccgagtgctcagagtccctagggaagctcacacctgcgcaaccttgtccagagtcccctgtgtatcctgccggcacctcctccagggagcctctgagtcttgcctagttgagcagcagcccccatccctgtcctccacagccttcagtgcagtcctacagggcagcctcttcgggcagctgggcaccatgccctccacctacagcaccctcttcctcagcggccagggcctggctgggatctttgctgcccttgccatgctcctgtccatggccagtgagtgcacttgggtggctggagggctggggtggcctctgaggtttggggaagagagagggcatgtgagagcaagacacatgggttctgggtgaagatggaggtaagcaggtgatatggaaatggggattgggtctggggctagggagtggggctcatgggccctgcagtgaggagtaataaccaagtgaggactgggttaactcagggacaggggcaggattcctggggctaatactggcatgtggcagcaggttgaagttgaaggataaggggatgggtttgggattcagatagtcttgggtttgaatctgcttcaccgcttaccagctaggggtgttggacaaggcttgtcacctctctgtgctagcttccccaccgacgtgattggtatagctccctgctcagattgtaatgagcatgcaatgagagaaggctactggcacatagtacgtgctcaacaaaaatgacacatggggaaagtgagagaagtgcagggctgctctggggccctgtacaagattcccatttgtcagtgaagggaggagcggaagaggctgggagtgggtctgagaagtacacaatgggaagtgggacaagagttggaagccccgtgggagccggcgggaccaggtgcctctcttctgcagctgaagttcctccgcaggtggcgtggacgccgagacctctgccctggggtactttatcacgccctgtgtgggcatcctcatgtccatcgtgtgttacctgagcctgcctcacctggtgagcctgctgttgggctcgaggccccacctcaaagcatcttggatagagtcctgagcctgaggccctgagagaggccaggggaggtggaggagacctggtctcagccctgacccccagagaagacactgaggggccccagcctccaggccaatggtatggggagggatccagacacctcaggcaagccaggcaggcccaacactttcctgtccttctgcagaagtttgcccgctactacctggccaataaatcatcccaggcccaagctcaggagctggagaccaaagctgagctcctccagtctggtaagccctgagaccctcctggggaggtgggagatgcagaggaagctagagccacctcccctgggaagctgttccatctgttcccagccagagcccacccctagtagccttgtgcaaacaggaagatcatgaagggaagttggtaggattaaagtcatccctgctgttgtttgggcctcagtttccacctctataaaatggggaggcgacagaggttccatgcatgcaaactttggatccgaagacctctgaattggaatactagtttcacaacatcccagctgtgtggcctgagacaaaccacttagccactgcacccctctgaacctcaatgtgtcatttgtaaagcaatggtaatgagataatccatctaaggtgcttcgctcatcacccgacccatgcacgcgcttcctggtagctatgcatatttccatcatgaattcccttcgcctgcagcctcagcttaggctggaggaagatcacctttttttgttttggggtgagggggttgttgttattttgagtcaggatctcactctgtcacctaggctgcactgcagtgctatcacaactcaactgcagcctcgacctcctgggctcaagtgagccacctcagtctcccgagtagctgggactataggtgcaggctgccatgcccggctaatttttttatttttgtagaaatggggattcaccatgttgcccaggctggtctcgaactcctgggctcaagcaatatgcccgcctcggccttccaaaatgttgggattacaggcgtgagccaccatgctgagctgaggatcacttgttttaactgctgggaatctcccttcgttgggcctggctgtcgggaaacctgggtcacaagcatgacccttccccgtcccccctcaccccagatgagaacgggattcccagtagtccccagaaagtagctctgaccctggatcttgacctggagaaggagccggaatcagagccagatgagccccagaagccaggaaaaccttcagtcttcactgtcttccagaaggtttggcttggatacagcccccaaccaccatctttggggaagaatggggctcacattgactccaaggtcatagggtcacagtgggtcagggacacagctgggccaggccccaagtgtcctgctcccacatggggcttgggcaagagggtggggccctgggactgccctgcctgctcacacccctgcctctggctcccagatctggctgacagcgctgtgccttgtgttggtcttcacagtcaccctgtccgtcttccccgccatcacagccatggtgaccagctccaccagtcctgggaagtggagtgagtgtcagggtggagaagacggcagggcagggggtacaaaggggagaggacgggagaggggagttggagaccagtatgagctgcagccgtttccctcccaggtcagttcttcaaccccatctgctgcttcctcctcttcaacatcatggactggctgggacggagcctgacctcttacttcctgtgggtaagcacaccagggctgggtgatccgatgttttaggaagcagtttgggatccgagggcttgaaagagcatggaggtgattttctggtagtccaaatggcctggtaatgcaaccactggccaagcagcagggagcacttgggccctggaggcgtgcaggccagggcttgcactgtgagctccctgaaagcaaaaatcatgtccagctgacctctgtgtccccagcatccagcctttgctgctcagagaatgttacatggaggttcctgcaccaggtgagggactgagcaagagtcttagttttggggttggttttagccatggtactgtatctttaaatgaaatcttccaaagagacaatacataacgcaggtgaaagaggagctggtctcatccaagtcaggacaggagctgatctacagcttccaatcccactcagaaaccccatctgcccccaagggggtctgtggaaccaccagtgggtgctctgaggaaccgagtacgtaaactgtagatgcggtggagagcacaagctggagcctgggagaggcagaggtgagccccaggccagtccctgatttctgggtggacttggcccaggccccagtgctgggtcctccctcactggctcacaaggtaggtcaggtcagaggaggtcagggggtgacagatgggtctatcctatgggtgggccaggcgtggtggctcacacctataatcctagcactctggggctggacgcggtggctcacacctgtaatcccagcactctgggaggccgaggcgggtggatcacgaggtcaggagttcgagaccagcctggccaacatggtgaaaccccgtctctactaaaaagataacaattagcaggtgtggtggtgcacacctgtaatcccagggaggcagaggctgcagtgagccgagatcgcaccactgctctccagcctgggagacagagcgagactctgtctcaaaaacaaacaaacaaaaaaacccctaaaatccgagcactttgggaggccaaggcaagaggatcgcttgagctcaggagttcaaaaccagcctgggcaacacagtgagactttgtctgtacacacacacacacacaaatttttaatgaaaaaaatagaggccgggtatggtggctcacgcctgtaatcccagcactttgggaggctgaggcaggtggaacactcgaggtcagaagttcgagaccagcctggccaacatgatgaaacctggctctactaaaaatataaaaattatctgggcatggtggtggcaggcgcctatagtcccagctactcaggaggctgaagcaggaggatttcttgaacccaggaggtggaggttgcagtgagctgagatcagggccactgcactccagcctgggcaacagagcgagactccatctaaaaaaaaaaaaaaaaaaagtactctatgggtgtcctgagatgccctggagcagagacctggctccagggaccatgctgacttcagcttctaccacagccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggtccggggcaatggggtggggtggggggctgggagtagggaggtgggttcagtctttgggaagggaccgcctgcaatggagggacggcccatcctgcttctggccagcccaaccctagctgtctgcaggccttgctggcgccccctactgggccaagccttaactgcaggggagagaactgggctagggaggtacccgcccaaccaagtagcccaggcactggttctggggccgcctcaatgtgcctcagtttccccatctgtaaaaaaaaatgggttgaactgtcatccctcagggcccatctaactgtaaaattctcagttgaaggagagctaaggttttgaccaaaaacaaggtcatgggctatttcctcaaggggcaatggagtggagaatccagagagaatgaagctggcagggcagacaggctgagagcactgtggaaagggcaggctgtggaatctggaatcccatcatgttagactcagaggccctgagagacatccttatccagcagcctcatttacagaccaggaaactgaggcccggaaagaaggggccagttatggtgacagaggggttgggtcagagcccagactggatgggcagagggcagtggagctgggtccagatttagacccagcattttctaagagctcctgttcccgggtgttctaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgta

SEQ ID NO: 703 - DNA, 35359 bp, Homo sapiens
gtcacatggtcgcggctgccctccccgtcagccgccctcgccgccgcggtgcgctggctgcaggaagccgccgcgccgccgcttttgttgtcagggacccagcgaggagcgccgctcgccggccgccgccaccctctctcgctgcagcctgctgtgcgctgcacggcctggggcccgggagccccgcccgctctgcccatgagggggccccgcgaccaccgctgcttccagcccggggcggcgcggcgctgaggcggcggcggcggcgctgccccctctgcgggaagcgggcggccccggccgcctccgcgagggcaccatggaggtgaatgcaggtaagaaccggactgcggcgggtgggggatggccggagggagcgctcagagcccgcggggcactttggggggcggcggcagggggtgtccccatggccggtggggcggggtgggctgctgcgcgccgcgtgtccgcctctggctcggttcccatcgccccccgggccgcccggcgcccgccctcttgtctccctgcaaagccgcagcgcggcctgccggcgcccggcccggcccccccctcacatggcccggccgcgcgagccacgtgcgcgctgtgtttacgttcggcggcgcgcgggcgccggttggctgggcgggcgcgtgacgcggcattacataatgggcgctgaggcggcggcggcgggcggggacacgtgaggccgctcggctccctgacccacattccccggggccgcagggacacgtgggggcgggggcgcgcgcgcgcgcgctggctgggagcgccgcagcctcccgggaggctccgcccctttggaagcctcggggcagtgacgtcgccgcgattccctcctcccccgcggggttgcacactgcggaggaggccgcgcgtgcgcgcccgctgagcccccgcggcggggcgtccccgaagcgggcgctgacaccgcagtgcaccggacgccgcacgctcttttcgcgaggtgaccccaaggcgcggaccccgcgcaaaccaaacgaaccggcgcctggggaggctggtagctgcataccttgcagattccgaggaggaagtgcaggacgagggcgtgctgcaggccggaggaggcgcctcggggaaggcgtggggctttcccgaagggatacgctcgaaggagctctgaggtgcttcgatcccgagcgactccccgcagactgggtagcaccgcccctgttaggatgccgtctgtttacaaaaaaaaccgtttgctctaggacgcgacctgtctcatacacacacagtcttaaaaactgcttccagatcccttcgggctggagttttccagtaaacgggtcacacccgcagctgagcgtgcagctcacgtatggtcaggatgactcaggtgatcataggtgactccaacaccatatgtaagactggacattcttcatttaaattaaaaaaaaattaacctgtgggtcgctgacttttcctgaatctgatcaagagaatttggctttataaatatttttcttgtcacattttgttacattgcaacggaacaacagggtgcccttccctccttttgtctgccccaaatgatgaggtagatctgaagtgagtgaggttatggaaacagccagcttttgttttattttttgagttgcaatgcgcctctaagaatcttgcctcgataacaaatgtattgtgaacttttcaccaaaagtaaaaataaagtcactttctaattttatttacgtatttttagaatttacttattttttttaacctgttgtctcacaaaaatctggatctaattgtgttttgattacctaatcggcctacttagcctttgagggtatttttaaaattttatgagtttatcatagaattaaacttctacatgttagaattcagaggtgatcagggtgaacctcttctaacccaccctttagcatgaattctaatagctttagtaacctcataagggctggctcaattaggaagtttttctctggtttgagccctcttccaatacttcgctgatctaaatcttgcctcgtggagcaaggcacattataaaaattcctccggatgaatgttgaccatccccttcccccttcagttcttccatttacagttctcatctctttgtccttgcccagcattgttttttctgatcactcatcatccttgttgccgtttgggatggagcacccagaagtgaacaggctcttgtggaagtggttggatgattatcaagttccaagttgccctctttgtcttgaatcctgttgcaaatgaattccctggcaggcttagtatttttggcatgttgctttgctgactcacagtaaccttgcagtcaactaggacctttcacgtgaactattatgaagttagatttcattcattgtgcagataattgcatgacttgaagtgtaggaatttacaatgaccattcttaaaatttctctcgttcatttggccttaagttcaaagctgttacaagctgttacccaccatgtttacagtttctgctatctatcagtaagcaggaggtctaataagaattgccttaaactggccgggcacagtggctcacgcctgtaatcccagcactttgggaggctgagccgggcggatcccctgaggtaaggagttcgagaccagcctggccaacatggtgaaaccccgtctctactaaaaggacaaaaattagccgggcgtggtggtgggctcctgtaatcccagctacttatgaggctgagcagcagaatagcttgaacctgggaggtgaagattgcagtgagccgacatcgcgctactgcactccagcctgggcgacaagagcgagactcccatctcaaaaaaaaaaaaaagccttttaactttcgaatttttgtaaacattgaccaaggtggggccagattcagcgctgtgtggcacacctctacccttccctctagtttggttatcagttgacaaacattcaaccagtgatcctgtaatcttactgtccttcgtgacatctctatgtctcctcgccccatgagtaacaagtgaaaacagtggagtaaaagacttggaaaaaaattggagaggtggagcaaagaaatctttccttggagcaaggaaaagcaagaattgaagaaaagttgctctactggtcagtagggttaagagattcaaaaggtagtgtggaaataacctacaaagaaaccactggatccttaacacacattaaaaaatgaggtgaataatgggtagggaggattagttactttggtttgaaccattctgttggaactcttctagtataatgatgacaaaaaaataatcatcagcttcttactctgtgccaggccttttacatgtgttcctcatgttaattccatgaaggaaggtgccgttgccaccatcttaatgatgcggggctaagtaaattgaagctaaataacttactcaggcaagtagtagagccagaatttgaatccacaaaatttacttgggaacacaaactgttaactactgtgctataatgtactttagcctgcataatatttgaagatttatacgcaacttggtggtcctgtcttcttgagggtgaaggagatactgcatgtgtatggatccccactcaatttgcagtgatatatgtaggttatagctagtggaaaaggatagtcatctgcagggcctcccagtttcatcagtcctctctttagtcatgctggcttatttccagacattagattacaccttgacctcccttctccagtaatttacatggagataaaaataatgtctattttataaaataagaccgatttggctgggcatggtggctcatgcctgtaatcctagcaatctgggaggctgagatgggcagatcacctgaggtcaggagttcgagaccagcctggctaacatgtgaaaccctgtctctactaaaaatacaaaaattagccgggtgtggtggcgggtgcctgtaatcccagctacttgggagactgaggcaggagaatcgcttgaaccgaggaggcggaggtggcagtgagtcgagatcacaccattgcactccatcctgggtgacagagcgaaactccgtctgaaaaaaaaaaacaacaaaaaacacaccatttatttttgtgtcaccctatttaaaaaatgtctcttttgatgatttaaacagtcttcaattccccacttagatattgcaaccttggatgtgtttgcccctattgatttctgccctctttagtatgatcctcagcagtcacaatcatgtgtgtgaaacattgctcctaataacataggtgtttccccagttggcctataaggcattttagggaaaggaccatgctgttctctggagccctgacacctaggacacaattggaattttagtgcttcagttagatctactctaccacccttggagtagaaattatttataacacttttaaaatgagggaaactaaagcttcttggtgataaaatgttttgttctaagtcacaaggcagaaaagtacagtcatgacttgaagtcaaacataatctccaggatggtggacagaggaagtgtgagggttttgatgatggacaagtgtagaaaatgggtaagaagaccccaatatatgcaggaatatcagtgcttcctagcagtacaaaattggatattgacttaaggcttgtctgaagttgaccactgggtaagccctagcctgggaacctggcccaggtccagggtccctttcaactgaaaatagagaagactgcttcagctaattttagctcagggtttcaaagaggtacatactgcctgtttcttggaggtgttgggacttgctggtttggggatttttactcttcttactttatcatcaaaaacagtgtatgaaaaaagcacttatgaatgccatttcatttcagtcttgtaataagtggcagatattccaattttatagaagaccactcaggtttagaaagattgaaagtgacttgcttgctcaggtcttctcaccaaataagtttgtactctggaattggacaaccttgactttaaactttggcctgccacttagtggctgacttatcctctctgagctccttgtttaaaaaatgatttgatgaaagttaattcacagagttcttcttgtgaggatgaaattgtgtcattttattcctgacatccagtaggtacttggtgacttgtagtttcactttcctttcttcattaggttgaggaactactagatgtactccttttcttctaagaaattaaaatttaacccatttgggttgctatcagtcaggttcatagatgggtgtctagtagcaagaatagatgccaagacaactaaatcaatattgaaggtcttgctaggagaatgcagctacttctagatgggtcttctttgattttctggtgcctggcacagatgcttgttttcttaagacaggaattggatcttcgctggattgataatagcccagtagtttcttttaggttggatattgaagcttttgcaaaggaaattgttttttggttaattaattacgatacagtccattgccccgtcagtgcttgcaaccaatttttaagccatctgcatagctctaatttcttttcttttctctttctttttctttttttttttttttttttgagatggagttttcactcttgttgcccaggctggagtgcaatggtgccatctcggctcaccgcaacctccgcctcccgggttcaagtgattctcctgtctcagcctcctgaggagctgggattacaggcatgcgccaccacacctggctaattttgtatttttagtagagatggggtttctccatgttggtcaggctggtcttggactcccgacctcaggtgatccgcctgcctcggcctcccaaagtgctgaggttacaggcgtgagccactgtgcccggccagctctaatttctaaaagtttatttcttagctaaggtagtcagcagatcttgtgaacataaatgactgaaaatgggggccctaggaaagtcttacttccaaggaaaaacatcactttcttatcttttattttcctgagatgttagatgtgaatttagtacttaagacactattttagagaagacaaatagctgtgagatcttcctttggaatttcattgaggactaagaatatttgtctttgtaaagtgtcctattgtgagtggagacatctgtgaaaaagtagcagtgtgctaatacctggaatttttaatgtggacttaagatctctaaagttatataaagacagcacaatggttttatccagtaacatgacactggctaggtttctaggttaagttggtttctctttggattcacagggtattaatgatattctggcggttgtatcgatgaaatcatcaatctttaaaactatgggccaatttgtgtttgaattcactgattgtagccattttgaaacttcaatgtgcaaataattgcttggagagcttgttaaaattgcacattcctgaggatgtgttctcgtctgggcagggccttggaaacatgtattctgaaaaagcaccagctagttttgaggatatgtattttacataatttctctgggtgatgaaaataaactcgaagttgggaatctttcttcttgtgtttgtagttttggagtttttagattttagaataaatggtagatgaaaactaccttggtcactttgtcttccagggagcacagatgaagtagttggcttgtggcagtgttcttcaaacttggatgtgcatcagaatcaccaagagggcttattaaagtttctgatccagtagatctggagcggagcctgataatttgcatttctaacagattctgggtgatactgatgcccctagtccagggcccacactttgagatggttggtttgtagttagggaccatgttgcaggaaaaatattaattgcaggattaattaaggtgagatgcacatagcaagagagcatatggacagtgggtttaactgggaagagcagatttgcacctctcacctcatgatcgagtccaggcataggcttcatgaataaaacagtggatggaattgtctacgttagtgatatttttgtcttaaaaatcaagtgcatatagttgaatttatgtatgttaaatttgtgtctgggctgggcacggtggctcacacctgtaatctcagcactttgggaggtggaggcgggcggatcatctgaggtcggaagttcgtgaccagcctgggcaacatggtgaaaccctgtctctactaaaaaaaaaacaaaaaccaaaaacaaaaattaaccaggcgtggtggcgggcgcctgtattcccagctattcaggaggctgaaggaggagaatcgcatgaacccgggaggcggaggttgcagtgagctgaggttgtgccactgcactccagcctggacaacagagtgagactccatctcaaaaaaaaaaaaaaaatcgtgtctgatgaaaaacattgtgtgtttcttggcatagtaggcacctgttttatcttcccttctgggttgcactcaaaccccttgagagttgtggttgtgctttcctcctcagagggtttgtttcttagcctcaatatatataattggtgcttaaaaacacatctgatatctactacatgacagactaaaagtgactctaaatttctctgcctgtttttttttttcttgcctaaagacggcaatgtctgtctttttgggattgttttggcctcagcattttgctttgtggatttttgtttaaaaatgattgataggcccggtgcggtggctcacacctgtaatcccagcactgggaggccaaggtgggtggatcacctgaggtcaggagttcgagaccagtctgaccaacatggtgaaaccccatctctactaaaaaaaaaaatacaaaaattggctgggggtggtggcatgtgactgtagtcccagctattcaggaggctgagacaggaaaattgcttggacccaggaggtggaggttgctgtaagtcgagattgtgacactgcactccggcctgggtgacagagtgagactctgtctcaaaaaaaaaaaaaaaaaaaaaaaaaaaaatgccagttttcagaagggttgtggcggttatataaaattgggaatcacattttgacaatagctctgtgtagagggaattagcttcagccttactgttattctggtatagcatgcattcttctagcatctttaacacctataaagagcgagtcagaagaacaagtagtgagtctggatttcttaagagctgcttagagatgaatggcagaatggggtagagaagggagagtattgaactggggattggttagtggatagccacatatgtcttctgggaacaccaaaacagaaaggtgtgggagcaagggctgtgaaacgatccctgttttgagataatttaccttatctaccattctaaatgttacatctgttctggattaacctgtgcttctagccaagtgttgggggaggcaaatgataaattcattgtttctaggattgtgtcagataactataacaggaggcaaagaagagaccagaaccagatttcttcatggccagtttgtttgagcaatgaagttacttaggagcattttttagtccttttaggaaaatactggaaaatgaaaagctttaggtgtgaggatctccatgtgctcagaatatccaagccagtgaaatccttctcacttaattttttctttctttgagatggggtcctgctctgtctccaggctagagtgcagtagcatgatcatggctcactacagccttgaactcctgggctcaagtgatcctctcgctttagccttctgaatagctggcactactagaggtgctgggtgcaaaccacatgcagcaagtttttaaatttttttgtagaaacagcattaccttatgttgcccaggctggtctcaaattcctaggctcaagcgacaatcctcccacctcagcccccaaagtactatgattacaggcatgagccagtgtgccgggcctatctccctttttaaatcagtgggagttacatgtgctttgaactttgcggaagcaggacgaataatgggaaataaggaaatactttattttttgcttttggtgtaagcaaacatttcatatcagtatcctgtttctaaagttaatggctttactgttgagatttgcaaaaataaaaaatacgtattatcttgtatctaattatgtgattttcctcctattttctaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaagtaagttactttggttttctaaagattgctgccattaattgcaaatggggcttattttatcagcttttcatttaggtggccattatgtttctgggtacagttttcactccttgctgggtaatcatacatcagtagttagggaagaaatcagtgatgatgatagaagttataacctaggggctgtcattaattcttgcctcagagcaagacatgtgattatgtactctgcctgaccctggtccctctagggtaccctcttttactacatttcacagttacttttcttctgaactactagaactaagtcttgtttctagaacagagtacttgctcattgtgggaaggggttacgttagtgaaactggatttgggaatatttgggatgaggaaatgttggattgggataaccaaatgagtagggggatttggacctatctggcctctgtaggtgaagtaaattgacacagctgcctgtggagagatatccctttccaccttttattgattgacttctctgtctgaattcttaattgttatccagagaattgttttcttagttctggttgcatatctggtataaagtaactctaaatttacaaaatttcttatttcctgctgacaggtctggaaaaaaaataaatttacaaaatttcagtgtaattctaaaatcaggaaaggaaaaatccgggtcagcgaggtatttttgtcagtgccataagttgtatttaaaagaaaattatggctgggtgtggtggctcacacctgtaatcccaatatttttggaggctgagtggggcggagtccaggagttcaagaccagcctgggcaacatggcaaaaccccatctctactaaaaatacaaaaattagctgggtgtggtggtgcatgcctgtagtagtcccagctacttgggaggctgaggcatgagaatcacatgaacctgggaagtgtggaggttgcaatgagctgagatcacgccactgcgttccagcctgggcgacagagggagactctatctttaaaacaaaacaaagcaaaacaaaaaaaaaacaccgtaagaaaattatgattgtgattacttttgatttgaaaatatttttcttttacattatgaaagtagatgtgtatcttctaaaagctcttacacgttgaatgaaataaaatatctaattggaaagaaaacagactcggtgtttcctcctactttttacttcgtgtccttttgtgtcctagaatttagtggcatggttctactgtgtaaagtctgtggggatgtggcgtcaggattccactatggagttcatgcttgcgaaggctgtaaggtaaagcatgcttttgtttctttaagctactgattctgggatttaagaagttgggtttagatttacccatttgtgcaattgatagtctgagagacagtgagaagtcagctgctctttttaagttttaagcattttatgtagtgtataagcataacttgttttgaataatattcttaattcagtgaaagtatttcttttttctttaagattttgaacaaagtaaatttgctatctcaattaaacatacttattgtgttaaaccaagtgcaccaaatgctcattcattaatgtgtcaagcacagttctaggtggtagtgaaataacaaggaacaaaacagagaaggcactacttctgccttgtgggaacttagtttaaaccaaactttgaattaggatctcatcatatactttgacttaatgacacgtcaggtactgggagctgggaataattgctacatacttgaaaaaaatgtggtatcttaaaaaataatgccaagtgagtaaaataatcctgaatataagttgagcccttgggaaagctagtttatttgtaagtttagttgactattttctagttattgctattagagtattggtcaaataattccaagtgagatggtctctacctccctacctatatacagggaatctttctctctttttaaaaaacttggcacaatcttttctcctgagtatcaaaaattaacgtgatgaagacacatgttcttgctgttctctgacttgaggccacaagcaagaatctagtttggcgagatatgatgggtaaacaagataatgaatatacatgatgggagaggaaatattttcaagtgtggctctgaatgaattgcgagtttgccagtttttttttttttagatggagttttgctcttatttcccaggctgaagtgcagtggtgtgatcttggttcactgcaacctctgcctcctgggttcaagtgattctcctgtctcagcctcccgagtagctgggattacaggcacacgccaccactccaggctaatttttgtatttttagtagattcggggtttcatcacattggccaggctggtcttgaactcctaacctcaggtgatctgcccgcctcggcttcgcaaagtgctgggattacaggcgtgagccacgcgccctgccaagtttgctaacttttaatggccgggtaactttgtaagacaagtcagtattttttatagatgtagcatttttttcattgtttaaaaaagattctccttctctatatatctttttttttttttttttttttttttacaaaaatgtgaagtaataggccaggtgcggtggctcacgcctgtaatcccagcactttgggaggccgaggcgggcggatcacgaggtcaggagatcgagaccatcctggctaacatagtgaaaccctgtctctactaaaaatacaaaaaaaaaaaaattagccggacgtagtggtgggcgcctgtagtcccagctactcgggaggctgaggcaggagaatggcgtgaacccgggaggcggagcttgcagtgagctgagattgcaccactgcactccaagcctgggcgacagagccagattccgtctcaaaaaaaaaaaaagtgaagtaatattggggaaggcattattcttactttatagctagaaaataaaagcacaaactgaatgagctgattgcatattcttgataaatacacatctgtgcagtactcttaaaatgtctagttcagctcttgtagtatctaagtcaagtgtatagtatcacaataataaaatataaaaatgttgtgtcccatgactacttagtatagattcgggaaatgtgtttagttgtcatataaaaggaaaatgcagtttaaaataatttcagtaattgcattcttgagttttctgtcctccctggtaccatgaaactggagatctttggagacctatcacagaacatgtactggaattgtttgtgtgtggagtaaaggcagctgtttgtagccatctagttgggaactgtctttccttggatagttagctactctgttggtgtgtggtgtaacacttacctgttgctggcacgtagtcagtgatttctgtcatgtataagtaggccttgccattgtcagcaggtaatgatcctggaaagaccaacttctgttaatgtaatccacaatctagtgaggggattatagctatcaaacatatttctcagtccactttttaagaagtagtcatttaggctgggtgcagtggctcaggcctgtaattctagctctttgggaggctgaagctgtaggattgcttgaggtggagtgtgagacccacctgggcaacatagggagaccctacctctacaaaaaataaaaaagctggatgtggtagcacatgtctgtagtcccagctcttgggaggctgaggcagaaggattgcttgagcccgggagttcgaagttgcggtgagctattattacgtcattgtactccagcctgggtgacagagcaagaccctgtctctttaaaaaaaaaaaaaaaaaaaaaaagcctggacatggtggctcgtgcctgtaatcctagcactttgggaggccaaggtgggcggatcagttgaggtcaggagttcaaaaccagcctggccaacatggtgaaaccctgtctctactaaaaatacaaaaaattagccaggtatggtggcacgtgcctgtaatcccagctactggggaggctgaggcaggagaatcccttgaatctgggaggtggaggttgcagtgagctgagatcgcaccactgcactccagcccgggctacagagcaagagtctgtctcaagaaagcaagcaaacaaacaaacaaaaaatcaggtccggagtggtggtggcttacaccctgtaagtctaacacttcgggaggccaaggctggcagatcacttgagccctggagttcaagaccagcctaggcaacatggcaaaacctcatttctacaaaaaatacaaaaattagctgggtgtggtggcgcatgcctgtagtcccagctgtttgtgaggctgtggttggaaaattgagccagggaggtcagggctgcagtgagctgtgatcatgccactgcactctagcctgggcaacagaacgagatcctatctcaaaaaaaaaaaaaaaaaagaatcagtcattcatacttcaagagttttggaatttgtagtgaataaaagtatgagatggaaaatgtgactgcaggcagggtctggtaacagggtagtgtggttgttgcaaggggtgttttgggtaaggacaaagaatctctgaagggaagaagaattttgtttggttagtaggtgttaggtgcttactcataccaataagaatcgaaattaaattctgtgtgtcaacattgtatttccctctgtcctaagacatagtgtttcccagatagtgagtcatatactgggactgtagttcgtcatatacactagataggtatgggagcagtgtttataagaagttcatttgggtgtttttaaatgggtaagtaaatcttcctttgttcttagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatggtatgttcccagtttaaagagtgttcctaaagtgtatggagcttggcttttattcctcatcatgaaccagagctataaaccggttaccaaggaccctcttgtatttaaggtgaagcagaaaacatattttcatgctttacaggacaccaaattgattaaagtcgtattttagcattatcatcccagaaacagtttttggctaaacttctgttgttgttgcttcttctaaaaagagccattttttttctgtgcaatttgattactttttattttttcctaaaaccaatggagtttaaaaacattttttatatggccgggcatggtggctcacgcccgtaatcccaacactttgggaggctgaggtgtgtgggtcactttaggtcaggagttccagaccagccatggtgaaaccccatatctactaaaaatgcaaaaaaaaattagctgagcgtggtggcatgcacctgtaatcccagttactcgggaggctaaggcaggagaatagcgtgaacccaggaggtggaggttgcactgagttgagatcgtgccactgcactctaacctgggtgacacggtgacactctgtctcaatgtagcctctatctcccaggttcaagtgattctcctgcctcagcttcctgagtagctgggattacaggtgcccgccaccacacctggctaatttttgtatttttagtagagatgggggtttcaccatgttgaccaggctggtctcgaactcctgacctcaagtgatccacctgcctcggcctcccaaagcgctgggattacaggtgtgagccatcaggcgtggccaggagttttttgagtaacagatttcagcaattgatgttttgttttttcaattccctgaaattttttttatagtgctaaaagtactaatgctataaaaatagttgatggatattgtgattgccctgaaagaataaaactgacaatcatttgtgaagggaggagtagagataaagtatcaaacatgattaagttgtttgtttttggtagcaataatgttagaggctacaattagattaacgaggctttctgggcaagtatactgaatttttattatctctgtgtaaatactagactgtgaaagaagcttttctttctctcatggataggattattggagacaagacaccttctaagactagcttctaaaagaatagaggatgacttatctcatttttacttatttcactggttttaattaaaatctaccaagtttatttttcagtaagtgcatttctactgattgtggaattttttttaaggattttttttttaaagaggctggaaaagaagacagcagataatttcatagttagatcttgagagcaaagttacaaaaatgaattgacaagggccaggtgttcagggaatgatttcacctaccagattccattaatggtaatggatgtgtgtagctgaatcacacatgccttgctgggaacagtcctcagctttgttagtaaggagctgtgtagtaatactggtctgcttcaaactggttttcattagctaatttcatatttcttttttctttttctttcttttttttttttttttttttttttaagatggagtattgctctgtcacctaggctggagtgcattggcaccatctcgacgcactgcaacctctgcctcctgggttcaagcgattctcctgcctcagtctccagaatagctgggactacaggcgcccgccatcacacctggctagtttttgtttttttagtagagacggggtttcaccatattggctagtctggtttcgaattcctgacctcaggtggtccacctgcctcagcctcccaaagtgctgtgattagaagcatgagctactgcacccatccgaatttcctatttcttttcttagactttgcttataaaatacctaggaggtagatgtccttaactttgttgtggggggaaaatagaaaattttctctccctctcctacttcctttggtgcatcaagaccagcaagtttagaaaaatgtggaccagagacatgtagactcattctttatatgtatgactagaggccataactgttggataattttgtgttattcttttatacaaaacaggtcttatttagaatatagacgttaaatatctttttcttcaatagctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctggtatagtgaaatcgattttttgcttacattgtatcagggaaagctttgaaaattttcttttattcgggagatatgctaacttggggggatggtgtcaggaaacctaagaaatttacagacttaattttgtacagtattttaggtcaaataattttaataaacatcttctgatgaatgacctaatttcacacccagctaggtacaagcatgtgatttgattgatctgagattgggattaggattttatgtaaaatatgattcatgcagaattggtcctttaattcttggaaatccctttgaaaatttaagcattctggttaattagtaccttactagctttgggattttctcaaagggccgaacttttcgcttgccatagttagaaattctttgatttctatagaaagaggttttttttttttttaaccattattatgcaagaaggtctttggatatagaacatagatgttttattgtttgataaatttaggagtattttaatttcataggctaatttctaaggattttctcagacttcatcttatgagatgacttaatgttggtcatatcattgaagcttttctatttttccatcaaatacgacattctacatcaaagtacagtgttcatattcagccaaaatttcaccaaaaacagcagtaccacaccatttccagtttaaaccatgaagtcctttgatagtgcttggtattttctactgacaggtaattaaagtcgtctttttcattttcaaaatagttgactctacctcaatcttcattaaaatttttgttgtcacttggagttatttgattctgtggaccttatgttaggctaagtcgttgcttttttgtttttttttttgagacattcttgctctgttgcccaggctggagtgcggtggcgcgacctcagctcattgcaacctccacctcttgggttcaagcaattctcatgcctcaacctcccaagtagttgggattacaggcatgcatcaccatgcctggctaatttttgtattttcagtagagacaggtttcaccacgttggccaggctggtcttgaattcctggcctcaagtgattcacccacctcggcctcccaaagtgctgggattacaggcatgagtcaccacgcctggccaagtggctgccttaatgaaggaaaaatctgtgggcattttggttctgatttcatgatattctctatggttttgtaatcatcccattcctagattttgtatggatttagtgaaaatttaaaggctgattttactaatagaatatacaggtgtgtttcatcatctttttggtgttttttttttttttttaataacttcttggcttcctattttccctcacgcagtcgtcatttagaagacacacctgtatctgcagtccttgtttcctgattgaacaagtagaagtcagtgatcacagcattgtttttgaaataaatgggcagtgacttttttttctttttttttttttcgagacggagtctcactctgtcacccaggctggagtgcagtggtatgatctcggctcactgcaacctccgcctcccggttcaagtgattcttctgcctcagcctcctgagtagctgggactacaggcgcaagccaccacgtctggctaatttttttaattgttggtagagacagggtttcaccatgttggccaggctagtctcgaactcctgaccttgtgattcgcctgcctcggtctcccaaagtgctgagattacaggcgtgagccactgcgcccggccaggcagtgagtgaccttttcaacaaaatgaggcaccttgctgttttttcttcttggaaattacaacattgtaattctacctatatagaaataaaggagtttggaaatattaactaaatgtgaatttgggcctaggcttgtgacttctggctgtgttggacaaatcactaaacctctcagagtctcatttctccacctaagaaatggaaattataatctgccatgaataatagattgagaatcaaacaattgaatttgtttgcaaaattataaaacaccatatactagcataaggtggcagcagtgttacaaaataaactcttaaacctgtgcaacaggtgtttgaaatagcttgttatagatgatatttttgcttaggcttttttttaatgataagttaattgctatttatattaggttgccaagaggctttctacagtatggtgggcagcaaatggatgaagtgctaatatctcagtagattttacttgtgttttgggggttaaattcatgttggggtttctgataattgagatgctgcttttgacatttctttaccacctcttagtatttaagagtttttccgttttatgtatactaggtttgtccattgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggtaggttttatttatcctgaatattgatgcaggcagggcatgtagtattttattttcatggatgttttaattcttttttttttttttttttttttgagacagaatcctgctctgtcacccaggctggagtgcagcagcgcgatcatagctcactgcaacctctgcttcctgggttcaagcattctccagcttcagcctcctgagtagctgggactacaggtgtgagctaccacgcccggctaattttttttgtttttttttttttgtagaaacagggttttgccttgtggcccaggctggtctcaaactcctgagctcaaagcgatctgcccactttggcctcctaaagtgctgggattacaggtctgagccactgtgcccggcagatgttttcattcttttctaagtcagtatttatagtccagagtctgaaactatcaacaaaataatcatcatctcaggattttgggaacagacttgggagacttggtaaatccagaattgtttaggattttatatatattttttacttattatttaggatttgaaatataggtattctgtatctacagcatatgaactcctgagttctagtattgcttttagatgtggacttaacaagtttctgcagtgttagacacctcctgaaagcctagcctagcatttactgtattcgatacagaataagaagggcaaatagaatgtgatttcgtttttcgagagactgtagaatattttggggatatatcagacatttcttatgtgccaccttagctcttcctggtttcaccttgcttcaggatccttggctacttttctgtcccgcttctcttgcaacactgtatcctgcttgggcttggggtagtctctactgtataacttaacagatgtgcctctcctggtccttagttaggtgtctttcaccttctgtctgccccagggcatcccttttgctgccaaggtgtgagatgccttgggacctaattaaggacaactctgagattggggtggtgagaggaagttgatgtttggtgggccaaatctttgaaccttttatggatggaagaagtgagccagggctatattttcacttctccctggatttattataacggagggagtgagataactaagtaatataattgttaaccgatttaacttggatgtcaattataacatggtgcttagaacacttactgtgatagctttctttgtggatagtctctttgggtgttggtttcttgaagcagttcagttagacttcatctgcttcctttgccttggctgcatttgatgtgttgatgtttcgaagtgttgctgcattggaattttgctctttttacttaaggcatagaggccatgtgttatacttggcagcctaaagagattctttaatgcctttggccagggcccagttttaaatttactggcactatttcttgctctaattttatattgcatttcagaatctttgttaatagagtggcagagtatctttgccatgagtggctagaatttcttttgatgttcttcttggagtatttattgctttggtagagaatctgtcttaagaaagtggttttgggaccgggtgcagtggctcatgcttgtaatcccagcactttgggaggccgaggcaggccgatcacttgagtccaggagttcgagaccagcctaggcaacatggtgaaaccctgtctctacaaaaaatacaaaaattagctgggtgtggtggtatgtatttgtattctcagctattcaggaggctgaggtggaaaggatcacttgagccggggaggttcaggttgcagtgagctgtgattgcatctccggcctgggcaacagagcaagaccctgtctcaataaataaataaataaataggccgggcgctgtggctcatgcctgtaattctagcactttgggaagccgagatgggtggatcacctaaggtcacgagtttgagaccagcctggtcaacatggtgaaaccccatctctactaaaaataaaatcagctgggcgtggtggcgtgtgcctgtaatcccagctagttgggaggctgaggcaggagaatcgcttgaacccaggaggcagaggttgcagtgagctgagatcgtgccactgcactccagcctgggtgacaagaagaaaactccatctcaaaaaataaaatctggcatggtggctcacacctgtaatcccagcactttgggaggctgaagcgggtggatcacctgaggtcaggagtttgagaccagccttgctaacatggtgaaaccctgcttctactaaaaatagcaaaaattagttgggcgtggtggcgcacacctgtaatcccagctacttgggaggccgaggcaggagaaatgcttgaacccgggaggcggaggttgcagtgagccaagatcatgccattgcactccagctcgggccacaagaacgaaactccatgtcaaaaatagaatagaatagaatatagaatatagaatagaatagaatagagtggttttgagtaaaagtataccctgtttttcttttataactttcttttatatgtgggatgattcataactgacttgattgaatactaagttatttttttattattgctgttagacttctccaaatacatttctttttctttttccaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcaggtaagcaagctggttcaaaattgtgccacacctagcatatagtgaccaactggggagaagatggcagttaacagggttccagaaagttatatagagggaataaggccttaaggaagatgctaaattgtatgaccctgttatttttgtgtaactaattttttcgttataacaatatatgtcaaagtactataggaataaagtaatacttacatctaggccttgtgtttaccactgttagtctttagctttttgttcataatttttctatgagtctaaatctttatttcatgaatttgttagaacattatgtatctccaggtaggtagttgtaatatgaatttcagtttccattcaaatacaatgtgggttacttgaaaacattaaaagtatcaagaggtattagtgtggtttgttgcagagaaatgtgaattagttgtaggctttagtccagttctgccattgaattatgtgggtaacttgggtaagtaactttactcttttgggtcttggattccttcctcatcctgtcaaaggaaggggttgtaccatgtgagcctagtgtggtgtctggcatagaagagctactcagtcactgtttgaatgagtgagcaagatttttgagtttctaatgtttatttatatgagtcatttatgatgtttcccaatgcccctgccatcttgcattaatattacagttatttctgacagtacccattaaggcagagattgttactcccaataacaaatggaaattgaggtactttcctgggtatgtctaagtaagtgccagctatttttaggcatcattttattgtataacatttgggaattttttagtatttggttatgactttgtttcccatttgcttcctactgtgtaaagggcactgtgctaggcattgtgagagttataagttacggcctctgattatgtagctaaaccataaattagtagctcttgaaagagaacaagttcttggccaggcgccaggggtgcacgcctgtaatcccagcactttgggaggctgaggtgggtggatcacctgaggtcaggaatttgagaccagcctggccaacatggtgaaacccccttctctactaaaaatacaaaaattagccgggcatggtggcacgtgcctgtagtcccagctactcaggaggctgaagcaggagaatcgcttgaacctgggaggcagaggtggccgtgagccgagatcacaccagcttgcattccagcttgggtgacagagcgagactccgtgttaaaaaacaaaaacaaaaacaacaaaaaaaaaacaagttatttgtataattttgaggacctgtacctcagtggaataaagacttgccatttggtaacataatttggctaccttttctgaccagctctacctggataactaaaaatgtgtatatgacgtgggagtagtatgaaaggaatatgtcaataagggatatctgttttatagctaatttataatgcctcttgcattttacctatcatttgcagaatctcttgataagtaattagtattggtttgagttgacatcagattaatcgattattttgaaaccacagataatcaatacttgttaaattatttatctgatgaatatgccgtacctattaggtgctcagggggagacagaaagctttaaggcacaagcttgctaagtgttttcattctttttggagagatgaaactacacaaagagctttatgctactaaaccgtgtagttctctgtctgaggtaagctggagttgtagaaaggaaggtgaaatcatcttggaaggctctgtggggaaagatagaagtggagctggaatttgaaggttgaattattaagctttcccagtgaagaagagatggaaaggcatgagagagtacgagatagggccggggaagggtcaggtggccaaagcctggagtgtacatcaaggaggaagggggacaaaagccttcagagttaggggagcaccaggttatggactaacagctatgagaactaagcggggagattttaaccaaaatatggggcagaagaaagtctgtgtaccttcttaagtaggagagtgatctggttgaacaaagtgatgtttaacattaattctgcatttttattgtggtgggcagattagataggtaagtcattagtgctagagagttaggttgagaagcttttgaaatgacatcaggtggggtgaactcttctaaaataaattaaggcaggtgagatgaagtagaagggccaacttcccagaggtagttcagaggaagaaatgatggcaaaggggtagagggaaactctgtatgccaggaacgaaccttgttatttcaggataggaacatgatttttagtttgatttaatctgtttttgaaaaagccttttttctgattataaatttaatatgggttctttgaaaatgtagaaaatattaaaatggaaaaaaaaggttataatatcactaccagaaaagatcactattaatattggggagtctttatccatttacctatccatctatccattcgcctatccatctatccatttacctgtttgtttatataggatatattttaaaaatggaaaattaagtgtgaaagactgattgtaaaagaatacagtgcattctaatttttgttatgtcactgtatgaacatatacaagtacacatatatgaagtttcatgtcaaattttaatccttaccacttaaaaattactagctgttttttgttgttgttgttgtttgtttttttatttttatttttggagatggagtttctctcttgctgcccaggctggagtgcaatggcatgatctctgttcaccgcaacctccctctcctaggttcaagcaattctcctgcctcagcctcctgagtagctgggattacaggcatgcactactacacccaactaattttgtattttcagtagacagggggtttctccatgttggtcaggctagtctcgaactcccaacctcaggtgatccgcccgcctcggcctcccaaagtgctgggattacaggcatgagccaccgtgcccggccaaacagcagcataaattactagctgtttttaaagcagtatctaggcaggaaaatgaaattcaaacgctacagaagagtttaaaatgaaaagtctctgcttttttcctctttcctccaccccagccttattcctcagaaaactggatttcttaacacccttctttttaattttctggttgttgaccacccaactctgaatataatgcttatatctctatacctattttttttttttttttttttgagacagagtcttactctgtcacccaggctggagtgcagtgatctcagctcactgcaacctctgcctcccaagtagctgggattacaggtgcccaacaccatcctcagctaatttttgtatttttagtagagacagggtttcgtcgtgttggccgggctggtcttgaactcctgaccttaggtgatccaccctcctcggcctcccaaagtgttgggattataggcgtgagccaccgtgcccagcctatacctctttttatttagtgagtataacttataaataaaagtatccttccttttccctctcaatttttttatgttttattttttaatttactttaatggttttgttggtaattttaatatactcacagtttttgaccttatacataatgtcttttggatagtttagatagaatctcttaattgttcaaagacagttttttctttgtactctgacttcgctgtaacattccttttatgtagtcaattaaaacatttatatcttgttctatcactgtttgtcatgatttgatcagtcaattcccaaagttgaaaagttgaaagtcagcatttatggtattatgattatgtaaatagtacttacagtgttcacacagtgaggttgaaatggtaaagaataatggaaacctcttctccaaacctctgcaccttgaatcagggaacaaatggatagtttatttcagttctctattaattgtttagaattaagtaacatagtttgctttatctttaaaatagctttttcttcttggaaatgtatagtggtcttcttttgttgtttttgggttgtcagaagaaatggtagttaatttctatatctcattatattactttatcctcacagtagatccctgtgagctgggacatgttattcacagttatacagacaagggatttgaggaacagagggattaagtaatttacccaatgtccatttttaattactggctaagcaagtatttgaactcccattagtctggcttcaaagcctttccattatactgcttgttaacagaatagctctagctgctaagggggagaaaaatctcaaacatgatgtttgcctgtaagattggaagaatcctagtatcatggaaggggaattatacctggaaggtaagtttcttttcaggttgtttaaagtaacagcagccacttccagttgaagattaaggacttgcatgtaggtgtgaggtcaaggctcatttacatacagacttcagttgtcttcatagagatttttgttgaaggtttgactttcatcctgtaggaagtgaaaataaatagaatatttggtgaggagtacaagcttgggagtgcaatgaagaaccagctaaggagagagaagatagaagtgtcataaattaaactctgcagtactagtgtagcatttagtacaccatttagaagatgaatttccacttcaacatgtgtactcttaacattatagtctccagaagattgtttaccatccagccaggtttgtaccttaggttctttggccttgaaatcttaaaaaccatggttttagaaatggaggctttagaaaaatttaatacaatctatggttttagatataggcatccatttccctgaagttctgagttgtataacgaagcataggtcatctaaacacaaaatagccactgaaagaccaacaacttcaaacatttttaaattttttgtgtgacttcctacacctgtccaaccaactactactaatactagttcccactcaggtatcttcccaacttatcagttgtttctttctttgcccacctagattattttgtttgtggggattactgtcattctttctcagttttcggtattataaattactaatcatatgattgaaaccagagtcatgcgtcgcttaatgacgtaaatatgttctgagaaatgcattgttaggcaattttgtcattgtgtgaacatcatagagtgtacttacataaacctagatggtatatcctactacacacctgggttttatggtatagcctattgttactagggtacaaacctgtacaccatgttactgtgctgagtactgcaggcagtttgtaacacaataagtatttgtgtatctaaacatatctaaacaaagaaaaggtacagtaacaatagatatgaaagataaaagctggtatacttgtgtagggcatttaccatgaatgcagcttacaggactggaagttgctgtgggtgaatgagtgagtgcatcgtgagggcatgtgaaggcctaggatattactgtatatgactgtagacttaatcactgaacacgtacggtacactaaatttattaaaatttttttttcttccataataaattaaccttagcttgctctgttttactttataaacttaaatttttaaaagctttttgagtcttgtagtaacacttagcttaaaacaacacattgtacagctatacaaaaatattttctttatatccttattctataagcttttttctatttataatttatttatttacttcttaaactttattgttaaaaactgtgacagacacatacattagcttaggcctacacaggctcatcatcatcaatatcactgtcttccacctccacattttgttctactggaaggtcttcaggagcagtaacatgcatgagctgtcatcatctatcaccttctatatttctatgataacaatgcattcttcaggaatatctcctgaaggacctgcctgaggctgctttacagttaccttttttttttttttttttttttttttaagtagaagggacgggcgaggtggctcatgcctgtaatcccagcacttggtgaggcccaggctggtggatcatttgagttcaggagttctcaaaaaatgaagtagaaggactatactgtaaaataatgataaaaagtatagtatagtaaatacttaaatcagtaatatagttgtttactattattaagtgtaataggtttgcttaccccagcatcactataaacgtgttagttatgtgttgtgctatgatgttacgacaacaaaagctgcaacgtcactgggcgataggaatttttcagcaacattataatattatgggaccacccttttatatgtggtctgccattaactgaaacattgttacgtggcacatgactattttcctctgtcagaatgtaagctccttaaaggcattcttgttttgttcaccgctgatttccaagcaccttagaacagtaaccagtacatatgtttaataaatgtttggcaaacgatttcatcaagtgaaatagtgttttttttaaaaaaaccattacttgaatatcaaaggcaagagggactcttcaaatcattactgaaggctttatttttatgaagataatttatgattgaccaaagttaaatgtcaagagaaagaggtctctgccagtagttttgtctgaaaaattgtgaccctccccctacccccacaaaccaatatccaattttttttttttttttttgagacaggctcccactctgtcacccaggctggagtgcaggggcatgatctcgactcactgcaacctccatcccctgggttcaagtgattcttgagcctcagccttccaagtagctgggattacagatgccaatcaccatgcccggctaaattttgtatttttagtagagacgaggtttcaccatgttggccaggctggtttcaaactcctgatctcaggtgatctacctgccttggcctcccaaagtgctgagattacaggaatgagccaccacgtcctgcccaacattctttttattttttgagacagcatctcgctctgtcacccagactggagtgcagtggaatgatcgtgggtcactgcagccttgacctgggtttaagtgatcctcccaccttagccacccaagtagctgggactactggcatgtgtcaccatgcccattcaattaaatttttttttttttttgtaaagacaaagactcactatgttgctcaggctggtctcaaactcctaagctcaagcaatcctcctgcctcggccttccaaagtgctggaattccaggtgtgagccaccatgcctggcctttttttccaaataagaattaacatatagttgtaatgttcaaattttgttaaatatgagataaactggccaggtgcagtggcttatgcctgtaatcccagcactttcggaggccgaggcgggtggatcacaaggtcaggagttcaaggccagcctggccaagatggtgaaactaaaaatacgaaaatgagccaggtgtggtggtgggtgcctgtaatcccagctactcaggaggctgaggcagataattgcttgaactcgggaggcagaggttgtagtgagccgagatcgcaccactgcattccagcctgggtgacagagtgaaactccatctcaaaaaaaaagataaaacttatttttatcattcttctgcatttagagttaatcaaatttttctttttttgccctttactattaaattttagtccttgttttaagtgctttcatggcaaatgacctttttcagctatcacttataatggaagacctcctcaatatccttgtaaaaaaacgaaagggcatgaatggccagaagttttgattccttgtagaagttagaaatctttttcttgttaattacaacctcccatgtgggggaccattgaatatttttgtatactcctgcctcctgttgtaaagggaaaaaaatactcttgctgatgaaaacatctatgggtgatctacataggtttgcctgattttaagatactttattgcaggcttatgccaaatgactggtttataaacatattgtatgacaaatttaataaacacaatatgctaaatgaaagtgaatgtagggttacatagcaataaagttgcatagtgtattagttacctattactgcataacaaattgtcccaaaattcaggggcttacaaatgcaaacatttatttaatctcacagtttttgagggttaagatatgatatgagagataggatatgatatgtgcctctgactcagggtttcttaggaggttatagttaagctgtggacagggctgtggtctcatatgaaggcttgagtagggaaggatctgctttcagttgtatgtagttatcggcaagattgagttccttgcaagctgttggactgagcacctcagttgcttgctgactgttggctagagcccactcttagttccttgccatgtgggcctctccacagggtggctcacagcatggcagcagcttttctcagagtaagtgagcaagagcgtacctaagatggaggccacagtttcttgtaagctaatctcagaacggacatcctatcaattctgccatattttttttcattagaagttagtaagtctaggtccacttagtaggaggaggttgcgcaagggtgcgaataccaggatgaagggatcattggaggccattttaggggctgcctaccacacatggtgacatacaaatgggagtgtattccatatgtattgaaaatatgtttatatactacattattttattttgctaattagaagcagttgaaatcagatgacatctaattttaaaaagtcagaacctctatgttcttgtgaataaaaattcttaacagtaaagaattttgattgatcaaatgttttatgtgatatatatgctttataatatagtaactagctaacgatttgttactgagattttgagaaatttgtcaacttttgcctttattcagatgtataaaaccttgctttctattcgttagtgacactgataagcaagaattttatttatatttaatgttaataatttatcctgtttttcctatttccctattcctgatctctcttagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttagactttttcatctgccaaaaccaaaaaccattttgatctccctgtggttatcaatataacgcacaatcacaagtgtatgaggacttagaaattaatcctttgtggtaggagttctgttgaatgatggaaatcttattactaccacaagactatttgatctggtaattggagacttcgggatttaggagatctccatgtctgtatttactctaccactgctaaagtgtgtggtcctgggtagtttacttgcttgcggaaaatgagaattgatggtgtccccaatgccccacctcacagagttactaaaaaatgtctgtaaagcatatttacctcttgggagataggcactatgtaaataaggtaaaatttctgttattacaattattcataataatattcttttcttatttctaagcctttctgggaaatcatttcagtccacaccaaccatattattcagggttcctgccatatgtgtggggtatcctactgatacacacgtattcaaagtttatgggtacaacaaagacatagtacatgtacataatatgtatgtgaatatagttaaatatatttcttcacaatattttaaactgtgaagaactttatcatacaggaaacttaaaacaagaggtgtcaaaagacccaaattaggtgcattttacttgtttatgatggcataaccattgctttaaaatgtttagacagtagaatattgaatttatgctctatttttgtttatttaagcaacacttaatgtaaaagtgcaacaggcaattgaatccaaatttcaacgacaaaaaaaaaaaacatgtattttagagttcatctttggcaaaatctttggttcagggtactagttgtttaaaagttgattcatattcttaccttgtgctgagaaaggttgcattgctgccccttatacacatgctgcagcttgatgttaaagaatttttattctttctgaagaactaattaatgtttaaagcaactgtttaatatgatggcatgtgtgtgtgtgcgtgcgtgtgtatgttctgagtccacttcttttttcctaaataacactacagggattttgtcatattagatttaatttataatttgaaaaatcatctagtgtgtgacctacaggcttagaaatggtatagtcaaagacattttatccacatttctaatagtggacttgattaagtagataagatcagcatctgtttatggtagtaggagaaatagccaaagttgaggattttatgtatgttttcctgtttacctggaaaatagcaattaattggattttttggtaaagattgccttctgtataatgtttggattatataaaattgcaaaaatgataacagcccgctttactgtactaagcctgttactttcatgacgtgtgagcagaatgccttattttgtaatcttgtttaacttgttgctactgggacttgatttactgtggcactagttaagtaagttaaaaaaaagttaaaccctctcattattaaagaggaaaggcgatggtgatgtctgtagtacaatataaaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaacttctgagttggtgggacactgttgattaataatgtactgtatgaattaagtgatgctttaactttgattttacattttaaagttaaaatgtgggcattatgtcagcaaacttaagggcattatgtcagcaagctaaaacattttttttcctgtgcttttaatgtatctctttacatgatctgagagaggattcaagttgatagaaatagctgaggggaaaagggggaacatcttgggatgaagcttgtccttatggtgatggtttaattacagattaaaaaattagaaggaaatttcagtggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaagattgactggattcgatccaaaagataaaacttgaagctattctggaactaacatggaaaaatgaaatggctattgtttaaaaaaatgatagaaatacattgttgatgggatatgagttaagtttattttctacaaactgtaattgatgaggacatggataatatcttcatgtttctgagaagtaatctgtatgtggggggaggggataataaatatttctaaccaac

SEQ ID NO: 704 - DNA, 52586 bp, Homo sapiens
agaagagcgggctaagacgccggaggaggtggcggcggctgggagaggcgagggttctggccggtaagtggagttgtggagaggttcagggtggccagggctcgcggttggccgtgagccgcggcggacttggtgctgcgggccgactaggccacgcgaggtggtggagcctgcccacctaggcgagcaggaatcggaagacatggcttcctctgatgcagcccgcacgcgcgctggggtgttcactcgccttccagcgcgctgccctgaggaccgggctgactcgcgcccctactgagggcttggggccgagccttgccgccaggagaagcgatggtctcctcctgaaggccgccgttgtcttgtctccgtgtgatacagtgatttcactagctggattgatcactttggggactgcaactcctagagagaaatggaatggagggcatctgaatcttcaccccctatagataagcttgtgttgcaccccaatttttgtgaggtgagacattaaaaatgaaaaatcccctgatgattagaattttgatttcaggtccaccttttggaaattttttttcagaaaagaagtgctttgctttttaaaagccctttagttcgtatatgcctcgcctcttgggagtgctcgagaggttttttttgtttttttttccttcaaagtagctttcaaaactatgctcctagaaaacttaaaacatgcaataagggcttctaaaaaaacactttattttcttaggcaaacatactaagattcagtaataacatttcaactttaaaactttacattttctcctagcatgctattggaccaaaaaacacaacaacaaaaactttccattttctttattgtatttactaataatttatcacactgaaacataacttttgaatacttaagtgtaatatcacggatagttaacagtgtgttttgtatttgtagattttagcatcgaaactaggagaaataagaatggctgtagaggaacttcagtctataataaagagatgtgtaagtattaatttttgtaaaattaaatacctttcaaaatatgggaagggcacagattgtttttaattatatttgtggtcactcaaattgtttatcttctttaatccttgctttttttgacctgtaaagagcatgagtgggggaggcagattggattatttctccaggtgacatacttatctaaataaccttttacattttaatcctgatccttttcatagatttcactggtacagtagatttcaaggtcacttattaaagtatttattagggtaatcctaattttgatacgtgtgttatttacgttacatttatctagaatttaaacagatttccttttttcatagataaatcaagaagttattgtatttaatttttatttgcatatacttttttttgtttgttttttgggttttttttttttttgccagcaaatcctagaagagcaagactttaaagaagaggattttggcctatttcagttagctgggcaaagatgcatagaagaagggcacacagaccagctattagaaattattcaaaatgaaaagaataaggtgcgtacaatcttggtgtttacttttcagtcttgggaagagaataatcacatgatgctattcatccagtcatttatccatcaaacatttaagaatctacttaaattttcacagtagggaactgaaaacaaaaaaagaattagaaatatttaggccaggcgcagtggctcacgttcgtaatcacagcgttatgggaggccaaggcaggcagatcacttgagcccaggagtttgagaccagcctgggcaacagagtaagaccctgtctcagaaaaaaaaaaaaaaaaaagaaaagaaacagtcatatacttgaaggtttttaccatctggtcaaacataaacatgtaaacaactaacaataatgaggcaaaataaataattgctatagttgaagtaaagagtttttagaagaaacagaattacttctggtttagggagtccaaaaatggtgtttgagtcattaatttacaatgagaaatatacatatcaagcaggctaaatattcattttgggtgatcagcccattctcctccagccaaatgtgtatggaaaaccaaattttaattaaaacagtattttatgtgcatagaatcagaacaggaggaaaacgatatgtcattatactagccagtatcatccagttacaatggtttgagaaatcatcctccacaatggaaaaggatcttatttgtggatcaggaataactttttcctgggacactgtgttggcaacatcctgccaaattttgtgtctttggatactccttataaggaagacggctatggtttggctctgtgtccccacccagatctcaccttgaattgtaataatccctgtgtgtcaaggatgggaccaggtggaggtgattgaatcatgggggtggtttccccatgcttctcatgatagggagtgagttctcaccaggtctgatggttttataaccatctggcatttcccctgttggcactcagtccctctcctgctgccctgtgaagaggtgccttccgccatgattgttaagtttcctgaggcctccctagccatgtggaactgcatgtcaattaaacctcttttctttctaaattacccaggcttgggtattttttcatagcagcatgagaacagactaatacaaagaccatcttccttctaggtacacactctttcttcatttgcagtgctacttatttattagaagttttctttcttgatatcacagtgtaatcatgttgatctgtgtttctctccagggcatcttgattggatttgggggattcctaaaactttttaatcatatattattataacatctcttagtcagtagttcaaatggcttatacccttcttattttttattaaaataggacattttatttagtttttgatacatgtttatgataactttgtaacctccaatataataaatcttatgttttttaaactcttcttgatttttttctaattgcgttctcaggataaccttctaaagtacttagctttcagctaataataaaaaaattaataacaactaatatttattgcatgtttacatgtaccagatgctgtctttagtcctttacatttattaacttaattagtctctccaaaatctcagaaggtaggtgttcattttgtaactgaaaagttaaatgacttgcccaaaagtaagtcagcttttatgtaacatccaagattcagacctgtgtagcatggttttggagctcctaaccactctgctctacctctggttagtgctgtatggcgtatggttttagggtagaatacaggggattgcttgattgagagggagaggcatcaaaaatgactgggtttctagcctctaaaaggataacatatgatatcaaacagaaaaaggcaacctaagtagagggaaaagttttctgaaggaacaagtgagttgacttttagaaattttgagtttaagtacagcagtcaattggaaaataaggttttgagctcagtagagatagaggaattaagatgtagatctctgagacacatatctgtgagactttaattacctaaagattgggtaattgaagcattgaggagtgaaaaaaaaaaacaagaatttacctgagttcacataaaaggggcagaagagaagaggcccaagatcccatcttgaagaatttaagaaacaggtagagagaagaggcctgccaaggagatgaggatcagcaccacatcagtgaggcagaaggaaaagggaagtataaacaaagtatttttcaggcattgcatgccttagcgttttatttttagcatgcttctgaatagctaatgggatagatttaaacatgtgaggcttagtcttaatagtttgagaatcacctttgcaatatgtggtcagctaaatgcaaaggtttagatattgataagacaatgttcaaaactgactacaggctgggcacagtggttcatgcctataatcccagcactttgggaggccgaggcgggtggatcacctaaggtcaggagttcgagaccagcctggccaacatggtgaaaccctgtctccactaaaaatgcaaaaattagctgggcgtgatggtgcgcccctgtaatcccagctactcgggagactgagatggggggattgcttgaacccaggaggtggaggctgcagtgagccaagatcgtaccactgcactccagcctgggaaacagtgagaccccatctcaacaacaacaacaacaaaaaactgactacaatttaattttcttgccaggtgacactatcaaaattgaccaagatttactattatcttcacctataagactgaattaaagaaaaaaaataaaaataaaaagatttactatttactgctttgtgagagaccattcacatactatttattacagtatattataattgttgtagttattgttaatctcataaattaaactttgtcacagatatgcatgtatagtatttatatatagtgtttggtactattcatggtttcaggcatccactgggggtcctggaatgtaccccctgcagataagtggggagactactgtatcgtatactctatttttattatcttacaagactggggtcaagatgaggtattataggtgtcattttgtcttcttcctagatcagattttttttaaaaaaattctaatttttgtgggtacatagaaggcatatatattgatgggtacatgagatgttttgatatagacatgcaatgtgtaataagaatatcatagagaatggggtatccatcccctcaagcatttatcctctgtgttacaaacaaaccaattatactcatttactttaaaatgtacaattagttattgactatagtcaccctgttgtgctatcaaatagtaggtcttattcattacttataacttttttttttttttttggtacccattagccatcttccctgcctcccactaccattttcagcctctggtaaccatcctcctactctctacgtccgtgagttcagttgttttggttttcagatcccacaaaaaagtgagaacgttcaatgtttttctgtgcctgacttctttcacttaacataatggtctacagtcccatccatgttattgcaaatgacaggatgtcattcatttttgtggccaaatagtactccattgtgtatgtgtaccacattttctttatccattcatctgttgatggacacttaggttgcttccatatctgagatattgtaaatagtgctgcaatgaacatgggagtgcaaatatctcttcaatatagtgatatcctttcttttgggtatatacccagcagtgggattgctggatcatatggtagctctatttttgtattttttgaggaactgccaaactgttctcattaatggttgtagtaatttacattcctaccaacaatatctaaaaaaaaaaatacaaaaaattagccgggagtggtggcgggcacctgtagccccagctacttgggaggctgagacaggagaatgacgtgaacccaggaggtggagcttgcagtgagctgagatcgcgacaatacatgtcgcgacaatatatgagggtttccttttctccacatccttgccagcatttgttattgactgtcttttgtatataagccattttaactggggtgagatgatatcccattgtagttttgatttgcatttctctgatgataatgatgcgtaccttttcatatgcttgtttgccatttgtatgccttttgggaaatgtctattcaaatcttttgccaattttttaatcggattattagattttttcctttagtgttgtttgagcttcttttctattctggttattaatctcttgtcagatgggttagatctgctttttcattatttatatatttttttgagatagggtctgtctctgtcacccaggctggtttgcagtggtgtgatcacaactcactgctacctcgcctcccaggctcaagccatcctcccactcatcctcccaagtagctggggctacaagcgtgtgccaccagacccagctaatttttgtattttatacacagggtttggccgtgttgcccaggctggtcttgaactcctgagctcaagtgatccacccacctcagcctcccaaagtgttgggattacaggcatgagccaccatgcttaaaaaaaaaaaaaaaaagaaaagaaaagacggggtgcggtggctcacgcctgtaatcccagcactttgggaggctgaggtgggcggatcacgaggtcaggagatcgagaccatcctggctaacatggtgaaaccccatctctactaaaaaaaaaaaaaaaaaaggcaaaaaattagccaggcatggtggcgggtgcctgtagccccagctacttggggggctgagacaggagaatgacatgaacccaggaagcagagcttgcagtgagctgggacagcgccactgcactccagcctgggcgacagagcgagactcagtttcaaaataaataaataaataagaatgtatttaactttaaaaaacagagacagggtctcactaggttgcccaggctggtctcaaactcctgggctcaagtgatcctcctgcctcagcctcctaaggtgctgggattagagacatgagccactgcacccagccaaccaccgtgcttttaaagaaggactctaggagggtagtgatcttatccagtgtgttcctcactttatttctaacctctagaatattatagtgtaggcttggtaaatactgatgagttaaaatacaaagcaggccagagaagtggaatacattgttgatcctttgagaattagtggttttgataatgaatgtgaattagtcattataaagataaacttttacttgtatggtaagcattctgaaatatctttgaacatagaagccacttgtatgtaggagagaaaattaatgaagttgtatcccttcttttttttataaattacaaggattatatttagagactccaagaactttaaaaggtacatgagcattggctggatttctttatgaataaggggagcaaaattgtctgtggaagttaagtacctgtattaagcaaattaactcttttgttggaaatagaggcactatttaaatcttgggaaacaccaacttgcctgataaaaagtaaagacccttttgcctttcctcagggaacatattaaaaactatttaaaaatgttgatgtctgttagtagccaaccctggaaagtctctggtgaaatgtcataggcttcacttgtctcatcttcctatttcagaaacaattctgagctcttccaagataggaaagcacactgcgagagtcctatagatggcagtgtttgctttactctgaaaatgtttttacaggtcatcatcaagaatatgggctggaatctcgttggtcctgttgttcgatgccttttgtgtaaagataaagaggatagtaaaagaaaagtttattttttgatctttgatttattggtaaaggtaagttaacaaaacaaggttctctttatcataacacacagcagtattttataattccctttaatgtttattgtttggtaagaaagcttttggttcatgaaagtacatgcagaaaggaactcgttggagaaaagacccagtcttattgattggataggcaattccatttcaggatttcccaaattttctggataaaagaattgtctaacctcatattaacctcatatcggacccattgattcagcatctccagggagagacctgggaagctatatcttaacaagtagccttatcgtatagatgtggaatacaagctttagagaggtagttcaaggtcacatttatcttttggcaacattggaactagattaaaatctcagtcctctttcctttgtggtatgttccctaaaagaaaatggaaggcctagaatacaagtgattaaaattgaagtaggaatagggtagaatacagatcagttgtgactaacaaccttagaaagcgaccctgggtaaaaggctagtagagtttacagtcaatatttgatggccaagaaagataaattctgagaaaaagtatattataagaaactgtttagtgatcagtgcaaatatacccaaatatatattggaaggagagctccatctgtatgagttattgactatgggagctgggagcttttaaaaaaccagtcaagtgagatgataagatatggccagtcagaaagcaatgcaaagttttacctgttcaaaaaatacaaaagagattccagactagtctaaataggcttgcagcatgggattgaaaggtcccacctgctggagcccctgagaatctgttaaggcaatttcagagtggacaggtgaagctcaaaggaaacctgagcctaaagatccattgacttcttgctttttagttttatagttacttgaccatcacagattctgtgttttgctcatgcatattttttcaacaattgtataaataattttaatgttaagcaaaaacataattgtataatattttgtcgatacatgccttcttaaaaatagtaataatgtggctttaaatacaacttgtattaaacaggttcaattgtgaatatttttatagttatgcaatccaaaggaattattgttgggtttgcttgaactgattgaagagccctctggaaaacagatatcccaaagtattcttcttttgcttcagccattacaaacaggtaatgagaattttgatatcagagtacttcttgttgtatctctaaatgccttgatggttacctcaaaatgtcaatactacaccaaagtaaagtttacagctaattagtgagtactctgcttaaaccaataatagcaatgccaatgtgaatactgctgctcatagaaagattatagtatctggccagagtgggtacccagtaaatattctgttgaatgtcatactatttttcatgtgctatattgaaaactatacctttttgcctaaccttcctatctgctgcttaaatctagaattttctctctaaacatgtttcaagggttacctctgtggtgtctgcagtactaaatctgatagcattatggtagtctggaagagtatcaggcaaggcattgctcagcctctgctttgggaggttggattgggcatagcaaagctactactgaagaatgaaacgaggagatatgggatgataaggctccatggctgagtgcagtaacagtattggtaggtaatgggtcttagcaaccaaggcagacagtatccataggaagaggttatttttcattttaggaaattcgtttatctcacaatctgatagagggacctagaatcagaaattaaatttgttttaaatatgaatgcctgccagcttcatactacctgtaatattcagtcttctagggaaaaaaaatctaataataccacctcctatttgtgtagtgctttatagtttacaatacacttatattttgtgcttataacaacccaaaaacatggaaagaacatgtttctgtcttaagtacatagcctgttacacatagtctgttataaacataacctaaacagcatttcatggcaagatgctgtattattttatgcacaactaagaagaaaaaaacactgccaattagactgtgatgtgtcatcttgattcaagagttgttaaaatgtgggaggaggaagtgtcttataattccacatttgccgaatttcttgtcccatgtttagcatacttgatgagcgacaacttgatctctgttttagtgattcagaaacttcataacaaggcatattcaattggattagcattgtctaccctttggaatcagctatctcttcttcctgttccatactcaaaagaacaaatacaaatggatgactatggcctttgtcagtgttgcaaggccttaatagagttcactaagccttttgtggaagaagtcattgataacaaagaaaactcactggaaaatgaaaagttaaaggatgaattactgaaattgtaagtataattttaagaacatctcacagtggacttaagtaattgatagttcagttattttatgtttcttcactttgtttgacatgtaaatagaaatctagtttcagattttgaattttagaagaatgtggggttcagttgatacagcatgggaacttgagacatttatattttaaaaaattataggccgggtgtagtggctcacacatgtaatcccatcactttgggagactgaagtgagaggattgcttggggccaggagtttgagacgagccttggcaacatagtgagacccccatctctataaaaaaatttaaaaattagctagatgtagtggcatatacctgtagtgctactgcttgggaagctgaggctagaggatgggttgaatccaggagtgtgaggctgcagtgaatgatgattggccactgtactccagtctgggcaacagagcaagaccctgtctttaagaaattaattaataaaataattataaaaccaaaatccattcatttactttatattcttctttgtattgccttattcatcatagtaggtgaataatgaaagtgggggaaatagatacatgtagctcagggtgagtgtgggaaatagatataggtagctctgtggagaaattgtgttttactctttcaaaggaagcagcagaaagaccaccagacagaacatccaactggaccacaaaaatagtggtagagtatccacccaatagcattccctccatgggtactatagactaaacatctactgttcaatatggctgtagcacttgacatatggctggtccaaattcagatatactttaattataaaatatcccctggattttgaagacttgttatttaaaaaaaaaaaacagtaaaatacctcaatttttatattgataacatgttgaaatgacaatatttcagatatactgggttaagataaattattaaaatcatctctcccattcttactacttttttcatgtgtctactaaaagatcttaaattatatatggggctgtgttatatttctattggacagtgatagactagattaattacatggaccagtaatttttaaattttggctacttgggaggctgaggcaggaggatcacttgaggccaggagtacaagaccagcctgggcaacatagcaagacctcgtctctaaaaaatagaatataaaataatattttaattttggagactaatactatttttagcttcctacttgtcaggttaggacatttaaaaaaaaatttacagccagacgtggtggctcgcacctgtaatcctaacactttgggaggtcaagctgggagattgcttgagctcaggagtttgagaccagcctaggcaacatagtgagaccctgtctctacaaaaaataaaaaagttagctgggcacagtggtgtgtgcctgtagtcccagctacttgggaggctgtggcaggaggatcctttgagcccaggagtttgaggttacagtgcactattattgtgccactgtactccagcctgggtgacagacaccctgtctcaaaaaaaaagttttttaccatttataaaacccattatttcataaaagaaaaggtattttaactaaagaaataggaaaggcttaatcacagaataaagtttggttttctaaataaaacaaatagagctgtgtgaaaaaatgactgtatttcttgattttttctttgaactaatgaaaacaacatcatagactagcaccagccctcaaacattcagaattcaatggaatagttcagatgtagaagtcagtcttagcatgttgagtctagcaaggtgttctcatgttctccccattactagtacgaacgacgttacatcaccagttttatagaccattgagttattgatgcttgtcttaatccatttgtgctgatataacagaatacctaagactgggtgatttataatgaacagaaattcattggttcacagttctggaggctgggaagtctgcaattaaggcgctggcatctggcaagggccttctagctgtgtcataatgtggctgaaggtaaaagggcaaaaggcaaaagtgggctgaacttgcccttttataacagcattaatctcatccgtgagagtggagcccccttggcctaattcccacctccttatggcagttaaatttcaacatgagttttggagagcagagtcattcaaaccatagcagtgcttatgttatttttcaagtaaaattaacttagatttgaagacctagggattttatacttggaagtgttgatttcatagttacctatttcttatgccttagttgtttcaaaagcttgaaatgccctttgctgacagcacaattctttgaacagtctgaagaaggtggaaatgatcctttcaggtattttgcatcagaaataatagtaagtacagctaatttaatctgctataatcttaaatgttatcccactatattctcagtactgcacatgtaaattgatacattcattaataaagaaatgtgtattttttgtagaacacacataaacaaaagatggaaaataaaacagcaataattttattatccaaagataaatattaacatcctccaggcttttttcttatatacttatttataataatacatatatataaatttttcaaagattttatatatatatataatcttgtaatctacctttttcctcttcaacagtatattatgaatatttttccattggcttaatagtgttccatggtatggacttagtataatgtatttcacctgtgccatatagttcaacatttggattgtttctaattttccattattgtaggacaactccaagttttctttttttaactgttaagtctatgataagtaacctagtaattaaatttttgcatacttttcaaattatttccttaaaactcctagagtggaaattccatgccctgtgataaatattttcaaaatagctccatatttaagtaaattttattttaaaagcaatttggctttatgcatcaatagtattttaaaatgtgctcagattctgtattagagaaataatctgaaatattaaaaaatttattttaagttgatgtttctgaatttcaaaagagaaagtccatgtggctgtgtagttttcttcagccatgttcagctacatgagtgcaggtgcagcataggagtaacatttggttgaattagggtggggttttaagaacagggtaagttgtagagagcaagaggggggcaagggattgagcatgtatgtaaggtgatttctttttcaattatactttaagttctagggtacatgtgcacaacgtgcaggtttgttacataggtatacatgtgccatgttggtttgctgcacccatcaactcatcatttacattaggtatttgtcctaatgctatccctcccccagccccccacgccccaaccagccatggtgtgtgatgttccccaccctgtgtccatgtgttctcattgttcaactcctaccaatgagtaagaacctgcggtgtttggttttctgttcttgtgatagtttgcttagaatggtggtttccagcttcatccatgtccctgcaaaggacatgaactcatcctttttaatggctgcatagtattccatggtatatatgtgccacattttcttaatctagtctatcattgatggacatttgggttggttccaagtctttgctattgtgagtagtgctgcaagaaacacacatgtgcatgtgtctttatcatagaatgatttataatcctttgggtatatacccagtattgggatggctgggtcaaatggtatttctagttctagatccttgaggaatcgccacactgtcttccacaatggttgaactaatttacactcccaccaacagtgtaaaagcgttcctatttctccacatcctctccagcatctgttgtttcctgactttttaatgatcaccattctaactggcgtgagatggtatctcactggttttgatttgcatttctctgatgaccagtgatgatgagcattttttcatgtctgttggctgtataaatgtcttcttttgagaagtgtctgttcatatcctttgcctactttttgatgggattttttttttcttgtaaatttgtttaagttctttgtagattctggatattagccctttgtgagatgggtagattgcaaagatttttctcccattctgtaggttgcctgttcactctgatgatactttcttttgctgtgcagaagctctttagtttaattaatcccatttgtctattttggcttttgttgacattccttttggtgttttaatcatgaagtccttgcccatgcctatgtcctgaatggtattgcctaggttttcttttagggtttttatggtgttaagtcttacatttaagtctttaatccatcttgagttaatttttgcataaggtgtaaggaagggatccagtttcagctttctacatatggctagccagttttcccagcaccatttattaaatagggaatcctttccccattgcttgtttttgtcaggtttgtcaaagatcagatggttgtagatgtgtagtgttatttctgaggcctctgttctgttccattggtctgtatatctgtttcggtaccagtaccaatctgttttggttactgtgtccttgtagtatagtttgaagtcaggtagcttgatgcctccagctttgttcttttggcttaggattgtcttggctatacgggctcttttttggttccatatcaactttaaaatagttttttccaattctgtgaagaaagtcagtggtagcttgatggggatagcattgaatctgtaaattactttgggcagtatgaccactttcatgatattgattcttcctattcatgagcatggaatgttcttccatttgtttgtgtcctcttttattttgttgaacagtggtttgtagttctccttgaagaggtccttcacatcccgtgtaagttggattcctagctattttattctctttgtagtaattgtgaatgggaattcactcatgatttggctctctgtttgtctattattggtgtataggaatgcttgtgatttttgcacattgattttgtatcctgagactttgctgaagttgcttagcagcttaaggagattttgggctgagacgatggggttttctaaatatacaatcatgtcatctgcaaacagagacaatttgacttcctcttttcctaatcaaataccctttatttctttctcttgcctgattgccctagccagaacttccaacactgtgttgaataggagtggtgagagagggcttccttgtcttgtgccatttttcaaagggaatgcttccaattttttgcctattcagtatgatattggctgtgggtttgtcataaaagctcttattattttgagatacgttccatcaatacctagtttattgagagtttttagcatgaagggctgttgagttttatccaaggccttttctgcatctattaagataatcatgtggtttttgtcattggttctgtttatgtgatagattacgtttattgatttgcatatgttgaaccggccttgcatcccagggaagaagccgacttgattgtggcgcataagatttttgatgtgctgctggattcggtattttattgaggattttctcatcgatgttcatcaaggatattgccctaaaattctctttttttgttgtgtctctgccaggctttggtatcaggatgatgccggcctcctaaaatgagttagggaggattccctctttttctattgattggaatagtttcagaaggaatggtaccatctcctctttgtacctctggtagaattcggctgtgaatctgtctggtcctcgactttttttggttggtaggctattaattattgcctcaatttcagaacctgttattggtctattcagagattcaacttcttttaggtttagtcttgggagggtgtatgtgtctgggaatttacccatttcttctagattttctagtttatttgcatagaggtgtttatactattctctgatggtagtttgtatttctgtgggatcagtggtgatatcccctttatcattttttattgcatctatttgattcttctctcttttcttctttattaatcttgctagaggtctatgtattttgttgatcttttcaaaaaagcagctcctggattcattgattttttttgaagggttttttgtgtctctatctccttcagttctgccctgatcttagttatttcttgccttctgctagcttttgaatttgtttgctcttgcttttccaattcttttaattgtgatgttaggatgtcaattttagctctttcctgctttcttttgtgggcatttagtgctataaatttccctctactcactgctttaaatgtgtcccagagattctggtatattgtgtctttgttctcattggtttcaaagaacatctttgtttctgccttcatttcgttatgtacccagtagtcattcaggagcaggttgttcagtttccatgtagttgtgcagttttgagtgagtttctgaatcctgagttctaatttgattgcactgtggtctgagatacagtttgttgtgatttctgttcttttacatttgctgagtagtattttactaccaattatatggtcaattttagaataagtgcgatatggtgctgagaagaatgtatattctgttgatttggtgtggagagttctgtagatgtctattaggtccacttgttccagagctgagttcaagtcctggatatccttgttaaccttctgtctcattgttctgtgtaatattgacagtggggtgttaaagtctcccattattatcgtgtgggagtctaagtatctttgtaggtctctaaggacttgctttataaacctgggtgctcctgtattgggtgcatatatatttaggatagttagctcttcttgttgaatttatccctttaccattatgtagtggccttctttgtctcttttgatctttgctggtttaaagtctgttttatcagagactaggattgcaacccttgcttttttttttttgctttccatttgcttggtagatctttctccacccctttattttgagcccatgtgcatctttgcatgtgagatgggtctcctgaatacagcacaccaatgggttttgactctttattcaatttgccagtctgtgtcttttaattggagcatttagcccatttacatttaaagttaatattgttatgtttgaatttgatcatgtcattatgatgatagctggttattttttctgttaattgatgcagtttcttcatagtgtcactggtctttaccatttggcatgtttttgcagtagctggtaccggtcgttcctattcatgtttagtaaatccttcaggagcttttgtaaggcaggcctggtggtgacaaaaatctctcaccatttgcttgtctgtaaaggattttatttctccttcacttatgcagcttagtttggctggatatgaaattctgggttgaaaattcttttctttaagaatgttgaattttggcccccactctcttctggcttgtagggtttctgctgagagatctgctgttagtctgatgggcttccttttgtgggtaacctgacctttctctctggctgcccttaacagtttttccttcacttccaccttggtgaatctgacaattatgtgtcttggggttgctcttctcaaggagtatctttgtggtgttctctgtatttcctgaatttgaatgttggcctgccttgctaggttatggaagttctcctggataatatcctgaagagtgttttctaactttgttccattctccctgtcactttccggtgcaccaatcaaacatagatttggtcttttcacatagtcccatatttcttggaggctttgttcgtttctttgcactcttttttctctaatcttgtcttcttgctttatttcattaattggatcttcagtcactgataccctttcttccacttgatcaaatcggctattgaagcttgtgcatgcgtcatgaagttctcgtgccatggttttcagctccatcaggtcatttaagtgcttctctacactgtttattctagttagctatttgtcttaccttttttccaggtttttatcctccttgtgatgggttagaacatgctcctttagctcggagaagtttgttattaccgaccttccgaagcctacttctgtcaactcatcaaactcattctccgtccagttttgttcccttgctggtgaggagctgtgatcctttgaaagagcagaggcgctctgttttttggaattttcagcttttctgctctggtttctccccatctttgtggttttatctacctttggtctttgatgttggtgacctacagatggggttttggtgtagatgtcctttctgttgatgttgatgctattcctttctgtttgttagttttccttctaacagacctctcagctgcaggtatgttggagtttgctagaggtccactccagaccctgtttgcatgggtatcaccagtggaggctgcagaagagcaaatattgctgcctgatccttcctctggaagctttgtcccagaggggcacccgcctgtttgaggtgtctgtcggccccctactggcaggtgtttcccaatcacgctacgcgggggtcagggacccgcttgaggaggcagtctgtctattatcggagctcgaatgctatgctgagagaaccactgctctcttcagagctgtcagacagggatgtttaagtctgcagaagctgtctgctgccttttgttctactgtgccgtccccagaggtagaatctatagaggcagtaggccttgctgagttgcggtgggctccgcccagtttgtgcttccaggcctctttgtttacactgtgagctactcaagcctcagcaatggcggacaccccttcccgtctagctgcagcctcgcaggtcgatctcagactgctgcgctagcagtgcgcaaggctctgtgggtgtgggacccaccaagccaggcatggcagggtatctcctggtctgccggttgctaagactatgggaatagcacagtatttggtcaggagtgtactgtttctccagaaacagtctgtcacggcttcccttggctaggaaggggaaattcgctgacccctcgcacttcccgggtgaggcaatgccccgccctgcctcagcttgccctccgtgggctgcacccactgtccaaccagtcccagtgaggtgaaccaggtacctcagttggaaatgcagaaatcactggtcttctgcgtcgatctcgctgggagctgcagacctgagctgttcctatttggccatcttggaagtgactcctttttttttttttttttttttgtgacagagtctcgctctgttgcccaggctgtcgttcaatggcatgatctcagctcactgcaacctccacctcctaggttcaagcaattctcctgcctcagcctcccaagtagctgggattacaggcacccgccaccacacctggctaattttttgtatttttagtagagttggggtttcgccatgttggccaagctggtctcaaactcctgacctcacgtgatccacccgcctcagcctcccaaagtgcagggattacaggcgtgagccactgtgcccagccgcaaggtgattttaatgtacaaagtgactttaatgatggacatagaatttaagctgggtaaggagtaaagttaggacatgcaagagacagtgaaaaggtgattggatcattaggttgtagaacctggtgtgggtgacagatgtttggagttaggttactaaaaggggtgaactgaaaaaataggtgtaaagaataggatgcttgaaaatagtattatggaaagattatagttactagtatcaatgtctggggtgtgaccatgagagggtgttctaaaggagaggatagaggcaaaggtcattgggctagagaaaatgaaatacttgagatttcagagtatcagaagatctttggttgtacatttaaatcacacagaattataatgttggaaagccatgtgatggggtgaccttggggtctactaactgcaacaaggaggggtagaaatggtaaagtcataaaaaatgagtttcagagttgagggatttttagagaggatggggagagaatggtgtagaagcagcaaggagaacagatgtattcccaggctcagtggtacaatgggtatagatgaaaaatacagtagtcttttgaagggttgcagagaaagcagctgttttcagatgagagccaattttaatttaggagagatggaaaaaggggtcagatgaagggatgctagaagtttatgggaataaattctgaagatgagagatgacttggtgactgatataattaggaatacataatttaataaggttaatgctgatggtcacgataatagtgaagaggctgtgagggatgaagtaggagaggtgacgggttttctctggagcacacaaaagtctgggggctcttcattgttaccagtgctagagcacagtatcatcttctggaggtagtataagcaccatcacatatgatatgtattttgagaagacaactatgaaagttggaaactattaaaggaaatctggtgatgtagaaaaaccaaactcagtttctcctactatagtcataacaagtttctgacaccagatgtatggagttccctgccctgccccctgcccttcacggcaagcaagcaagcagttgtacaacggacaccaattgggtgtcctctaattcaattccaacgttacctacctggagatagtgtcagatttcacaggttgagggctaaatacctcaagactgcccccccttccaatgccagtctcaagccctaggatgttttacctgtgctctaactgactggcaataaatcaggattcccaggaccccctccttgggtttgattaatttgctagattggcttacagaactcagggcactgcttacttacatttagtggtttactataaagaatattaccaaggatacagatgaagagatgcatagggctaggtataggggagggggcaccaagtttccataccctgcctggatgcaccaccctactggaaacttcgtgcgttcagcttccagaagctttctgaatccaatcattttgggtttttatggaggcttcattatgtaggaatgattgattacatcattgaccgttggtaatcaacttaatattcagcccctttcccttactggggtgggatgggggtagggctgtgggactgaaaggtccagccttctaatcacagggttggttcccttggcaaccagctcccatcctgaggctatccaggagacgcagctatcagtcaactcaatagcataaagacacttatcactttggagattccaaggattttaggagttatatcccaggaagtgggaacaaagagcaaatatatatgtcacagtatcacagatgttaaatctgggagtgatgtaatcaaactgtgtttaggattcatcactttaaaggaagatgactaactgggataaaattggaagtagggaagccttgggagttaagtaagcaatgatgggagcctgagtatagatgtatggatattttttgtttgtttcctttttttaattgactaaatttatgacacattctgttagtagggatatagttttaaagatgaagaaagggcagatttgagaactttatagtaggtaaaattggcaaaatttggtcattgattggatttagaataaaacatggatgagggtttttgcttggataactgggcagatgaaggtgccaatacttgagatagagaatacagagcaagaatctgggggtcttgtgcctttaaaacaaatgtattgtaaaaatttacaaacattcagaaaagtactaaaaataatctagcacatgcccatgtacccatcacccagcttcaataattatgaacattttgccaattttgttttatctgtcctcctccttttcttgctgtagtataacaagtcctaaacataattcatctgtaagtctttaaggatgcttccctaatgacaagggcttttttaaaaaaacaaataaccaccaggctattatgacacctaacaagattttattaccttttgttaaaattttttgagacagggtttcactcccattgcccaagctggagtgaagaggcatgatgtcggctcactgaaacctctgcctcccggactcaagcagttctcctgcctcagcctcccaagtagctgggactgcaggcacacatcgtcccacctggccaatttttgtattttgggtagagatggggtttcaccatgttacccaggctggtctcgaactcctgggctcaagcgatctggctgcctttggcctcccaaagtactgggattacaggcgagagccactgttcccagcctaactcctaacaagattaacaataattttttaatatatatctaataaccagagagagaataggtttttaaggaatttaaaatataatattttaatatgtaaatatatgtatatttaatatagaattatatgtaaatgtgtatatatattttttgagatagggtcttgctctgtggcctaggctggagtgcagtggcacaaccatggctcactgcagcctcaacctcccaggctcaagtgatccttccacctcagcctcctgagtagctgggacttacaggcataccccagcatgcctggctaatttaaaatttttgttttgtaaaggtgaagtctcactatgttgtacagactggtcttgaactcctgggctcaagtgatcctcccaccttggcttcccaaagtgctggaattacaggtctgagccaccatacctggccaggagatactttgaatgagagggggtgagattacctaaagaggtgacaagagaaaagggctcaggagtgaactctagagagtaccagcacttaaaatgagcccaagaaggaagtcggaagtggtagaaatacacagaaactggtgtagtagagttttagaaggatagaggtgatcagtactgttaaatgcatagaggtatgctgaaaagcatctgtaggatttaggaagtaagatggcattggtaatcttagcaagaacagtgtaagtacagtgttggagacaaatcagagtggagttgataaaagaatgaatgacagatgagaaaaaggagatgactagtgtaagctattctttaaaagaggttggatgaataaggaaggagaggtaatagctagaagacatgagctaagggtaggaaggtaatggaggtgggaagacttgagcatgtttatagctgttggggtgcaaactgttgagggaaaaatacaagtgtttatgagataactgaaataatgtggcttatgagcaaatggctggacatagtatcaaggccataaggaaagtcctagacaggaagaactagtgggtatcaaggtaagaaaacatgttgagaaatttgtagcaggaatggaatcttacaattgaggggagtcaaacccactggcctcagatttctaggtgaaggagagatgatctcttaataatgaggaggtagaaatgggcattgagtaaaagggcttaaggaaactggtaaaggtttggaatactgaggggaaaggaaagagatggtggaagaccacggaagcatgagtcagtagtactgagcactcaatggtgcttggaaaccacaactatagtggtaacagtctgtatttttttatccagcaatactcagctccctgtgtgtagaagcagagaaggtagattgcagttatttttccaaggctggcattttactgggtagatactgctgaaggaaatacagggtgcagatagttcagctggtcaataatccatgattcaggttggatagggaaagaaggggggttaggagggaatgcctaggtaggtcaaaatgtaggaatcacaggactggagaagtcagaagtagaaaagcagattgctaggagagacaggatgacagattttggtcagaaaatgggatattggagtttaaagtatcaaatacagaatagttccagatgttcagagatccagcatgggattaggtactgaaatggattagaactaaaagtcactagaatttagaaattgagaaccatgagagtggatgcaatgacttgttgcttgattgaaaaataaattaataataataaaggaccatgagactagcctgttataggggttatctccatgaacattgaattttcccaggatcatagcaggaattgggtagagaaaaagattatgagaaggtgccagagtcttcagtgaatgtcaggaaattaccaggaagtcagcatatgacagagaaaaggacagtatgttatctgcatcaaaggaaaatgtgcttttgttgaaaagtacagaaaaagccaatactacaatactgtgctaagcccctacctgtactcctctacccaacagctgcattccaggccctgtggtataaaaggtgtgagaatgagcatctcccaccagaaatcagacaggtttagttaaagcagtgaggcagaacaagcatcctatgaagagactgaggatgtaggtgagtggttctaaaatctcagtagaaggaacattgcaagtagaaagagccagcagtaaggatgcacgtagcagtctagaagtagaggtgagaccagcttggagatgaaatgaggagatgtcttctgttctgtgctggagaagtactggtaagtgtggtgtggttgggattcacaggcctcagccatcctcactttggtacaagttattttggtacagaactactagaatgtcccaaaggctgtagtacaggaacatttctgaaaggacaaaagctgccatgaatattgagaaattgtatggtgccaggtacagcctggatctgagcaagactgctggatggtgtgtggatagatagtgaaggcccagatttgggaacagattggatctcagatatccagagcagcactgtagaatctagttgcatataataatgttttaaaaagggtatcttaggctgggcacggtagctcccgcttgtaggcccaggcctttgggaggccaaggtgggcagatcacttaagcccaggagttcaagaccagcctgggctgcatggcgaaaccccatctctataaaaaataaaaaaaataaaaaaaaaatagcgggcatggtggcatgtaccagtagtcctagctactcaggagactgaggagggtggattgcttgagcctggggaagtcaaggctgcagtaagccatgatcatgccactacactccagcctgagtgacagagtgagaccttgtcgccaaaaaaaaaaaaaaaaaaaacagggctaccttactctggaaaaaacacatgtagcattggctgaataaagaaatggagcttcatgattaaggacatttggaatcagagtgcaataaactttttgtcttgtagctataaccagaatgcatggctttgaaaatcactgcagcagtatatatttagcatctggtcgctgaatagcagtctcttgtgactgaggatgattttccatggttcctttttgtattctgaaatgactaatggaaccatctgggatcagcagattttaagtccctgaaggctggaaaagacttatacttggctttataattccccacaaagtcaggcccagcaccttgcacttaagtgtttattgaataaaagagtgacttgtgtggaagttattcattctgctttagctgtttttgtcattcattcccttttaactcttgtagtttgttgtgactttaactttcttacgctttttttgtggagctgctcgataaatatttgacataggtattatgtcattttatggctcatccagtgtcacacaagtagtaaatggtagagccaaaactcaaaatcaatgtcagtggattctgaaggtaggtgctttctggtacgctagaattagtaccagtataagaggcataggagtgatcttgtttcctgagcggaaagctttatttagccctgtggtcctacccactcatgcaaggatgcttctctttctcgtctcacatgagaaccctgatgactgagagatcaacagtgtttcctcaggcccagctgccctgcccagcgttcctgcatcccactctctacaggcacaatgttagtggagcattgttcctagagtattcttcatcttagttgctttacccttgcttcatatatttgtatgtctcacgtttcagattgctctcaaatatccctgaagcacttttttaaaaaaaattgtggtgaaatatacataaaattcatcattttaaactttttaaactatgattctgaattaatttagaatacttctgatgtataaaatgctatgtaaaatacgattttgctgttggcttctgtattagtttttcattgctgtataacaaattcctgcaaacttagcagtttaaaacagcatacctttgttatctcacagtttctatggatcaggagtccagccacagcttaattgggtcctctgctcagggtctcattgggctacaggccagttgttgactgggtctgtagtcttatcagaagcttaactggggaaagatccactttcaggtttcctccgctggcagaattcatttcctctaagctgtaggactgaggtccccattttcttgctggctgtcagccagggaccacatttagcttctaggagctgcctgtagttggtcccttgccatgtagttctgtccatgagccttctcataacatggcagcttagttctttaaagccagcaagggagagagtcagagagcaaagtttctgactctcagggaaggcctggaccccctttaaaaatatacctgattaagttagggccacccaactcaaaatctactgatttgggaccttaattacatctgcaaaaaccccttcacttttgtcatataatctaatcatgggagtgacatcttggcgcattctgttggttgaaagcaagtctcataggtcccactcacgctcaaagggagtgattacacctccccttggtgagaatgtggagtttgaatacacggggtggggggcattttagagtctgtgtgctatggtttccttttttatccatttcatagggttttttatcagcaattggacaccctttccccaaaatgatttttaatcatggaaggaaaaagagaacttggaattaccttgaatttgaagaagaagaaaataaacagttagcagactcaatggcttctctggcatatctagtatttgtacagggcatccatattgatcagcttccaatggtcttaaggtaagagttagtgtttggtttattcatgtattctaaaaggaatttcataaaattctcatttatctaatgtccaatatatgcatattaacacactaatacattttaaataaatagtaaaggctatttttaataagaatgatcccagctataatctgttaaagatagcagtagacaagtaatgaaagtggggagtgttgaaataggtgtaagggaatggtggggacaagaatcagaagatgataaacagggcttggttttgaagcttttgagaccaccctggaactagccaggtacccaggggtatcatcatcttttcactggattactgctgtaatcctgagtggatttatatatctacttttacttccttttaatttaacacattctcaacataccagaaagcgaagccttaaaagaagtcccttactgaaaaccctccagtggctttttattgctttaagaataaagtcttaatgcctttgcataacttctgagacaaacttgtgcctggtctggtccctgcttaattgacctgattcatctcctaccacctttcctcttgtttactatgctccagtgacacagaccttcttttgtttctagtttaaatgttatgaattttcctatttggcctttgtatatgcttaaaattctctttatccttaaatgtcactttctgaagaaagccttcactcaccacccaatttaggttgaatccttctattataattaccttgaccttgtcttcttttcccacaatgtttattaaaattatttttaaaatatataattttataatgtaatatcttctggactttgagttctatgataataaggattgtgtatttgtcttataggcattgggtatttgtgtgagtttgtgcatttatatatgaatatagctaggagtacattcgtatgtaaatgttgaaatactggctatcatttgcatgttcaccatgtatgaaacattatgctaataactttatatgcattatctcatccttataataagcctgtgaaatagagcattctctcattttacagatgaaaataacaggcttagacaagttaatataccactgaagatctaactactttgtggcataggtgggatgcagatagctctgtctgaccccagagcctatactcttaagcatcacattctatcaccaaaataacttatacagcatatgtatattaacttgctagggctcctgtaaaaaagtgctaccaactggatggttgaaataacagaaatagtttgtctcatagttctggatgctccttctgagggttgtgaaggagaatcttctccatgcctctctcctggcttctggtgatttgctcacaatctttgatggtctttggcttgtagatgcattatcctgttctctgccttcatgttcgtatgctgttctccctgtgtgcttgtgtctgtctccaaactttccttttacataaggacaacagtcatattggattagggcccaccctaataatctcattttaaattgattacctccataaccctatctccaaataaggtcaaattctgaggtactagaggttaggactccaacatatcttttttgggggagatacaattcaacccataacaatatgtatgtgtgtacatatctctgtgtgtgtgtataatatatatatttgttttgtttctattttagcccattgtaccttttgcagtttaatatggggcacattgaagtctttttgcaaaggtaagatcgtttagatggtatctcaaaatgaaatagtagtgttaaaatagtccttgttaagatcagcggagactgccttttctttgctaagctctaattaattaattggttattttataaaacagcgaggcaaataattcacgagagagacagaaatgagtcaaggaggttttacaccaaagtctgttttattttaaacttaagacagtattaagattttgtcttaagggcttttacagtcatctgtttctaaggtttcttctcttactccaaaagttggtaaattaaaacacctctaccccactgcatcctcctccatcttaaggaagggcagtcaataaaagaagttcttccgtatttttccttcatggacacagtctgtgaattgcatcaaaaggaaggaggtgtcttgacttccaccttttataatttagattattgacagtgatgtcattcaattacaacttttctcatttgaggtgctaagcagcaggactttctatttaaaaaaaaaaaaaaaaagccaggcacggtggctcacgcctataatcccagcactttgggagaccaaggcgagaggattgcttgaccccaggagttcgaaaccagtctctctctctacaaaaaatagaaaaaattagccaggagtggtggcgcctgcccgttgtcccagctacttgggaggttgaggtgaaagaatcacctgtgcctgggaggtctgggctgcagtgagcagagatcatgccactgcagtccagcctgggcaacagagtaagaccctgtcgcaaaagaaaaaaaaaaaaaaaaggaaattacagagtaacaggtatacataatttctagacagaaattaaagaatttcacagaactatatgctttgttttctttcactataacatgtaacatgtttaaattatcccctgagatcagttagggctttgcaattatcctctatgaacactagtgacagtttatcagtcccatctcttaccaggtgaaggaagatttgtaacatggcaatgtccaaagcttcagcatacaaggcaggaatttccaagggtctcctggcacaagtagttactaattctgtaaatttgctgtattatgtatgttttaatgattttatattcattacatttagtttctgttattcatacagtgataatatgtattgttttgaatctaagtcctaaattcttgagatttccaaactgcagagtcattgagtctttttttgaataaaaagaattggaaagattttacagaataatcaactggaatatatagcattggttatatcaggtttagttagtttcttagcacttgctgttgaagatctattgttttgaagttaggaaataatccctgagtagatttattttggtcagatttagtggccttagccaaaccgaaagacagatcaaagatggattaaaacttttgatcaagttcttcaacagaatttctccttaatgatatgcattttaaaagtgttaaaatttcagtttttgctgtatttttcataagatgaagtatcattctaaaatagtttacaaattcatgataaattttaatattatttttcagaacagaagagtctgttatctccaaaggattggtaagatgtttgttcccattataacttaaatacatagttatgtcaacaaataacagctgttgacttcactatatatgtatctgcatatattttaatctgtaggagctgctggagaatagtttattgagaatagaagacaatagtctactttaccagtacttagaaatcaagagttttcttactgtacctcaggtaaataaaatatgtattctaatattgaaaatagccctttgcctgttctgaacttaaagtaaggtcttttctgattcctttcccactcttttctctgcaacctttgaaaactctggtgtaatgctgtccagtagaactttgacaatatgaaagccactagccaaactgaacacttgaaatgtgactaaggaactattttttttttttttgaggtgtagtcttgctgtgtcgcccaggttggagtgcagtggtgctatctcagctcactgcaagctccacctcctgggttcattccattctcctgcctcagcctcccgagtagctgggactacaggcgcccgccaccacacccagctaatatttttgtatttatagtagagacggagtttcactgtgttagccaggatggtctcgatctcctgacttcgtgatcagcctgcctcagccccccaaagtgctgggattacaggtgtgagccaccacacccagccggaactaagtttcaaatttaaattttaatttatttaaacacgaatagctattagaggccaccattattgatagcacagcatccagtagaaaagcataactttcttcttttaacactttatttctgtagggatcttggaaaatgaagcttctttatgtttctcataactcaagttctcaggactccatctaaggcatccactgactcattaccagaaagactaatacacattgtgtttttccctcctatggtttattttgcccaatcctctttgttagttatgatatccaaggaaatccttagatttcagtgtgggaactggttttcctaatatttaaatagaaaaacatggtttttgttaacatattgtttgattgtttttaattaataaattatatttctgtagatttgatttcattttcttgccactgtagacataattgaaaattatcgtttgcttttaaaagtacactgtgtgacactctactcaatatcacttaaaaaatcaattgtagttagctttctggaatggaaggcttagggaaaaattaatttacttcacttttaaatctcctaccctcacttctctgaatttttagtatcctattgatgtattatagttgtttgtttgcagtcagtataatctgtttacatctgaattttacatttttttatttccagggcttagtgaaagtaatgacactttgccccattgagacactggtatgtaaatatttggtgactaaagaataatgagttacagtgagaaaatttgacaaataatttaattttctttttaaaaattttaatttgtgaaatttttatttaggaggtacaagtgtggatgtattacatgcataaaatggatagtgatgaagtctgggtaagctttattcattttatataataatattgtttgttccattttagaggaaaaagagtttagctatgcttcagctgtatattaacaagttggattcacaaggcaaatatacattatttaggtatgtatcaagcatggctaattgctaagtgtgtggttgattaaaagtcatgttaatgccatgtaattgttttagggcatagtatgtcggtatgttttacatgtaattcaactctggttggaacccatattataaattctcagtgatggctagagaaagggttaatcaaatatttcagacatactatatatatgtctatattttgtatgactaatagtatatattgcagttcaatcaattggaatactctaaatttgaaatagacttaaaaataattaaactgagattgatgatgctcctgctggaactttatgtatgtcactaatctccattactcacagttcaaattgatggctctggaattacaactttgataggctatgcactatgttaatagtaagagcttactaatactgctctttgaggtggataagattctagcaactctctaagttaaagattggtaaactttctaattaattttctgtgaagagccaaatagtaaatataggttttatgggctatacagtctctgttgcaagtgctcaactttgactttgtattggggatgggtgtgttccagtaaaactttattgataaaattgggcatcaggctggatttgctaaaatgtcttacctgggattggccaatattagtactgttcttttttggcgggtgcagcagtgtgatcatggctcactgcagccttcacccttggccccccagcttcaggtgatcctcccgcttcagcctcccaggtagctgggactacaggtgcatgccatcatgcccagctaatttttttgtggagatggggttttgccatgttgcccaggctggtctcaaactcctgggctcaagcgattcacccacctcagcctcccaaagtgttgagatgacacgcatgagccatcatgcccagccaacactcttgattctatcttttcttgttttctattgatagtaagagcaagtttatgaaatctcaattcttaggtattataccggctttcctgttctgttctatgtgtatctctaccaataaatcccctttttttcttaagctagtcatatctagttttttttttttttttgcaattaagctactctagcactggactactttcacaggaaataatttggggattttttagaccattatgttagtgccctttcttgccatgttaaattattgtaactatgttcataaaaatattcaaattttggtttgatagaaatggcttgttggaagatccagttataaataagtatttaccggccgggtgtggtggctcatgcctgtaatcccagcactttgggaggctgaggcaggcggatcacgaggtcaggagtttgagacaagcctggccaacatggtgaaaccctgtttctactacaaatacaaaaaattagccaggcacggtggcgggcgcctgtaatcacagctactcaggaggctgaggcaggagaatcgcttgaacccgggaggcggaggttgcagtgagccaaaattgtgccactgcactccagcctgggcgacagggcgagactctgtctaaaaaagtaaaataaaataaataagaatttaccatttagtgagagcaataactattacaggtgactttgtaattggttgatgaccttgctaattaccattactgtggggtttttattcctagaagtaacacatggcctctttgaatttgtaaaacttttatcaccatttaattctaatgctgtccaggataatttcacatctattgtaattttgctttcaaggtgcttattgaatacaagtaatcactcaggtgtggaggcttttattattcaaaatatcaaaaatcaaattgacatgtcattaaaggtaagaacatagccaaagtgtcaattaccaatttatttcgtagggtatatttattcatatgtagaatacattaatgtgagttattgctctatctctagtattactattacttaaatattattaaggcatattttttcccctatttctactatgttttaaaaactctgaatttggaaatttagttaactataagtttaaattgtattctttgaggttttggtttttgtttttgttttttttgagacagggtttcacgcctgtcacccagcttggagtgcagtggcatgatctcagctcactgcagcctccacctcctgggctcaagcagttctcccaactcagcctcccgagtaattgggactacaggtgtccaccagtgcgcctggctgaattttgattttgtagagatggagtttcactgtgttgcccaggctcgtcttgaactcctgatctcaagtgatccacccaccttggcctcccaaaatgctgggattacaggtgtgagtcatcactctgggcctctttgagctgatattgtggcttatttttgctttgttatatgcttctcaaaaatgaatggaaacttaagtctcttctgtttctgagtgctcagtaattctaaatggaaaacagagtgaccagtgttctcaaactggcagggttcgttcctggtgtctggaaagtgaatgaaagtacggaaattaaagttaaaaactgtattttaaatgtgcaattcttcatttttgtagtgtcaaggtattagaaaaacacatgaattacatgaattataaagctttctcaatttttcgtttgcttttcagagaacacgtaacaacaaatggtttacaggaccacagttgatttcccttcttgatttggtactttttctcccagagggtgcagaaacagatttactgcaaaactcagataggtgaggtgaccattaccaaagttcacatagtaaattcagaataaaatgtgaaacatctgcttagggaacctaaagtaataaaatgtcttttcctgtgattttatgatctatggctaattcattaagttacataaagatttttcatatttaagtgatttgataatgtgtagaaacaaaattaaaacctcctctttctagatgaatgaccagcactatgatttgatagcttttatgtacccagcattccatagaaatttgcaatgacagcacttgtgacttaaaactaaaaatctgtgtatgtaatttatgtgtttaggttttgttgttttattgttttccaggtcattttttttttcatatagaacatataatttcagtttcagtatactggaatggatattgagaaatggtttaaagcatttaaaaagtaatcttaaaattcagaaagcaagagatgatgctctcaaatattaaagataacaaggctttctttaaacaaggatgataattttcacaattgtatgatttaaacaaatggaaaacagtgataagttattactactcaaaaagatattaatggaaatagtttctattggcaaacctaattataaaaatatgaccaaagttttagcttattgagattgctgttgactatataaaaccatactgtaagtaacatatatttttaattaacaggattatggcttcattaaatttattgaggtatttggttatcaaagataatgaaaatgacaatcaagtaagtgaagtatttgaaaagaaactgtgagtatattcaaaaggcataaggaatgtttcagatattcagtacctaaagccaatatttaatatcttacccagatataaaggccgggaagagtgccaacaattattctgaaacctgaagttaattcccaggagcatttaccaccccacatccagctttcctttccctttccatttcctattgtacgtctgctttcttgctgaaagcacttagtcctgttgggtggataagttgcaggtcctaagtcaactaaccttgtggagctcaacgtacatatggtgtcttgttcagtttcctccacctatagctcatgagctgtataaaatcatctgatattttaatattgcctcatcagacatgacaaattgaagcattttcagcactaaaacagaatttgttaacagcaccttttagatatgtttaggaagttggattttttaaaaatagcacatcattagaagtattcaataaatagagaagtattcaataaatagaaaactatttgagggagatttgtcatacagtaaaattatatttgctttttatcttctctttctaccctgttctgatcattgctttccctatatgtgtcacctctattagctagaactacctgaatcatgtgttgttaattggtttttttttagtaattcatttttatataaagatgccaaagaaaattttttttaaattaggtaaatcgtgatttgggatgaaggtttatgagaaaagtagcagtctctttccttcctgacagatctatagtagattcagtgatttgaacccccgttcatccctcttcagctgaaaatagctatttgccatcattgactagtgcttactctgtatcaggtgctatttttttttaacattttgttgtgaaacttttcaaatgtacagcaaagttgaaagaattttatagtgatcattggtttacccaccacctagagtctatgattctactgtactaacttcatcatgtatctatcactccaccctctgtctatcactccgtcagtctattttttgatgtatttcaaagtaaactgcagacgtcagcatactttctccgaaatatttcagcatgtatttcattacattgattaaatatttgtctgtagtttttctttgaagtaaaatttacataatgaaatgttcaaattttaagtgtatattcactgaattttaactaatacatagatctatattactcaaacccatatcaatatagaacatttccagcatcacaagaggttcctcataccccttcctagttaattctgacctcgttgtgctactcacccctgccagggacaaccactattctgcccaagtgctgtatatcattcattcttcagagagcgtctcgttctcttgcccaggctggattacagtggtacaatcatggctcactgcagcctcgacctcctgggctcaagagatcctcccacctcggcctcccaaagtgctggggtaacttccaggcatgggccaccatggaaaaccaagaaaagtactctttatttttcacttttcatagataatgtaggtgaaaaaagttcattaacttgcacaagggcaaacatctggaaagtggtagaaatagctatgaccccaggcagtggccagaactttctaaatcacaaactaaatcctgattcctgaaggagcttgtgataaaaattgaaaagctacaatataaaattcagcagcagtagaggccctgagacttcaggaaggtggccttagggtagggtatgagtttttatttttttagtaatcaagaaaggctgtacctacttgagagattatctgacttgcctgacaaaaagaaaaggaatcttgttgattaggattgataggtgtgttagatatggaacacagagtaatacaaaggcagcagattggtctctgcttagagagggaagacctgagagcagtttagcattgtgcaatgtctgctatactatccatagataattcctcacttttgtttgtcatgtacattttatggtgaagaaaaggatacagccagcctataggactgcctttttttttttttttttttttccatctcaaagagacagtgtctcactgtattgcccaggctggagtacagtggcagtcatggctcactgctgcctcaaactccccagctcaaacaatcctcccacgtcagcctcccaaagtgctgggattacaggcacttcttttttttcttgagatggagtctcactctgtcgcccaggctggagtgcagtggcacgatctctgctcactgcatcgtccacctcctgggttcaaatgattctcctgcctcagtctcccgagtagctgggactacagccaggcaccaccacaccagctaatttttgtatttttactagagatggggtttcatcatgttgcccaggctggtctcaaacttctgacctcaagtgatcctctctcctcagcctcccaaagtgctgggattacaggtgtgtgccaccacacccagccaacaggcatctctcatttaatggtttttaataatttttctaagggatcaaatattctaaattattgctttataagttaccataagaattataccagggaaattagcaaaaacccagtccaagctggcagcctcacatcttttaggcgcttaaaagcctgtctatcttgaaaacatttctcctgagtgcaatgacaataggtcgtgtcaataactgagaggcaaatatgtctactgtggttaataaaaaatgacacttcctgagtttttggaagattttggttaaagaaaaaacaaaatgggctgggcgtggtggctcacacctgtaatcccagctctttggaaggccaaggcgggcggttcatgaagtcaggagatcaagaccatcctggctaacacagtgaaaccccgtctctactaaaaatacaaacaaaattagccaggcatggtggcgggtgcctatagttccagctactcgggaggctgaggcaggagaatggcgtgaaccgggaggcggagcttgcagtgagccgagatcatgccactgcactccccactgggtgacagagcaagagtctgtctcaaaaaaaaaaaaaaaaaaaagaaagaaaaaaaagaaaaaacaaaatgatggtctggtgatgctgaaatatggggcattttattcaaaaggactcctaccagtacctatttttgagcacttaagtgtgctaagagggtaattagtcagatgaaaagcagacacacagtcagaaatatgaacaggaagattaagaagagaatcacattcaaatacaaagacaacaaagtgattcataattgagtaataatccatttcttttcttgctattttgggttactgtcaactgacttattctcttcgtaagccctccttcctcaccctactatttcatgcctcttgtatctccttggttaagtttcaggcaccttctcttactcttgaatttcatataacttttcttgaatattatagtacaaacatgctcccatctttactggtaaaaccaacttagtttttataccaaatattatctatttaatagatatttaatagagtatctttaaataattattagttgtttcgaattacaataatttattctaatacatatccaataatcatgttatcccttaccttctgtcctgtgtactcatatcctttcccatccatctgtttactcatctttttttctaaaaagtttgtaattatagtatgtagaatgaaagctgggacaagggaaacaatgagatggcaaaggccacaggtaaatatcaggaattttaaaattgaattgcttagtctgtgtgagtgtgcttttcatttaggaaaaaactgtatcttgtataataaatacacatacacaaaattctatataatccatattttgggtgctcatttaagttttggttttttttcaatacttttaagttctgggatacatgtgcagaacgtgcaggtttgttacataggtatacacgtgccatggtggtttgctgtacccatcaactcaccatctatattaggtatttctcctaatacccctcccctagcccccgaaccctgacaggccccggtgtgtgatgttccccatcctgtgtccatgtgttcaaattgttcaactcctacttatgagtgagaacatgtggtgtttggttttctgttcctgtgttagtttgctgagaatgatggtttccagcttcatccgtgtccctgcaaaggacatgaactcatccttttttatggctgcacagtattccatgatatatatgtgccacattttcttaatccagtctatcattgatgggcatttgggttggttccaagtctttgctattgtgaatagtgctgcagtaaacatacatgtgcatgtgtctttatagtagaatgatttataatcttttgggtatatacccagtaatgggattgctgggtcaaatggtatttctggttctagatccttgaggaatcgccacactgtcttccacaatggttgaactaatttagactcccaccaacagtgtaaaagcgttcctatttctccacatcctctccagcatctgttgtttcctgactttttaatgatcgccattctaactggcatgagatggtatctcattgtggttttgatttgcatttctctaatgaccagtgatgagctttttttcatgtttgttggctgcataaatatcttcttttgagaagtgtctgttcatatcctttgcccactttttgatgggtttttttttcttataaatttgtttaagttccttgtagattctggatattagccctttgtcagatggatagattgcaaaaattttctcccattctgtaggttgcctgtttactctgatgatagtttcttttgttgtgcagaagctctttagtttaattagatcccatttgtccattttggcttttgttgccatttcttttggtgttttagtcatgaagtctttgcccatgtctatgtcctgaatggtattgcctaggttttcttctagggtttttatggttttgggtttttatggttttagattttatgtttaagtctttaatccatgtcaagttaatttttgtatagggggtaaggaaggagtccaatttcagttttctgcatatggctagccagttttcccagcaccatttattaaatagggaatcctttccccatttcttgtttttgtcaggtttgtcaaagatcagatggttgtagatgtgtggcgttatttctgaggcctctgttctgttccattgatctatgtatctgttttggtaccagtaccatgctgtcttggttactttagccctgtagtatagtttgaagtcaggtagcatgatgcctccagctttgttctttttgcttaggattgtcctggctatccggacactttttggttctatatgaaatttaaagtagttttttctaattttgtgaagaaagtcagtggtagcttgatggggatagcattgaatctataaattactttgggcggtatggccattttcacaatattgattcttcctaccgatgagcatggaatgtttttccatttgtgtcctctcttatttctttgagtggtggtttgtagttctccttgaagaggtctttcacatcccttgcaagttggattcttaggtattttattctctttgtagcaattgtgaatgggagttcactcatgatttggctctctgtttattattggtgtataggaatgcttgtgatttttgcacattgattttgtatcctgagactttgccaaagttgcttatcagcttaaggagattttgcactgggatgatggggttttctaaatatacaatcacgttatctgcaaacagagacaatttgacctcctttcttcctatttgaatacgctttatttctttctcttgcctgattgccctgagcagaacttccaatactatgttgaataggagtggtgagagagggcatccctgtcttgtgccagttttcaaagggaatgcttccagtttttgcccattcagtatgatattggctgtgggtttgtcataaatagctcttattattttgagatacgttccatcaatacctagtttattgagagtttttagcatgaagggctgttgaattttatccaaggccttttctgcatctgttgagataatcatgtggtttttgtcattggttctgtttatggaatggattacgtttattgatttgtgtatgttgaaccagccttgaatcacagggatgaagccaacttgatcatggtggataagctttttgatgtgctgctatatttggtttgccagtattttattaaggatttttgcattgatgttcatcagggatattggcctgaaattttcttttttttgttgtgtctctgccaggttttggtatcaggatgatgctggcctcataaaatgagttagggaggagtccctctttttctattgtttggaaaagtttcagaaggaatggtaccacctcctctttgtacctctggtagaatgcggctgtgaatctgtctggtcctgggcttttttttttattgtaggctattaattactgcctcaatttcagaacttattattggtctattcagggattcgacttcttcctggtttagtcttgggagggtgtgtatgtccaggaatttatccattttttttctagattttctagttaatttgcatagaggtgtttatagtattctctgatggtagtttgtatttctgtgggatcagtggtgatataccctttatcaatttttattgtgtctatttgattcttctctctttattagtctggctagtggtctgttttgttagtcttttcaaaaaagcagcttctggattcactgattttttttgaagggttttttgcgtctctatctccagttgtgctctgatcttagttgtttcttgtcttctgctagcttttgaatttgtttgcttttgcctctctatttcttttaattgtgatgttaggtcgtcgattttagatctttcccactttctcctttgggcatttagtgctaaaaatttccctctaaacactgctttagctgtgtccaagagattctggtatgttgtgtctttgttcccattggttgcaaagaacttatttatttctgccttaatttcgttatttacccagtagtcattcaggagcaggttgttcagtttccatgtagttctgtggttttgagtgagtttcttaatcctgagttctactttgattgcactgtggtctaagagacagtttgttacaatttctgttcttttgcatttgctgaggagggagtgttttacttccaattatgtggtcaattttagaataagtgctgtgtggtgctgagaagaatgtatcttctgttgatttggggtggagagttctgtagatgtctgttaggtctgcttggtccagagctgagttgaaatcctgaatatcgttgttaattttctgtcttgttgatctgtctgatattgacagtggagtcttaaagtctcccactattattgtgtgggagtctaagtctctgtaggtctctaagagcttgctttatgaatctgggtgtttctgtattggctttatatatatttaagatagttagctcttcttgttgcattgatccctttaccattatgtaatgcccttctttgtcttttttgatctttgatggtttaaagtctgttttatcagacactaggactgcaacctctgctttttttttttctttccgtttgcttggtaaataatccttcatccctttattttgagcctatgtgtgtcttttcacatgagatgggtctcctgaatacagcacactgatgggtcttgactctttattcaatttgccagtctgtgctttttaattggggcatttagcccatttacatttaaagttaatatcgttatctgtgaatttgatcctgtcattatgctagctggttattttgccaattagttatgcagtttcttcatagtgtcgatggtctttacattttgggttgttcttgcagtagctggtactggtttttcctttccatatttagtgcttccttcaggagctcttgtaaggcaggcctggtggtgacaaaaatctctcagcatttccttgtctgtaaaggattttatttctccttcacttatgaagcttaatctggctggatatgaaattctgggttgaaaattcttttttttaagatattggcccccactgtcttctggcttctagggtttctgcagagagaaccgctgttagtctgatgggcttcccgttgtgggtaacccagcctttctctctggctgcacttaacattttttccttcatttcaaccttggtgaatctgatgattatgtgtcttggggttgctcttcccgaggagtatctttgtggtgttctctgtattttctgaatttgactgttggcctgtcttcctaggttgggaagttctcctggataataccctgaagtgtgttttccaccttggttccattgtccccatcactttcaggtacaccagtcaaacataggtttggtcttttcacatagtcccatatttcttggaagctttgttcattccttttcattctttttttctctaatcttgtcttcacactttatttcattaagttgatcttcaatctctgatattctttcttccacttgatcgattcagctattgatacttgcatatgcttcacgaagttcttgtgctgtgtttttcagctccatcaggtcatttatgttcttctctaaactgcttattctagttggcaattactctaaccttttatcaaggttcttagctccttgcattgggttagaacatgctcctttagcttggaggagtttgttattactcaacttctgaagcctacttctgtcagttcatcaaactcattctctgtccagttttgttcccttgctggcaaggagttgtgatcctttggagaagaggtgttcgtgtgcttggaattttcagcccttttccgctgctttttcctcgtcttcgtggatttctacctttggtctttgctgttggtgacctttgggtggagtttttgcttgggtcatcctttttgttgacgttaatgctattgctttgtgtttgttagttttccttctaacagtcaggcccctcttctgcaggtctgctgcagtttgctgggggtccactccagaccctgtttgcccgggtatcaccattggaggctgcagaacagcaaagattgctgcctgctccttcctctggaagcttcatcccagaggggcacccgccagatgccagccggagctctcctgtatgaggtggctgttgacccctgctgggaggtgtctccctatcaggaagcacgaggggtcagggacccatttgaggaagcagtctgtcccttagcagagctcaagcgctgtgctgagagatctgctgctctcttcagagctggcaggcaggaatgtttgtctgctgaagctgcacccacagccaccctttccccaaggtgctctgtcccagggagatggaagttttatctataagcccctgactggagctgctgcctttctttcagagatgccctgcccagagagaggaggaatctagagcttaagttttttttcaatttccatttctatttaagattcaggggtgcaggtttggtacaggggcatattgtgtaagttgtttctttctctaagataaaacatatccatgaaatatttgcagagccggatgacttctatatgaattagaagaaaggggaaacctgggtcttgttcatggctttttatttcttcattaccatcactgactgtattctttgcagggttcctgactgttctggcaataaatttcattgtagtgtagaactgcctagtcttccttttgtgagagagatatgctacagtgaattttgaaatgtatagttttaagccttagaactggaaatcagtaagcctccttgggtatgaaattaaaagcaggtatttgtgaacatttcaaatttttaattataactattttaaaactcttaatttactttttctagacactgaaagattttaagaaatcttaaaatgtgattttctttgtagtatttattatttctttaaaaacgatctggtaaccttgagagaaaaaatattcttattctcacagcttcttcactcctacatgcttctaaaaatattacagtttatcatctgaaaaatttgtggaattatgctgaacagaatatgtaaaaaatttctttaggctacttttggcatgtgtttttattacctgaagttttatgattatgggctattgccattgaaaacagctaaggttttaacattcaaagatctagatttgcactgtccaatacagtagacagtagacacatgtgactatttaaatttatattaatttttttttccttttgagttggggtctcactctatagcccaggctggagtgcagtggcgcaatcacggcacattgcaataacaacctcctgtactcaggtgatcctcccatctgggattacaggcatgagctactgcgctgggccagtactctttattaatatgtgattatttccatttgagaaatttgaaacattaaaagaaaacgtttggttagagatacatttgctttttaaagtcctgatttagtaatttggttaaaatttttggctgaagagaattagtgaagcttaattgtatatttgtaccaatgaatgattataaaactttatcactgtaatcccagcactttgggaggctgaggcgggcagatcacctgaggttaggagttagagaccagccagtccaacatggcgaaaccccatctctactaaaactacaaaaaaattagctgggcatggtggcagacgcttataatcccagctactctggaggctgaggcaggagaattgcttgaacccagtaggtggaggctgcagtgagctcagatcatgcctctgcactccagcctgggcaacagagcaagaagacaccatcttaaaaaaaaaaaaaaaagttttgggaatcagatttaaaagaatttccattacaaagtaaaactgaaaggatgaaagaaaaaaattttcaacttagaacttctacaagaggaaagtttttcatggatacaaattctttggttatatttttgcaaatattccagtctgtggcttgtgttttaatagtatttttcaaagaacagaaattttaatatttatggagtccaacttatcaattttattcttttatgattcattatttatgggttctaagaagtctttgttaacccagatcacaaaggtaatttcttgtagaaattgtatagttttaggttttacacttaggtcaatgaccccatttcaagtaaactttttatgatatgagatatgggttgagagatttttttttcttttattttgacctcaacactatttgtagaaaaggttatccttaatttactgaattatcttggcaactttatcaaaaatcattttataagtatgggtctatttttggactctattccatttacctgtatctattcttttaccaataccacactgtcttgattcctttataggaagaaattattctgttttattcctttataggaagtcttgacctcaagtaatgtgagtctgccaactttgttcttctttttcaaaattgtattggctatttttaaatcctttaccttttctgtataaattttagaattttgtcaatttctgccacaaagagttttaattccacttatggcattctggaaaaggcaaaaattaccttaacaaaaatcagattgctggttgctggaggtgggaggaaactgactacaaaggggcacaaagaaatttctgggtcatgggaatatctttacagcagcagtggttacatgactttatatcactatatatctttgtcaaagctcagaattgtatagctagaaggttatattttactgtatgtaaacaatatctcaacaaacctgactttgaaaaataataaaaagaaaagaactaggctcaatagtgaattagactgaaattacctcatgaacaggcaagcacactgattatgtaaaaatctttctgatgtttacttttgaattgtttattctccatttttctacattaaagtattaagattaaatgtgttatatggaaaggatttgagggaaaacttttatttcaactatataaataaacgtgtgagttgtgatgtaaaacctagtttttactgagagtcatggcaaaaataatttgaaaaacagtatcctagaaaaacttttaccccgtgtgaatgggaaaacatacagcaatgtaaatgctgcattattttgaaatactaaaaacttaggataaattccatataatggaatgcttatgcaccaattaaaattagagctacaacacaaataactctcaaaaacataagattgacaaagaaaaaggaagctgaagcaggttatatacagtataccatttatgtgcttttaaacatgaaaaattatattgtttaagtgatacattaggaatgcaaaacattcaagttttagataatggctacctcttgaataaaggggatttcagccatatctagtatttattttttaaaagtaaatatgataaaatgtttccttttgtcaaaggtttccttttgtcaaagctaggtgttttccctatactctttatgttcaaatgtgctttagtgggtaacagagagtcatcagtaacctagtcttgaaagccatcagttgcagtgggttctgcctataaacccagaggtgaatgcaaagtaaaaagaaaaaaaaaaagttggggggcagggaataaatggtgaagaaaaggctggacgtaaaaaggaataaaagcctgttatttgcagcaacgtggatggacctacatgtcattacattgaaatatgccaggcccagaaagacagtatcacatattctcacatgtgtgagctaacaaacttgatctcgtggatacagaatatagaatgattgattgataccagagtgtgagcatgggaggaggaaatgtagagcaactggtgaatgggtacaaaaagagttagataaaagacaagctgtattgcttgatagcacattacagtgactataattagcaacaatatattgtatatttcaatgtagctaggagagaggacaggaaatgttaccaacccatagaaatgatgaatactcaagaggatggataccccaaatactctgacattattatacattttatacgtgtaacaaatacatgtacccataaatatgtaaaatatcatgtatcagtaaaagaaaaaggctggatagagagaggtaaaaataggagaaatgagagcagtcagtgcacataagagtaatatgcttgttatactgtgtggctacactggttaaggaaattcctgctgcatataacccaaatttgccattagaggttaagaaaactttccacttaacaatttaaaaattatacaactaaaacatccattatttaaaaatcaacataaagaagcaaaaaaaaaaaaaaaagaatagtaatcaaaattacaccgttgttgatatactgtattcccttctaggttttgggttaatacgtctgtacattttttcttttttaaaaagaaaatgagatcatactaaaagaatcacactgttttataaccttttttcccattcaccaatatgtactgaaaaacagtattttaatggctgtatagtttttccattatgttaatatgtcataatttactatgaatctcctgttgagttattttaattctaatgtttcactaaacatttttaaaaaacatctgcagtagaatcataacatacatctttatttccccaagataagttgatagatgctaagtgaaaaggtatgcatatttttgagggttttagatcctctctagtattctacttttcctattagtataggataaataagacaagatgactgaaatgaaaaggataggtgtgagacattaatattatcaattattcagcatagacatgtgtagattttatttggaatgctgcaagtaacatgtactacttgggtcaaaataagctcattacaaaataggttatcaagtagttcattattctagttaagaataaattgggtccctacgtttccctttttgacctaagacattttcctttgtaaagagtacttggaaactggaagtaccaatggattttcttttctctattttttaaaataaagacttcatgagtcctctccattagtactgtaagagaaaatgctcttggaataaactctaagatacatgacaaaataagctgccctcaacagataaaatcttcacctactttggtcaccagggaggttcaaattagccgggtattagaaaagtttccatcagtaggaaagggaaagcatcctctagaactagatccgtggtgtggatatcaattgaaaggccatacttgggatgaaggcataaataaggtagagtcattgtggagatggctcatagaggaagagacgtctgtgaatttatcctcaaataattttctcataaataaaacttaacaagttaatagatctcaaaacctggagctatccaaatggtgcagtgataagcgtagtgccccaagtacatttttcttttaattggtattcacataactagctatagtaataattattaaatagtgaagtccattgtgaaaagcaagggccatgtttcatttatttttgttttttgagcttttatcgcgtttaatagtaggcaatcaatcattgttgaactaaataactcattctttcattcttaacagactggattatggacagaacttggaaatattgagaataatttcttaaagccacttcatataggacttaatatgtcaaaagcacattatgaagcagaaattaaaaatagccaaggttggtaatgtgcaattttgttttcaattaggtctaaaaagtagtctaattttggaactgtcatattcaaatttaagaactttttaaaaatcttgtactttagagaccataacagctaagccattttatttatagttaaaattcttagcagatctataagctaatttacctaaaatcgggttaatgaagacttaaaccaaatattacattgtaaagcctcaaggtctgattaagaatctgtattacagctatttccgtttgggtaccattcctttggtattgctgggtccactctccatctcactctcaagtaaatccatacaaattatgaaaagaatcttagatccagaatttttttaagtcaataattctataataatcgtgtgatctcttccgtatatctgtggtggtgcttttataggcattaccggaaattttgtttttagtataatggctataattctgattatatactgaagaaaacagtttcatgaatcctatacatgccaaaataatgctatttatctaaagaagcattaatttacatgttgcagaattttgatatttcattctgtttgcttatagcttaagtataccctgagctgttaaacaatggacttaataatttatacaaataactgacatgttttaagttagtgaatgaaagtagcttatacctttgttattgaaatctgagagttaagtgtcacacatgatttttcttctcttacagaggcccagaaatctaaagatctttgttctataactgtaagtggagaagagatccctaatatgcctcctgaaatgcagcttaaggtgatctgaaattttcttttctttcctttttcttctttagaaacggggtcttgctatcttgcccaagctggagtgcagtggcatgattgtggctcactgcagcttcaactccctgggctcaagtgatccacccacctcagattcctgattagccaggactgcaggtgcacaccaccatgcctggctaatttttagtagagatagggtctcactatgttgctcaggctggtctccaactcctggcctctagtaatcctctcagctcagcctcccaaagcacaggaattacaggtgcaaaccactgtacctggtcttaaatattcctaagctacctccagctgaaatcttttctgtgttttgctttgttttgctttaaaggcagcattaataacattactttttcttggcattgcaggtcctgcattcagctcttttcacatttgatttgattgaaagtgttctagctcgagtggaagaactcattgaaataaaaacaaagtctacctctgaagaaaatattgggataaagtgaaagttccatttcctaaataaaaactaataaaatatagtactttccattatgattcatttaatacctttataaaaaatttttctgtaaaaatttactgcttgaaaaataaatgtagcttttctcattta

SEQ ID NO: 705 - DNA, 4382 bp, Homo sapiens
gagccattgattggtcgacgcccccagagggttacaattcaaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggtgagtgatgcggcctaccactcgccgggcctgccatgccctaggcattggtacccagagcaaagatttctaggaccaccccccgccgccacctcctggagcgggagatctgcgggtgcaggagaacacaccaggagctcggggcctggcattcccctgggcatgggtgtcgagggcggagacttccgggactcccacctccttgcgcgggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggtgagtataccctgagctgagcctgaccttggtgatgtggggagcctccatgacggctccccctgagattcaggtgggagaagatgcaccgtctggaggcctggcccatccagactcccaggtaaccccgaatactcttttttcaggctacagcaggagctgatgaccctcatggtgagtgattaagtgcccagaaccccagccttccatccaattttcagtagcctccttttttccgtcagcttttttgctagacataggggtaatgtaatttgctccctcctgggaaagaagttcatacaccccacctacaccatttcttccagcagtccctcctcccaattccatccccccacacgaagttatctcgaacacttccctgaagtcatacaagaccctccctatccagtgtgtccctacttcctagccccaaccaagctttacccacacccaactccccgcccttcttggtatttctagcctatgaatttggttgctttattttggatcagagtgatgagattaaggggaggctgggcgcggtagctcacaccttataatcccaacactttggggggctaaggtgggcggatcacttgaggtcaggagttcgagaccagcctggccaacattgcaaaaccctgtctctactaaaaatacaaaaattatccaggcatggtggtgcatgcctgtaatttcagctactcgggaggctgaggcacaagaatcatttgaaccgtggagacagaggttgcggtgagccgagcgcaccactgcactctagcctgggcgacagagtgtgtgtgtgtgtctgtctctgtctatctctctctctcaatctctctctctctctctctatatatatatatatgtaaatatatattttttagtagagatggcataaccccatctatatctcatatatatacacatatatatgtgtgtgtgtatacatatatatgtgtgtgtgtgtatgtgagcatatatatatatatatatatatatatataaaattaaggggaaagctcacccactgacctttgctatgcccaaaagtgtactccacattccaacaaatgtgttttctccccagatgtctggcgataaagggatttctgccttccctgaatcagacaaccttttcaaatgggtagggaccatccatggagcagctggaacagtaagtgtagggctgggatgggtgagtgagtctggggaaaggtgggaagtgagatccaagtgcgagctctgcttcaagcctttggcggagcaagacactcctcctgtgactgtttacattctctgagccatgtggccttgttctttccctctgtgcaataaagggtgggtttaaagcagggctgcctatcttagatgtttacatggggggacagacagcaaggaaatggatgaagtgaggactttggccaatagggccagatctcaagaaggcagcttcccattgctgcagatcaggtttaagatgagtcagaagtccaaatctgtgccaaatctaatttttacgtattagcaactaatattcttttttttttttttttgagacggagtctcgctctgtcgcccaggccagactgcggactgcagtggcgcaatctcggctcactgcaagctccgcttcccgggttcacgccattctcctgcctcagcctccgagtagctgggactacaggcgcccgccaccacgcccggctaattttttgtatttttagtagagacggggtttcaccttgttagccaggatggtctcgatctcctgacctcaagatccacccgcctcggcctcccaaagtgctgggattacaggcgtgagccaccacgcccggccagcaactaatattctaattgaactaaagcacaggatgccaatttacaatccttagaccaaagagtcactgatgtctccaccagataagaggaaagcatcaggctaggcatagtggctcacacctgtaatctcagcactttgggaggctgaggcaggcagatcacatgagcccaggagtttgagactggcctgggcaacatggtgaaaccctgtctctaaaataaaaactaaactaaaaaaactttttaaaaaggcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccaggtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggaggtgactttagagaccacccctcccctccatgcaacttgggaacctgtcaggactccctggggtcagcctcttctaccgccttgaccttctctttctctccacccacagaacccaacattgatagtcccttgaacacacatgctgccgagctctggaaaaaccccacaggtgagtcctcagtccttgagcccagggtgatccctcccccaaccttcaaaggctccctcaaacaaaaggagcccagtgacttgggaccgggttggttggggcagggtggagtgtcggcagcaacccacttctgtttctgccccagtgctcctatttgctataaaatagcaattgttttatagcagaataaaaatgtttggcgataaataattttgggaaattattggtgagaccaaggcaggaggatagcttgaggccaggaattcagtagagtgccttgcctgtgccctccagtctcactggaagcaagcccttccaggagagctgcctagatgggcagtgcagggagaatgccgggctgggaaaccagcccctcctccacctcctccgacctttgcatccctggtccagctgcctcttgcccaccttaattcatcctgggccaggcacagtggctcatgcctgtaatcctagcacttggggaggccgaggtgggtggatcacatgaggtcaggagtttgagaccagcctggccaacatggtgaaaccccgtctctactaaatacaaaaaaaattaaccgggtatggtggtaggcacctgtagtcccagctactcaggaggctgaggcaagagaatcacttgaatctaggaagcagaggttgcagtgagcagacatcatgctattgcactccagcttggtcaacagagtgagactccatctcaaaaataataaatagtaaagattaactcatcctgtctccatcactcactgagacctgcctgttctcttccagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 706 - DNA, 55549 bp, Homo sapiens
gtgctctatggtgttgccttcgccccggaagtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtaatagccgccgcgctctggtcttctcgcctcttggtccctgagctctggccgtgtatcctcgggggcggaggccgtctgggcctcttgtgctggccccagctcacccccttcaccttacctgccccttctctctcctctctcgcctccgtccagtcctcgcttctcgctccccttgcccagcccagccccccgcgagcctgcgctttctcctttcccattgggaaggacgtgactggaaggggaactaagctgagggttcattgcgtgccacacttcataatcgcgagtggaaactgttgagccagtttctgaagtgaagaagttagtacagctggcagaatggcggtttttattctttttccatctaattataaaggttgtgttccattacaaccagtcgccttctttagcttgtgatctaagggaggacgaagtctgatggaaggtatcactttgtgtctggcaaagtcgtaggagaggctttattgttgaattgagacagtggaagatttcgtttccggttgatttggaaagaaaactgccgaaccttccgagtagaagtgtgaagcgtatggttgatcagtattgctgatttttgcatcacagtaattcatttctaatttgagagagaagagagaaattcctcacctgtttaagaatctgatgtgcatttggctttgaaaattttcctcctcttttgttcaaaacttcattccttccaatttctgacttggttagatgggtgcctcgaatccacctgattgctgataagaaacattgtttatcaacacgtgggatagtcagtggtaaataatcgaggctctaatgtggcggagccattgcctaatctcaaggatcacctgaagagtttgtatggattttatgtcccaggcctcaccccagtcctcccaaatcacaatcaggagaggggtgggtggagtggaagaacctatatgtccgacaagcattccaggtgaattttatcagggacttgtgaaaactttacatacattgtatcttcatacactaacatagatctgtcaggcactaatcttaaactcctggggaggtggaaaatgaggacagatggaggtggtaatcccatttgagattgcatggtttaagggggaaagaaaagattaatactggccgggcgtggtggctcacacgcctgtaatcctagcactttgggaggctgaggcaggtggatcacctgaagttaggagttcaagaccagcctggccaacattgcaaaaccccgtctctactaaaaatacaagaaattagcggggcatggtggcgggcgcctgtaatcccagctactcgggagcctgaggcaggagaatggcttgaacctgggaggcggaggttgcagtgagccgagatcgtgccattgcacttcatcttgagcaacagagtgagactccatgtaaaataaataaatactgtacgtgtattaggaagcaacaggaagtgtgttaaacatttaagatttatgtacacatcaccgtattggttttaggaaggggaagcaaaagaaaactaatgagcctctagtaaaaattgagtataaagaccatttgaaacagtgaaccagaaacacatgaaatgttgaagattagtatttaatgtctgaaaagcttgccatttgtatagaaagtttgaaaatgacattttcgtggttgcataaaaaatatacatgagaatgtaggcctgaaatagagcatttgcctctggtaataagttcttaaagttaatagtatcagtttaccttatatataacctttattagctatatgttgacttcttatggctttgaaattagcgtgcagaagaatgacccaatccgtgtcatttgatgtattaataataggcctgaagtgggaccaggaatttgcattttacaagcactctaggtggtgatactagggtctgaaaactactgcaggcccaaggcggcccaccagccaagaatggtttacatttttaaaggattgtaaaacaaaaatagtaatatgtgacagatttcagtagtccacaaagaccgaaatatcttctatctggccttttacacaaaaggggaaaaaaatcttatttgggctccttgtaaactttactgttaccaaggtttgaggcttgaaagtggaaacctgtttaatttgccagttatatgaaactatccaagggaagaaaatagttgaattgtaacacttaacattttatatttttaaaaaacttgccgtttgtatggaaagtttatattgagatgatagtctctctctttctctctctctctctctctatatatatgtgtgtgtatatgtgcatatatatgtatatatgtgtgtgtatatatgtgcatatatgtatatatgtgtgtgtatatatgtgtatatatgtgtgtatatatgtgtgtgtatatatatgtgtgtgtgtatatatatatataaatatatatatatatatatatataaatatatatatatatatatatatttttttttttttttttttagagacattgtcttgctctgtttcccaggctggagtgcagtggcacgatctcagctcactgcaacttccgcctcccgggttcaagcgattctcctgcctcagcctcccgagtagctgggattacaggcatgcaccaccatgatgcctagctaagttttgtgttttttgtagagacggggttttgctgtgttggccaggctggtctcgaactcctggtctcaagtgatctgcctgcctctgcctcccagtgttgggattacaggcttgagtcaccatgcctagcctcaaaatatctttaagtaagatacttgacatattagtcaatcgtatatattatattttgttttaactgaccatctattaactcacgatggggtcaagaaaataattttgttatgccagagtttatgtagaatccatcctcccgcccagtatcttttgtattttttagaggcgagttgttctgtcacctaggttgaagtgcagtggcactatcatagctcactgcagcctcaaactcctgggttcaagggatccccctgcgtcagcctgcctggtagcaaggactacaggtacacactaccatgcctcgggctctattttgttttaagtggaatgaatctaatcaattgtgtgtgcttagacacattttgtctccatttgaacattaggccatttctacttaatttgttcatacaaatcttgagtaacataaacattaacactgacctgtatatttaagttgtattgtctttaccgttgcactcttaaaaacaatgcacaggctgggcatagtggctcacgcctgtaatcccagcactttgggaggccgaggcgggtggatcacctgaggtcaggagttctagaccagcctggccaacatggtgaaaacccgtctctactaaaaatacaaaaattagccaggcacggtggcaggggcctgtaatcccagctactcggggggccgaggcaggagaatcccttgaacccaggaggcagaggttgcagtgagccgagattgcatcactgtactccagcctgggggacaagagcaagacttcatctgaaaaaaaaaaaaaaaaatgcacaaaggctgtgcggtggcacaggcctgcagtcccagcactttgggaggctgaggcaggaagatcacttgagtctaggagtttgagaccagcctgggcaatatagggagactcctgtctctacaaaaagtaaaaaaaattagtgggtatggtggtgctgcctctggtcccagccacgtgggaggctaagggaggaggattgcttgaggccggaaggtgaaggttgctgtgagctatgagggcgccactgtcctccagcctgagtgagagagtgcaaccctgtctcaaaaaaagacccaaaaaataaaaaaccaaaacatttatgagactgtattgtaactattaggtgaacacatatattggtgtaactttttcttcttaaaagttataggattgtattaaaaaaaaagtctgagctggccaggcacagtggctcatgcctgtaatcccagcactttgggaggctgaggtgggtggatcacctgaggtcaggagttcgagaccaccctggccaacgtggtgaaaccccctctctactaaaaacacaaaaattagccaggtgtggtggcaggcgcctgtaatctcagctacttgggaggctgaggaaggagaatcgcctgaacccgggaagcggaggttgcagtgagccgagatcacggcattacactccaacctgggcagcaggagcaaaactgtgtcttaaaaacggaaaaaaaaaaactgaactataactgtggctggtggcaacttaagtattcatgacatcctcccactttgagcacatttgattgcttccccaaatcactagttcctggcagaaggaccaaagcagcagagtcaaggcaggcctgctgtcgtgagttgtcatatgcctcaagggaccctctttcccatccccatccattttattgcggcgcttcactttgttttccaacttattcaggtaagtaatttatttccctgtcttatatacccatctgattgggaagaggtgaataacctaaacctgtgaataagatagcaaacatttgcaattagggacatttatcatgcttttgcttgtttcacactttaagaaatttaaggctgggtgcagtggctcactcctgtaatcctttgggagcactttgggaggccgaggcaggcagatcacctgaggtcaggagttcgagaccagcctggccaatatggcgaaaccctgtctctactaaaaatacaaaaaaaaaaaaaaaaaaaaaaatcagtcctggtggcaggcatctgtaatcccagctacttgggaggctgaggcaggggaatcacttgaactctagaggcgaaggttgcagtgagttgagatggtgccactgcactccagcctgggtgacagagcgaggacctccccccgcccaccaaaaaaaggaaatttaaaatgaaagctcattaaaaagagaaaatgtaccttatataatatgtaataaacatactacatctaaaagcatccttattccaatagaaaaccaaactcttaactgacctaaacaattaggggaatttattggtttatgaagttcaaaagtgtagaggtaggactggcttctagcgagacaagtccagtgtctcaaattgtcaccagacaccattttctccatggcttgtctctgtttcctaaatgttggctttattctctcagcatgctatctccttgtggttataagatggctgccagcagctcttggggctatatatttttaggtgcaaatctagcagaaaaaaaagttgtcttctccgttatcacaaacaaaatcttgaaattgaatttcactggaccagattggcctaacttgggacaggtgcccatccttgaatcccttgaagttgccaaggaatgggatgtgaaatttggcttaagccaatcgtgggcttggtgtgtctcatcaaatgaaatggctggaaattctagagtatggtttggaaaaggagaagagggcatggatgctgggagtaagtcgtagtgaaacatttgtattggaattctttatttggttacctagataggattaatctgtgggacaacaaaccattctaatttaagtacaagtattgttggaagagtgaggaatcaggttctagctccttgctattccaagtggttcatgaactagcagtttgggtatcatctaggacaggggtttggcaaacttagtttgtaaaaggtcagatagaaaatatggccgcatgtggtctttgtcgcatattctttctctttctttttaaacaactctttaaacgtgtgaaaaccattcttagttggagactcaaatccactctataggccgcagtttgacaacccctaatttaggcgcttgtttagatatgcaaaatctcagactcaccttgccccagacctactaaattacaatgtttttaatgagatttccaggtgatttgtatgtaaactaaagtttccccaaacctgtggtatgaatagatcttgactctggcggcacatgagaatcacctggggaggtcttacaactactaaggccttgggtccactcctagacattctcatttgttatgaggtagagccatggtgtaggacttttaagagctcaccaggcagttctaatgtatagccagaattgagaattactgctctagactaggaagcataactgcctctgccacatctagtgtggtagataaaacaccatggccacaatattttgtagttcttatccaaagctggagtcaacttccctattccttgcagctgggttggacttgcggcttagtttgatcggtagcatgtggtggaagtaatattgtgcaaggtccagagtcggcctcagaagaccttgcagcttttgcctttgcccacttggaacactccctctgtcatggtagaagcccccgctagactactgaacaccaaggactgggcggtgaaagagcaagcagacaacaaccagcactaaggctccaggtacgagtgaagccatctgagactctccagctctgattaagcagtcaagagtactggctggggctgggcgcggtggctcacgcctgtaatcccagcactttgggagaccaaggcgggtggatcacttgagctcaggagttcgagaccggcctgaccaatatgatgaaaccccatctctactaaaaatacaaaaattagccaggtgtgctggtgtgtgcctggagtcccagctactcaggaggctgagacaggagaattgcttgtacctgggaggtggagattgcagtgagccgagatcatgccactgcgctccagcctgggtgacactgtctcaaaaaaaaaaaaaagtaataaattatggttttaagccagtgcattttagagtggtttgttaagatgtagataccttaattttaaaatgctttattactaaaaaattctaataatcatctgagcctgcagtgagtcataatctttttgctggtggagggtcttgcctctgttgatggctgtggactgatcagagtggcggttactgaaggttggggtagcggtggcaatttcttaaaataagacaacatgaagttcgccacgttgattgactcctcctttcacaaaagatttctcagtagcatgtgatgctgtctgatagcattttatccacagtagaacttctttcagagtaggagtaaatcctctcaaaccgtgctgctgctttatcagctaggtttatgtaatctaaatcctttgttgtcatttcaacagtgtccacagtgtcttcaccaggagtagattccatctcaagaaaccacttcctttgctcatccataagaaacaacttctcatctgttcaagtttgatcatgagattgcagcaattcaatcacatcttcaggctccacttctaattctagttctcttgctctttcttttttttcgagatggagtttcactcctgtcacccagactgaagtgcaatggcacgatcttggctcactgcaacctctgcctccttagttcaagcgattctcctgcctcagcctcctgagtagctgggattacaggcacccaccaccatgcccagttaatttttttgaatttttaataaagatgaggtttcaccatgttggccaggctggtctcgaactcctgacctcaggtgatccgcccgcctcggcctcccagggtactgggattacaggcatgagccactgcacccagcctctagttctctttctatttctaccgcatctgcagttacttcctccactcaagtcttgagcccctcaaagtcatacttgagtgttgtaatcaacttcttctaaactgttaatgttggtattttgacctcctctcatgaatcatgagtgttcccgatgacatctagaatggtagatcctttccagaagcttttcagtttaccttgcccagatccatcagaaaaatcactctgtggctattgccttacaaaatatatttctttttctttctttctttctttctttttctttttcttttttttttttttttttttttttttttacaaaatgtatttcttaggggaataaaaaaagaaaatatatttcttaaataataagacttaaacgttgaaattcctgcttgatgtatgtggttgcagaatggacattgtgttagcaggcatgaaaacaatattcatcttcttgtacctgtgcatctgagctcttgggtgaccagatacattgtcgatgaacagtagtattttgaaaggaatctttttttctcagcatttggtcgcaacattgggcttaaaatatttggtaaaccgtttgggcacagtggattgcgcctataataccagcactgtgggaggccaacacgggcggatcgcctgagatcaggagttcaagaccaccctggccaacacggtgaaaccccatctctactaaaaacacaaaaattagccggacatgatggcaggcgcctgtgatcccagctgctcggagggttgaggcaggagaactgcttgaacctgggaggcggaggttgtagtgagctgagatagtgccactgtacttccagcctgggcgacagagtgagactccatctcaaaaagtaaaaataaacaaataaaaaatattccataaacgatgctgtaaacaggagtgctgtaatctaggctttgttgttcgatttgtagagcacgggcagagtagtttaccatcattcttaagggttctaggattctcagaatggtaaatgagcattggcttcaacttagtcaccaacagcattagtgcctaatgaagtcagcctgtcctttgaagctttgaagccaggcattgcctcctcacctgtagctatgaaagtcttagatggcatcttcttccaatagaaggctgttttgtctgctttgcaaatctgtttagtgtagccaccttcatcttaggatcttcttgataagttgctgcagtttctacatccacacttgctgcttcaagttgtacttgtgtgttatagagacagcttgtttccttaaacctcatgaaccaacctctgctagcttcagacttttttcctgcagcttcctcaattctttcagccttcatagaattgaaggagttagtcttgctctagattggctgtggcttaagggaatgttgtggctgatttgatcttctattcatgtaattttttccatgttggcaataaggctgttttgctttcttactctatttttttttttttttttttttttggagacagagtcttgctctgtcgcccaggctggagtgcagtggcacaatctcagctcactgcagcctccatctcccaggttcaagcgattctcctgcctcaacctccccagtggctgggattacagtcgcccgccaccacgcccaggtaattcttgtatttttagtagagatggagtttcacattgttggccaggctggtctcgaactcctgacctcagttgatcctctcgtcttggtctcccaaagttctaggattacagatgggagccaccacacccagcctactatttttctcttctcaggagtagcacttaaaatttccttcagtagttttgctgttgttgatacagagtctagttctgtcatccaggttggagtgcagcaatgcatttgtagctcactgcaaccttgacctcctgggctcaagtgatcttcctgcctcagcctcccaagtagctagtactataggcgcaagccaccacacttggctaatttttaaattttttatagagacaggatctcactatggtgcccaggttggtttcaaactcctgaactcaagtgatcttcctgccttagcttcccaaagtgctggggttacagctgtgagccaccatgtctggcaagaattgtttctttgtatttacaagttggctatttgtgccagaggcttagctcctggcctatctcagcttttgacatgccttcttcactaagcttaattatttctaattggctgggcactttgggaggccgaagcgggaggatcacgtgaggtttgagttcgagaccagcctggccaacatggcgaaaccccatctctgctaaaaatacaaaaatcagctcggtgtggtggcaggtgcttgtagtcccagctacttgggaggctgaggcaggagaatcgcttgcacccgagaggtggaggttgcagtgagtcgagatcgcgccactgcactgcagcctgggtgatagagcaaaactccatctcaaaaaaaaaaaaaaagattatttctaatgatttcaagccagagacatgtgactgttcctttcagcttgaacacttagcggtgattgtagggttattaattgaccagtgtcaatattgttgtgttccaaggaataggggggtccaaagagagggaaaggtgggcaatggctggttggtagagcagtcagaacctacacaacattattaagttcattgtctcatggttcatggcacccaaaacaatttcagtagtaacatcaaaggtcactgatcacaaatcaccataacagataagaaaaaattgaagtgttgtgagaattacggaaatgtgacacagagccaccaagtgagcgcatgctgttggaaaaatggtgccaaaagacatgctagatgtatggttgccacaaaccttcaatttgtgtaacaaacttgggatatctgtgaagtacaataaatcgaggtatgcctgtgtgtgatgtattcagtatgtgtacctactgataagttctgaacttaaccctggggccagcttgtgtaatgtactcttaatgtcctcagcttgatgcacacttctggtgagatcctcgaggtatatattttaggcaaaaaggtctggctttgcctcaagtccagattcccaacctagcgtgtttatgttccttttaaaacttgtgcttcaaaattttaagtgaattggtgacaggtagaagtagttttttattagaattgattgtgtagtattaagctgttggaaatacaaatcctttgtatttcttatcctttgtatttctcagtccagtacatgacaaatgctaggaaccaagattactgggttacaacttgccatctttaattaattaattaatttttttttttttgagacggagtcttgctctgtcactcaggagctctcacactggagtgcaatggcgtgatctcgcctcactgcaacctctgcctcctgggttctagagagtctcctgccttagcttcctgagtagctgggattacaggcatgtgccaccacgcctgtaatcaaaatacaggcgtgcgccaccacgcccagctaagttttgtatttttagcagagatggagtttcaccatgttggccaagctggtctcgaactcttgacctcaggtgatcctcccaccccagcctcccaaagtgctgggattacaggcgtgagctaccatgcccggctgtcaacttgtcatctttatggtaaatatattcctattactttatgatacacctttgttttggcccaaagtggcattacttgttttgattaattaattgcgactttacttactagacctatctccaggttactttgggatctttaaatcaaatccagttgcaaaaagttaacatctaccactttaaaaattataccaggaatacatttggcagtaaataaactgatggttgtttaaataagaaggggagttatttatcaaatataggatgatgggaggtaagtggctagtgtctttgctcagtggctcaaaaatgtcaaggttagtgtctgaatcccttggcctttctcttggcatttgagatgactgcctcgtctctaggcattatattcttatttaaggcagaaagaagggggtgtgcttgacatcagtgacgtgtccatttttatcaggtaagcaaaacctttccaaggggctcctgaaaaattcttatgtttcatttggctgtaatcctgtgtgatatggttaccactagctctaggggagcctggaaaagtgaagatatttcctattacagaaaaagcaggcaaggggaaagggttggaaatagatttgggattagctattcaacagggtttgctaaaggatattcgttataagactggtaacaggctctgaagggagttaagagccatttagagcaacagtaccattggttgcataagtttataactttccaaaatagatgaacttactcaaaccttttctgctttttctgtaatagatttctttgaaaggaatatcacttatttggaagtataaattctgaaattaaaatctcaagtcaaattataatcactttcctcactgtgatttctgagttgaattgagtggactcagtgttgaagagaaagggcattcttaggccaggcatggtggcacatgcctgtaatcccagcactttgggaggccgaggcgggtggatcatctgaggtcaggagttcgcgaccagcctgaataacgtggtaaaacctcgtctctactaaatacaaaaaaattagccaggtgtggcagtacatgcctgtaatccgagctacttgggaggctgagacaggagaatcgctcgtacctgggaagtggaggttgcagtgagctgagatcacgccattgcatgccagcctgggcaacaagagcgaaactccatctcaaaaaaaaaaaaaaaaaatgcattctaggcaagtaatagtagtagtagctatgctattattctgagtttcatttatttccaaaatgcctattaagatacctccacctggatgtcctatgagcattcttttaaatactttattgagatacagtttacatatagtaaaatgtataagtattaaatatacagccagtgcattctgattaatgtatacacctgtgtgactatcacctaaatcaagataaagatggccgtcatcccagcaagtttcctcttgctcctttcctgtcaagccccacccattccaggcaatcgctcatctaatatttatcactacaggttagtgtgtctgtcaacttcttagcaatggaagtcacagaatcacatatcatgtactcttttgtattttacttcttttgccaaaagtgtttttgagagttatccatgatgtatgattagttcttccccacccctcccccccaagcctttttttttttttttggccaagtgtaatattccattatatgaatataccacagaatttctcctgttaatggaaatttaagtttcagtttttagctagaggaatgaagctgccatgactgcaagcattttaaacagcaccccagctggaattgttcgtctcttatctcccagttgcctattttgaggcttccaattttccttatcttattgaatagtaccaccttactttgaatatagtaccaccttactttgagtatagtaccaccttgagtatagtaccaccttactttgagaatagtaccaccttactttcagtatagtactaccttactttgagtatagtaccaccttactttgagtatagtaccatcttactttgagttactcacaataaagcttaatcattttttgatcccttttttattctgacagataattattgaccttttattagggactagacttggtgatagagatataatgaatataaaactgtaatctaatgggggcgtgggcagtagtggagataagtattaaaaaaactgctttggaactctagaagtgcaaaggagagaagtacccagcctggggcagctagggaagacttcctggaggaggagatatattaactgaaatctgaagggcccaaaaaagttaaagggaagtatataccaaaatatgagtagcattgtcgtagttaagagagcaaaacagatcataggaactgcaagaaagtcagtataacaggtatagagaggatttgaggtggcagagggaggaagtggcaagagagaggaaggggtcggattgaagggatgtgtgctgagtttgatggggtgatgaaaagttattgtggggtttaaagcaagggaacattacatttgtgcttaatacaatgtgaaggatgcacttggagtggggcagtactggaagcaaggagatctgctaggaaatggtggcgtattccaggccagaagggatgagctaaggagttgcattagaattaggaagagatttttggccctctgagaggacatttgagaaactatagaatgtggaggaaaagcagtgtgaggccagaagaacatgcaacaggttaaagtgtttgaagttaaggaaagtgttgccatgatccaggtatgagataaaggactagactaggaattttaaaagtatttttgatagagttggcttttaattgaataagaataaaggaaagataactccaaaatgacttctagatttttttttttttgagacaaggtcttactctgtcacctatgctggagtgcagtggtgtgatcttggctcactgcaacctctgcctcccaggttcacgcgattcttctgcctcagcctcccgagtagctgggactctacaggtgtgcaccaccacacctggctaatttttgtatttttagtggagacgaggtttcaccatattggccaggctggtctcaaactcctgacctcgtgatccacctgcctcagcctcccaaagtgctgggattacaggcgtgagccactgtgcccggcccccagcctagatttttaacctcagtaactgagagaactgtggtcttattgaaagagtacgtcagaaaatggaggtgtttgtagaggagaatgagttaattctattttgaatatattggttttaaagtaatggggagcatatccaagtagcattattcagtatagagttggaaatactggagtagaaagttcaggttaggactaaaataaatttgaatcatttacatgcttagaagtcattcaggtcacaaaaattcaaccaaatagcttgttttaggggctgggatacaaagacaaaagacctacccgagctctgcttttgaggagctttgaggctagtagaagggataatatgttatgatattcctcactgaatattgttcgttatatatataatatctttgaacatactatcccttctagaagggatatcataatatcccttaataataataatatacattattatcccttataataataaggtatagccaggcgcagtggctcatgcctgtaatcctagcactttgggaggccaatgcgggtggatcacctgaggtcaggagttcgagaccagcctgaccaacatggtgaaaccccatatctactaaaaatacaaaaattagccaggtgtggtggtgggtgcctataatcccagctactagggatgctgaggcaggagaatcacttgcatctggggaggcagaggttgcagtgagccaagattatgtcattgtactccagcctgggtggcagaataagactctgtctcagaataattataagaagggataatatgttcagggtacaaacagaaagggatctttactttgtgacctgggaaagttacagttttacaaaagaaaaagaagactgtttcaagaatttatatgggttgagtttgaatggggtagaggaaaaggggaagataccgggagttaaagatgaatttgaagagtaggaagtgctgttacagaagctaggactaggaggcatgatcagtagtgttagatattttgaggaagtcaagctgtagactcaaacaacaaaatttttttttaactgttggggtaacagctcacaaataatttggtggatgtccccaaaacagtgaaataaaggggagaggtgagaggagtgttttaatttataatgggcaatacttagaaaagaaaataattattgaatttggagtggcttcaaggacaatacatttaaatatttgttccagaaattgaccaaactttaaacaaaaaaccagaagtcattctgactgaaactgacaactggtggggcaccatggctcatgcctgtagtcctagcaccttgggaagccatggcaggaggattgtgtgagcccaagtgtttgagactagcttgggcaacatggcagaaccccatctctacaaaaggtacaaaaattaacaatgtggtagcctacgcttgtagtcccagctacttgggaggctgaggcaggaggatcgcttgagcctgagacgtggaggctgcagtgagccatgatcgtaccactgagcgacagagggagggagtaatcgtactctagcctgggcgacggagggagaccctgtctcaaaaaaaaaaaaagaaacggacaatttatagagttctctagctttttaccaggtcttcagattctttctgtgtggagaatggatacaaattattttgttgactgatagaaagtaatagcccaaagtagtatcctctgaagttgctgtagtttgtgtgtcaccttttccagaaaggttgaattttgtggctttgaattctgtctgagagtaggagtcttggctgtttttggactgtagagtgagaataaattgagatggtgatgatgcaggccaagtggaggttcatagaagttgatatttgcaagacgctactgtgtttctcatctgttatttttgccccataggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttggggtaagagctcactttgctaggagttacctaccttgctagaaatgcagtgttaaagtactttgtcccatttgggctcccttaaagtaaggacaggtagaggggggatcaaaaagagctgggctcatgaattctaattatagagtctgaatttttttttttttttttgagacggagtctcactctgtcgcccaggttggagtgcagtggcgcgatctcggctcactgcaagctccacctcctgggttcacaccattctcctgcctcagcttcccaagtagctgggactgtaggcactggccaccacgcctggctaattttttgtatttttagtagagacggggtttcaccttgttagccaggatggtctcgatctcctgacctcatgatccgcccgccttggcctcccaaagttctgggattacaggagtgagccactgcgcccggcctagagtctgaacttaaaaattgcttttattattaaattctggcttacttatgtaagccctagagaataaacatatgggccttgtttggtacagcatttcaagcggtgctaagttggtattttcagttttatttgaggatttatagctggaaacaggccccagggtattgtgaagttaatacaatgggaaacaataaaatgtcctttttggccaggcacagtggctcatgcctgtaatcccagcactggaggccaaggtgggtggatcacctgaggtcaggagttcgagacccctctggccaacatgatgaaaccccgtctctactaaaaatacaaaaattagccgggcctggaggcaggtacctgtaatcctagctactccagaggctgagacaggagaatcacttgaacctggcaggcagaggttgcagtgagcccatatcgcaccattacagtctggcctgggagacaagagtgaaactccatctcaaaaagaaaaaaaaaagcccttttcacttattaggtttcactgtgccaagtattcccttctgttggtttgtaaaaagcaatgacagtgaagaattctccttggaaataatgtatagatctatttccctcttaaatctattttgtaatatatctaattttatatagtttacaggctgtgcatttggatcagctgctatttggcaatatgaatcactgaaatccagggtccagagttattttgatggtataaaagctgattggttggatagcataagaccacaaaaagaaggagacttcagaaaggaggtaaagataaacactgctttctttcttctagttaatcacggttttaaaaaactgatacttaatagatgcacgtgttttcagtgtacatgatgcattcacataatgtgtaataatgaaatctgaggaactgaatatctatcaccttaaacatttatctttatgctaggtatatttgaattgttctccactagctattttgaaatgtactatagattatagttgactgtagttactctactggtaatcccaggttttgaagcctggttatttatgaagtgcttttagttaatggcaacatcagattaatagatgtcaagtcagtgcacttaatattcttcacagtaagtattgattactgttttatatatctggtgttgtacttaacagtgttccagaattctgtccctctacccacatgcatcaaaaatcaccacggatagttgttaaaaatgttaacgttggccgggcacagcggctcaagtctataatcctagcactttgggaggccaaggcagtcaggagctggagaccagcctggccaacatagtgaaatcccatctctactgaaaatacaaaaattagccaggcgtggtggtgcatgcctgtggccccagctactcaggaagctgaggcaggagaatcgcctgaacccaagaggcagaggttgcagtgagacgagattgtgccactgcactccagcctgggtgacagagcgagaactcatctcaaaaaaaaaaaaaaagaaaagaaattaatgttaatagttgttaatgtttctgcgtggaggatgtctcagctctactaaagtttaaggatctcagtggatctcagctctactaaagtttaaaggccactgttttacttggatcaccttgatggattgctttagagcagcagtcaccaacctttttggtaccagggactggttttgtgcaagacaatttttccacaggtcggggttgcaggggggcagatggttatgggatgaaactgttccacctcagatcatcaggcattagattctcataaggagcgtgccacctagatccctcacatgtgcatctcacagtagggtttgcattcatgtgagaatcttatgcagccactgatctgacaggaggcagagctctggtggtaatgctctcccactgctcacctcctgctgtgtggcccagttcctaacaggccacggaccactagtggtcagcagccgggttgttggggaccctggctttagagtacgtatttgaactgcagggaatttttcaaaatatacatgccttagggatagagctagcaagtgatttttttttctaagagacagcgtcccactctgtcacctaggcctcagtgcagtaatgggatcatagctcactgaagcctcaaactcctgggtttgagcagtcctcccgcctcagtctcctgagtagctgggactacaggcgtgtgccaccatgctgggccaattatttcattttttgtggagacaggagtctcactttgttgcccaggctggtctcaaactcctgacctcaagtgatctcccaccttggcctcccaaagtgctggaatttcacaagtgtgagccactgtgcctggccccaagaggagttttaaacgtttctcagtgacatgatatttacacacctgtggtaaatacctgctgttgagtgtctctaaactgtgctcgagatgaaatacggaaaaaaaaaaaaaaaaaagaaatatggagcttttagagcttttcatttactttatatgcaagtcgatggccctctttcttaactgatttcttaaaaatgtttgcttttagataaaacatgtattttgtttctttttttttttcttttgagacagagtctcacttgttgcccaggctggagtgcagtggcgcgatctctgctcactgcaagctctgcctcccgggttcacgccattctccttcctcagcctccggagtagctgggactacaggtgcccgccaccacgcccggctaattttttgtatttttggtagagacggggtttcaccgtgttagccaggatggtctcgatctcctgacctcgtgatctgcccacctcggcctccaaaagtgctgggattacaggcatgagccaccgagcccagccaatattttatttcttttattcaccaatacatattgaacactgagattttagttaatatgtggtttcaggcccatttggttttcaagcacttctgtttttttaatgacacattgcccttccaatctggagagtaggttgatatcttctttacttttccccttccttggaacagtgtgatcctggccagcaagagcctgagaaggaagccttgcattttctttttgctaatgatgttttgagttttctctaagtagggaaagggattcattcctccttgttttcccatgggcacattcaagaagcatgagccctatctgtgttagagaggctttatgccagaacagtggataatatttgcaggtgaaaatgacaataactagccatcggcatctgttcagtcaatgtatttgagaagatagtaaaactgacctattccattatcctggatctcttacaaagctataggtttccagcacatgtctgcacatgaagttttgatatccaaatgtacccaaatggttcttgagaatggtgaaaaatgatacaaacagtatacataatcttcatttaaagattgatttgtttataatataattaaatgataagttgaatgtataaaacctatgcccattaaagaagtttgaaacaatgtgtaaatttaacatggaaacatgaaagtcctgggaacccctttcgtgccactatacacgaagttctgggagttcatacacagtgcaattataattatagaaatggaatcggccggggcggctcatatctgtaatcccagcaccttgggagactgaggtgggaggattgcttcagcccaggagttcaagaccagccttggcaacacagggggaccctgtctcttaaaaagaaaaaaaaagaaaataaatggaactatacatactaatctgtagtttcttttaccttggattttttcttttaataacaaaatctggttcaatttcttagttggaatatattttttattttaaaactttaatcatggaaaatttcaagcagatacaaatgtagagagaatagtatgatgaatcattatcgtccagcttcagtgttccccaagacagggccaatttttttttcatctatttccctttttttcccttccctttccacccttgtattattgtaaagcaaattctagacgtatttcatgcataaaattttcaacatgtatccctgaaaaattaggaccctcctctttttattaaactccagtaccattactatatctttaaaaaagtgcaatttagtagacaatattctcagaattttaaaacataagaccttggtatgaataatcacttccttggtacctgtctgtatctgtgagtgtgctaggggctttacattattgttattccttgtgataacactgctgggtacctattattgtcccatttcatgtgtcaagaaactgaagtttagaaataattgtctgaggttccagagctatccagtggttggttctgtgtggagaatgtgggctgcctgactataaaacatgtgccttttccactctaccacgtatttattatgtctgtgaccaccagtgatttttgcagaagaggaattcctcttatgtgcgaggcattttcttctggtttttcatttttgtagcctgaaatttctcacatgtggtgatgcaattttctgtctgttttagattaacaagtggtggaataacctaagtgatggccagcggactgtgacaggtttgtgttagcttacacgttttaaccattcaagggaagagaaatcaaaccaaaaggtacagtatgtcacaagcaatggctcttgtaccatgctcaccagtggtttagaagacagtctctgtactgataggctaatgtaatagtatataaagtggtgaggtataaaggtttacatgatgctctgggtccgttactttctaattttgatttagtatgatactgattgatcagttttgttgtagaattccagcttgtggaatagcttattaattattacttcccttattaaagaaactaatggaaacattaagtaccttctatattcaggatgctgtaatacacattctgtccctacttggagttgcttacagagtagttgtctccctttttacagataaggaaaccggctttcagagaaggaacttttgaaagtcaaactgctagtaagcaatagagcagagtttcaaaacccaagtctgtccattcgaaaaccagttttcgctcttctcccccatgctatttataaaaccccatttaaatgtaagcatgacatgcatgtcaccatgataactttttttctttgtaaattgttatggaaagacagatttggctcttcaagttaacacctctgcaatatttcatggagtcagttatttgagaaacttgaaaatagatttttgccaggaagagtggctcatgcctgtaatcccagaactttgggaggccaaggtgggcggattccttgagctcaggagttcgaggccagctcaggcaacatgacaaaaccccatctctaccaaagatacaaaaaattagccaggtgtggtggtgcgtgcctggggtcccagctacttgggaggctgaagcaggagaattttgaacctgggaggcagaggttgcagtgagctgtggtcctactattacactccaacctgggtgacagatgagactctcaaaaacaaaaaaattttttttaagttttttaacgattgcatagaaaagaaaaaattatttctagagaattgcaaaatattgcttttgctcaaatttgattagacttaaagtctaattgattagacttaaataagcatttaagacttattttgtactcttaattttctgtacttaagtggagaaagggtgtttatctttcttcattcaaactgtttattctctctggaaggcttaatttttctgactttattggaacccgatgcagctttcaggcttatggttcagacattgcttcctttaggaagtgctttctttttttctgaactcattgcagtttttatcattgataatgcagtgtgccttatgtaattgtatgtgtaacatccttgagggcagtataagcatctggaggacaacaatgacatctttcattttgtgacagcacctagcatatatcatgtacacagtaagggcactcagttaaaatctgttgagtgaatgaatgttgaatggaatcttaaccaagggattgagatttttcagtgttgccataactaagaccatagaattgataggtcagtgacatcttaaaatgattacttcaaagatagctctttagtagcacatctgtttccactagattaatgtattttgtttgcttgcttcttttatgaaagtaatgaggctgggtgcagtggcttacgcctgtaatcccagcactttgggaggccgaggcgggcagatcacctgaggtcaggagtcagagaccagcctggccaacacggtgaaaccccatctctactaaaaatacaaaaaattagcttaggcgtggtggtgcacgcctgttaatcccagctactagggaggctgaagcagaattgcttgaacctggaaggctgaggttgcagtgagctaagattgcgccactgcactccagcctggacgacagagcgagactctgtctcaaaaaaaaaaaaaaaaaaagtaacgaaattaagatttctttagggtggcaaggttttgccttcactattttcaaagcatttcactattagtttatacctcacattctttgaaggtggtcatgattttatgccatttaacatatgaagaagcctagcatcagagtttaaaaccttttctcatgctggtgaatactttcttcaaagaagctagaggtaattaaaaatcagaattctttccccctagtctttttcttttttgaaatcaaatcagccatttggcatgaagagcgtagcagtagagagagatgcttgtgatctgtcttgcaacttgaatgtaagctgctttgaacaacataaatgtgaatggtcatgctgcaggtcttaaatctttattgttagattatccaagtgactttaacctcaggaaatgccatttgaactgtcttgtgtcacctcagacttttcttgtaggaaataattattctagtaatagtgattctagctttacaatgtctgtaagtggtgcttaatcaattacctatatatgagagtctcaagaataaactgtttatttagtatgtcttgtcttcttcctggggtgccaattagtccagctttccttgctgagcactcctgattgcttcttgtagactgcaaagtgaagttggctcagcttctggttttaatcagtgatagatttatggggtgacaggtctactccgtcccactttctttctttggattggagatgttttccgaatgggtttttttttttttcgttttatattttgaaagaacttgacaagtttgacctagagagtttttaaagctttgtgagaccagtgtgcctctctgctttgtagtattcatacctagacaatggcagcatgaaagctctagtcggttaaagatttctcactgctacaccaaacacttcatgtaagtattccttgccattgaatctgttgagctcttgaatttggatggaaagattttggatacggtaagttcagacagtaaagtgttaatccaaatatacatagtttctgagtttcagagaatgaggggtatctcaaatttatccatgtctctttggttcctaggtataggtaagaacagtcagattgtaaggcatacccataatttattttattgttaaggtggcatctggtggtgaggtaaaaaacccctttctagctgggtgcagtggctcatgcctgtaatcccagcactttgggagcacttttgggaggtggatcacctgaggtcaggagttggagaccagcctggccaacatggtgaaaccccatctctactaaaaatacaaaattagctggacgtggtggtgcatgcctataatcccagctacttgggaggctgaggcaggagaatcgcttgaacttgggaggcagaggttgcagtgagccgagatcatgccattgccctccagcctgggcagtagagtgagactctgtctcaaaacaacaacaaaaacctccccttcttacagctgatgccaggtttggagtctgtagttttgtttttgtttttgttttgagatggagtcttgctctgtcacccaggctggagtgcagtggcgtgatctctgctcacgggcaagctctgcctcctgggttcacgccattctccttcctcagcctataagtgcccggctaatttttttgtatttttagtagagacggggtttcaccgcgttagccaggatggtctagatcttctgacctcgtgatccaccgcctcggcctcccaaagtgctgggattacaggcgtgagccaccgcgcccggcgagtctgtagtttttgactgttctgtctcaatctgtctgtgcaaatccctttttaaagctatgctaggaaacttgttttaatcctttttttttggtttgtttggggattttttttttggtcttaatttttattacacagaaataatctccccaggcttcatattgctctgaaaaagtgtttataagcccactaggtatttgtggggcaagcggggagtataacgtggcattcttcaaacttaaatttgtcatccctggtgcttttatatttcacctaattttctgttctattgccctgatctgtcagccttttaagcctctcctagaggtccccaggcaacccccagagagaatattttctcctccctttctagctttcagggttgtctttgaggcacttgccaggttttcctgttagttcaagagaatgctgactttactgtattgagattcaggtaaagccacaggaaaaaatcagctaaattattatttttgatcaagaaggagcaaggacagaaaaggatagggagagagatcgcaagaaaactgtgccgtagttcctctactagtgtattttttgtcagctccaaagcttagtcactactactctccagtctttgaccccttgccccaacttctaaagtctattcttttttctttgctgttctgtttctgccaggcttattctttttcatttcagttctctctctccttgtaccttttcaaggttttgagctgtcttcccagactaaggcctccttacctattcctgatgttgctggtaaggcaatgttttccttggtcttatagcccatctttaccttttaatcagaatcagtcactgtttttctgtaactcctgacttcccagtctgcaaacaagttatttttgtagaagaatagcaaagttaatccttgagtgccaaccacacttcaagtatcatgctatgtgctttacatgcatttctattattattagtcatcataagaaccctgttatcctcatttctcagatggggcaaggaacggccaagtaactgcgatcacacagctagaactgggtggattcgggaatcaaatccacttcatgtatcaaagaatagggtttttattatgtccttttcacttttctagaatagcaaaccaccattaattacctttctgataaaccacactgcctccccctatcaagtatctgggtgctgattcacagcacaaattgcagcaaattgttccaaagtagcagcctacccccagggaggaaagggagccctttttgactgcctagactagattttgtcattgtaaaatgaataaatatgcatggtagcagatgaaaattggaatagaggatacataaagtgaaaaataagtctttctctcactctgaacttccagttctgcacttttcctttcccataataaccattgcatgtttagttacttgtgtgttcttccaaagcatctatttatatataggcatttatatctatctgtggtttaacacaaaaatagaaacatgcagtacatactcttctgcaccatgattttttttcacttaatattttaaagaacattctatatcaatacaagtaggtttgttacattctttttaatattttattgaggtataatatacatagaagaatgtgaatatgtcagatgtacaactcaactaattaattttcacaggctgagcacatccatgtaaccagcacctggattgataaatggaaattaccagcacatcaggcttttttgtttgttttggtttgttttgagacagcgtctcacttgtcactcaggctggagtgcagtggcatgatcacggctcactgcagcctcaacctcccaaggctggtcttgagctcctgggctcaagtgatcctcctgccttggcctcccaaattgctgggattacaggtgtgaaccactgtgcctggccagcatattctttttaatggcattatggtattccatgtaaatgagtattatttaacaaatcttttattaatagatatttaggttgttttcagtcttctgcttttatgaatattactacagtgaaatgccttatatatagatctctgtaccttgtacaagtatatttttaggataagttactggaaatagaattgctgggtcaaagaatatacatttaaaattttgtgtattgcaaagttgtcttaaaagaagttgtgtaccattttaaatgtcctccaacaatgtacagagtataaatacatcagattgatttctaaaagttccccacaggggaggttagatattctcatctgcagggagagtacagagaaataacaatccttttttgtggttagcaattacaagggcctttgcctccctcattgtgaatttgccctttctgtttacccgtattagtttcaaactttctgtctctatcccagtgggaggatggaagatggacagtctctctgggtttcttcttgattccaggtagctgtggacccagtccttaattagtttggtggatactgcctaggaaaagaaatgatagccactgtgtgaggccaacaggttgatctttgcacctgcctggttcccagagaacctgaggtaaggatggcttgagcctagttctttggctgctgtggatgtacttgcttgtcagtgtctggactggccaggtctgggttggtatagtagccccttcagataaaggagctttggaggggtgaattggcccacccagaaacagaggggatctgtgaatagctattagaccccaagtggtatggtaagtcctttataggaaaatgagaaaaagggttttactacctttcttgggctgaggaggaagataacctgaggtcattgaaccaagtagtgctttccaaatcagtgcatctgcctttttaaaaattaagatataattcacatataaaattcaccatttaaagcaggggttcccagccctgggcagggactggtaccagaaccgggctgcagagcaggaggtgagcggcaggggaacaagtgaaactttgtttgtggggttttttttgtttttttttttgtttgtttatttttttgagacagagtcttgctctgtcacccaggctagaatgtagtggtgtgatcttggctcactgcaatctctcccggattcaggtgattctcctgccttagcctcccaagtagctgggattacaggcacctgtcatcacgcctgggtaacttttgtatttttagtagagacagggttttgccatgttggccaggctgggatctaggttgtgtactccttatgagaatctaatgcctgatgatctgttactgtctcccatcatacccagacaggactgtctggttgcagggaaacaagctcagggttcccactgattctacattatgataagttgataagttgtgtaattacttcattatatattatgatataatagaaataaagtgcagaataaatgtaatgcacttgaatcattctgaaaccatccccccacccctggtctatggaaaaattgtctaacacaaaaccggtccttggtgccaaaaaggttggagaccactgatttaaaatgtgcagttggctgagtgtggtggcccacacttgtaatcctaccacttgggaggcctggcacttaggaggccgaggtcagaggattgcttgagtctagaccagcctgggcagcatagtgagacctcccacatctctctaaaaataataataaataaaaatagaaagccaaagtaaattcagtggtttttattatatttaaaaggctgtgcaactattaacgtcatctaatcccagggccttttcattatcccagaaagaaaccccattcccgttagcagtcactcccccattccctccttccctccttcccctcagccttaggcagccatcaacctgctttctctagggactttcctcttctggagatttcatatacatcaagtcacataatatgtggccttttgtgtctgtttctttcacttagcataatgtttttaaggttcactcgtgttgcagtatatatcatcagtacttctgtttctttttatggccaaatgatattccagtgtatggatatattacatttgtttattccttcatcagttgatgggcatttgagttgtttccattcttcagctattaataatggtgctatgaacctccatgtgcacatttttgtgtggacatatgttttcatttctcggtatatatagccaggaatggaattgctgggtcatatggtaactgttttttttttttttaattgtaaaaaaaaaaaacatgaaatataccatcttaatcatttttaagcatatagttcagtagagttcagtatattcacatttttgtaaaaccaatctctagaactttttcattttgcagatctgaaactctactcattaaacaatacgtcccctttttctcctcccttcatcccttgataaccaccattctacttcctttttctatgcatttggctactttagatacctcatacaagtagaatcataaaatacttggtgttttggactggcttatttcataatgtccacaaggtttatccatgttggagcacgtgacagtatttacttccttttttaaggctaaataatattttattttgtgtgtatatcacattttgtttatccattcacctattgatggacatttgagttatttctacctcttgttattgtgaataatgctgctatgaaaatgggtgtgcaaatatctctttgagaccgaccatgcattcgattctattttttgagatggaatctcactctgtcgcgtgggctggagtgcagtggcgtgatctcagctcactgcaagctctacctcccaggttcaggcaattctgtctcagcctaccgagtggctgggactacaggtgtacaccaccatgcccggctaatttttgtatttttttttttggtagagacagggtttcaccatattggtcaggctggtctcaaactcctgacctcaggtgatccacttgcctcggcctcccaaagtgctgggattacaggcatgagccaccacacctggccaattcttttggatgtatatccagttacaggattggtggatcacatggttattgtatttttaattttttgaggaattctcacgctgttttccatggcggttgtaccattttacattctcgccaacagcgctcaagtcttccaatttctcacattcttgccaacatttgttattttctctttgtgtgagtgtgtaggtgtttgacagtagccatcttgatgagtgtgagataatacctcactgtggttttgatttgctttttctggtgattagtgatgttgagcatcttttcacgtgctcgttggccatttgttttatcatctctggaaaaatgtatttcaagtactcgagttatttgatttttttttgttgttgagttataagcattctttttcgtttgtttttttgagacagagtcttgctctttcgcccagaccagagtgcagtggagcgatctcggctcactgcaatctccatctcctgggttcaagcactcttcccacctcagctgggattacaggcgtgtgccaccacgcctggctaatttttgtactttttagtagagatggggtttcgccatgttggccaggctggtctcgaaaccctgacttcaaatgatccacctacctcagcctcccaaagtgctgggtttacaggcatgagccacttgcacccgcctgagttataagcattctttatttgttcttgatatcacccccttttcagatacattatttgcaaatacttccattctgtgatttatttctgcttttttactcttttgattgtatcttttgatacacaaaagtttttaagtttgatatagtcccagttgtctattttttcttttgttgcctgtgcctttggtgtcatagccaagaaatcattaccaagtccagtgtcatgaggcttctcttctgttttcttctaggagttttatagttgagggtctaacatttaggtctttaatccattttgagttaatttttgtatattggtataagataaagatctagctgctgtcttttgcatgtgggtatccagttttccctttgttttctttttgaagaactatcaaattgttttccataggtagctacaccattttccactccttcaagtagtgtgaggattccatctgttattgcctgtcttttctatcagcaactacaattttttttgtattttttaattgtaaaatatatataacataaaatttgccattatagacattttttagtgcacactttagttgctttaagtacattcacagtgttgtaggttgggcatggtggctcatgcctgtaatcccagcactttgggaggcggaggtgggaggattggctgaggccaggagtttcagacagtgttgtataaccgtcactactatctatttccaggactttttcattatcccaaacagaaacactgaacctgttaaacaatagctccctattaccccctcccctcagccactagtaaccgcattctactttctgtctctgtgagtttgtctattctagatccttcatataagtggaaccataatttttttttctttttggtccagcttcttttgcatagcatagcgttttaatggttcgtcgatattgtagcatgatgaaaatttcctttgtaaagctcaaatattccattctatgtatttaccacattttggttatccattcttctgttgatggacatttgggttgtctccatctcttggttattgtgactaatgctgtgatgtacaaaggttctgacatccccacatccttggcaatactgtttttaatttttttgagacagagtctcgctctgtcactcaggctggagtgcagttgtatgaacatggctcactacaacctcaacctggtctcaaacaaccctccttccacagcctcttgagtagctgggaccataggcacgcgccaccacacctggctaattttttaattttctgtagagatgaggtcttgccaagttgcccaggctgctttcgaactcctgggctcaaataatcctcttgccccggcctcccaaagtgctgggattacaggtgtgagccaccatgcctggcctattttccttttttttaaatgtgataatagccatcgtaatgggtatagttttgatttccattttgctagtgactagtaatggtgagcatcttttcatgtgcttattgagtatttgtgtttcttctctggagaactgtctatttacttcctttcccatttttacattgggttgttgagtttttttttatatattctggatattaatcccttattggatatgatttgcacattttctcccattttgttgcctttattatatccatcctggtgagtgtgaaggggtgtatcactgtggttttgatttgcctttccttaatgactaatgaacatcttttcatgtcttattgtatatttattcttcttcggagaaatgcctgtttctccaaatctttttcccatttaaaaatagctatttatctttttattgagttgtaaaagttatttatatattctggatactagacccttattaagagatatgattcacaaatatttttcccattctgtgagttgtctgatcactttcttcacagtgttttctgaagcataaacattctaattttgctgaagttcattttatctatttttttcttttgttgcttgtacttttaagtgtcatgtcaaggaaaccgtgacctaattcaaagtcacaaagatgtgtacctatgttttcttctaagagctttaaaattttagctcttaaatttaggcatttgattaattcggagttaatgtttgtatttgagatttgagataggggtccaaactcattctgtgcttatggctatccacttgtctgagcaccattttttgacaagactattctttcccctagtgaattgttttggaaccttagtcaaaaatcaggtgaccgtaatcgtatgggtgtatttctggactgtcaattctgtccattgatctatatatctgaccttattctaatactacattgtctttattcctgtaggtttgtgttgtaaattctgaaactatgaattgtgagtcttccaactgttaatatgaaatattacattgatttttcatatgttgaaccaagctggcattcctgtgacaaattccacttggtcatgatttataatcctttttatatatggctggatttggtttgccaatattttcttgaggatttttgcatctcttttcataaaggaatattgatagttttttgtgatgtctttggttttgatacggaggtgatagtggctacatagaatgttccttcctcttctattttttgaaagagtttgagaaggattggtgttaattctcttttatatttggtagaatttcccagttgtagtaagttgaatagtgtgcttccccaaaatttgtgtccacgtagaaccacagaatgttactttacttgaaatagggtctttgcagatttgattagttacagagagatcatattacattaggatgtaccttaaatccattgactcatgtccttataagaagaagagaggacaaagaaaaatacagaaaacaagaccaaagagatggtggcagagattggagtgatgcacctgtaagccaaacaatgccaagaattgtcgagagccaccagaagctaggaagaggggaggaaggacacttccctagacccttcaaaaggaagcatggccctgctgacactttacaccttgatttcagacttctagcttccagaactggaagagaatagatttttgttttaagccaccaagtttgtgttacaacagctgtaggaaactcaaatactagtgaagccaatgagaaacataggcacctaacacctaatctggctctggggttttctttgtggtaagttttttgaattactaattcagtctctttacttactcttggtctgttcagattttctatttcttcgagtcaattttagtagtttgtatctttctaggaattttaaatttcatctaagttattctcatttgttggtatataattgttcattgtattttgtagtaattctgatttctataaggttcgtagtaacattctgctttcattcctgattttagtaatttgtttttatttttatttttcttttttagcaaatctcagacctgtatgagatgacttttgtaatttgagtctttttttctttgtcactgtagctaaaagtttgtcaattttattgatcatttcaaacaaatccaacttttggatttattaatttttctgttatttttctattcatttacgtatgttcttcattctttccttctgcttcctttggttttagtttgctcctctctacactttcttaaggtgaaaagttagattattgaattgagatctctttttttaatgtgggcattcatagcaccacttttgttgcctcctataaattttggtatattgtatttttgttttcattcatctgagtttcctagttgccctcgtgatttcttctttgaaccgttggttatttaggagtttgttaatttccatatactggtgaattttctgaatttatttctgtattgatttgtaatttcattccaagtgatcagaggacatagtttgtataattttagtgttttagtttaagtttattgagagttgttttgtgactgaacatatcctggaatgtgctgcatgtgcacttgagaagaatgtatattctgtttttgttgggtggtgtgttctatagatgtctgttaggtctagtcgttttatagagctgctgaagtcttttgcttccttgctgatcatttaattattctctccattattataaatagagttctgaagtctccagctattattgttatttattcctttagttctgtccatttttcttcatttttgagattcttttgttaggtacatatgtttctaattgctatttcttgatggattgaccttttcatcattatataatatcctcctttttctctagcaatgaattttgtcttaaggtctattttgtcttactatgcatgtggccttgtagagtccaggaatatgttagaggttttcagagtttctatggaaatcttattcccctgcttttcctcaagatttttgattagtctcttatttgcccccaagtgttatccatcatctcaggcagcctcaaacttaaaacacttacctgtcattgtttttgacaaatgccctctgtgaaaagttttatacttggggagctcccagtcaggttaaacagacagccctgaaagtgggttttgcatggaatcaacagccaggtcaaataatgacaattctttgggaatgaggctttgaaagagctccagctccattctaccagctacctcggttttcaagactaccttgtaactagagagtgggggattggactaggccaagttaaaatgctgcaaagctttgggaggccgacgcgggcagatcacgaggtcaggagattgagaccatcctggctgacatggtgaaacccggtctctactaagaatacaaaaaattagctgggcgtggtagcgggtgcctgtagtcccagctactcgggaggctgaggcaggagaatggtgtgaacccgggaggcggagctttcagtgagcggagattgcgccactgcactccagcctgggagacagcgagactccgtctcaaaaaagaaaaaaatgaataaacaaacaaaaaacgctgcaaagctaggtgttttgagattcagctgtttttcttaagtaaatacaccctggtttgctataagcctttgattagtttccagagttctgaaaaggttgattctgacattttttgccagttctttcattgctcttatgaaggagagttttcagagctccttactttgttatttttcactgacatagtccagtgcgttacacaggtgtgagggtaggcactaggacagcagtgccttcctgaatcagtagtgccaagcttgtccaagagttaccgagtcaggaagaagcaggtgacatccctcctaagtggagatatacaaaacttaagctcttctatttctcaaaggaaaaggagagaggaggaaaccattattctttgttcatttgcatgctaggtgcatgtactatcttatttaagcctcactacaacctttatgaggtaggaggtattgtcctcattttacaaatgagggaataaagtgccacaggccacaaaactgctaagtgacatacttaggattcagacttgaaaaggccattctcttttcaccatgttttccatttgctggttcactgtgtgactgctacatttcatcatgttttctcatttcatcgtcactcagcccttttttttctttttatttatttatttatttattttgagacagggtctccctctgtcgcccagactggagtacagtggtgcaattttggctcactgcagacttgacctcctgggctcaagcaatcctcccaccttagcctcccaaatagctaggacccaagcatgtgccaccatgcccagctgattttgttcatttttttgtaaagaggaggtctcactatgttgcccagggtggtctcaaatttctaggctcaagggatggatcctcctgcctggacctcccaaagtgctaggattataggcgtgagccaccacacccggcccgttcaaccctttcaggtagattttattattctcattttacagaagaggaaacaagctgagcggttaggcctcttccccaggttataatgtaagtaggacagagtcacttctgctggactccttcacccatacttttagccaaaatgcagtactgcctcagtaggcctaggattgccacacatcctctcatgctcatccgcttctggggaccagcatatgctgtttcccagcaaggaagccgtttttatgtggtgtctgaagtcctagagtgaccaaggtcaaaataaatcctcctggctacccatgtcttgatgtatagtagaaagagcactagattaggaattctggcttggccactgaatttggccctctgacaacttgtaccttttagagcctgtttttctcatctataactggccttcagaatagggtttacaaagaagaaagtatgtgcatttcacttttcttatttcttttaaatttgttaagtgtgtcttatgaatttatagtggttcacgtacataatttgttaataagtatacatatatgggatgtgtctgttactaatggatggtgtttactaatggggtgccccatgaaagcagtttgatgaccactggcttatgaagtaagggattttggctacagtctgtttcagtgccagtactcattatttatcagaaaagcttcttgcgtttggattgaaaacttagcagtgttaactctttgtctactgttaacctcaatgtctttggttatctttccccccgctttttttttttttgagacagtttccctcttgttgcccaggctggagtgcaatggcgtgatctcggctcacctcaacctccgcctcctgggttcaagtgattctcctgcctcagcctcctgagtaaccgggactacaggcatgcaccaccacgcccagctaattttgtatttttagtagagacgaggtttcttcatgttggtcaggctggtctcgaactcccgacctcaggtgatccgtccgcctcagcctcccaaagtactgctgggattacagacgtgagccaccgcacccggcctttatctttcattttttttcatgtattttcctttattttaatcactttatccagaaacatatcctcgtcttgacagtgctgtggtgcctgtggtttccagaagctgggtgtgctgtgtgtctgtggtttgaggaagttgcccatggaactgacagaggaagcagagtagtcgttgccatttttcagcctagtaggcaggatcagggaccccatcttgctctctttgccttgaaccacaattagaataaaacaccaaagccctgactgatcatgatcatagcaatccgatctttatgatcatggccagaccattctcaggtcgtctttaccctaagatatcaatcactgggtatgacaacctagacctaagggtgcactctgggtagtaaagatgattaactctcccaaaggaatctaaggaatccagagcaacacgaatcactgctctcttcctatagggtaaacctcccaagactccagtccctgtgaggaggctctgcccgcctgcccttcccagggttccaggctccacattgggaggtgtacacagtgctcttcgctcttcattgccttgtgtatgatcccttttcccatctttgcataaatgctgtccctctcaccatctttaaaagagttctgggtaattatttaccaaaggtggtataatgctgtcacagtccctgctagtgagacatctgatacaactgatggaatcagttcaacaaaatgcagtaaaattttatttaatgtactacggagaaagaaaaaatgctaccagttataagatgcatcctgatttcagatattaaaatggaaaaaatgtcttaagatctgtgaaaaatgtagcttcctttcccacctctcaagtgggagagcaaaaactggacagactagaaatgccaggggctagctgagaaccttacagaatgagcaactgcggaagccacaggtaacaccgagatgtagatcagctgccagggacaagacaaagaatgttttctaaagtaaatcctcttaccagtatgttattgaaatcagtccttattggcatcgaagaaggtgaaagtgctacttgcctgttgcctacagagactggaggaatgacaaatgtttattttaattcaacaagtagaggaatacctgctatgtgaaggagttgtggcaattcataaaattaatatattttttgaagtttgtagttttcaataataatttcttatctaaaatgtaacaagttaattatattatcgaataaacctcaatttcgtagtactaacaacatcaacacttacagaaaaaggaaagtcactcaactcccacatgtaaacagactttagaagcagttgcagaggttttctaaattatccctgaattcctatcacatgactatttttctcagacatgttgaccttcacctacacagatgactcacatatgtttccataagctggcagtaagtttaagaagcataccatgccctgaggaaaaagaagtaatgttagctcttctactcttggccaaagaacctaattctgtatattacttctgtctttggtttggctattatagacaataaattattgatctgattataattgagaaaagtaagctcttctaaagaagtaaaatatggatctagggaaaggaagttagctcccagagcatttacaatttcccaggaattctgtgactttaccaaccctaggcagtgctgatactttaaaagcattcatttcacttgcttttttttggctcaccccctatcccccaggtatacagtactcttacataattgtggaagaatcttacaagggggtaatgtagatcagactttcctgctttcatttttaacctccctaaattataaatatttattttgtaggtattatagctgcaaatgtccttgtattctgtttatggagagtaccttctctgcagcggacaatgatcagatatttcacatcgaatccagcctcaagtaagtctaacttgtgtgaatttattttaaggtagaaataatatgaaagaaatatgctttagttaatggaagtgctgtaaaaaagacgaattacctatcaatagctacaagcaaaatgcagaggataggctgtaagctccttcactgaggacagggacctcacctctctttttctttttctttgttttttttgagacggagtcttcctctgttgcccaggctggagtgcagtggtgcagtcttagctcactacaacctccacctcccaggttcaagtgattctcctgcctcagcctccctagtagctaggattacaggtgcccgccaccacacccagctagtttttgtatttttaatagagacagggtttcaccgtgttggataggctgttcttgaacacctgacctcaggtgatctgcctggctcggctggagtgcagtggcgtgatctcagctcactgcaagctccgcctcccgggttcatgccattctcctgcctcagcctcctgagtagctgggactacaggtgcccgccaccacgccccgctaatttttttgtatttttagtagagacggggtttcaacatgttagccaggatggtctcgatctcctgacctcgtgatccgcccgcctcagcctcccaaagtgctgggattataggcgtgagccactgcgcccggccaatttactttttattttattttattttattttttgagacagggtcttgctctgttgcccaggctagagtgcagtgatacgatcttggctcactgcaacctctgcttctcaggctcaactgatcctcccacctcagcccccaggagctgggactacaggtgcatgccaccatgcccagctaattttttttgtttttagtgcagatgaggtcttgccatgttgcccagactgcttatttttttctaatcaacttttgccataaggacaagttgctttcattgaactgagagtttttattggttgcttactaagtagaaaagagatttattaagacagctttttgtcacttttaaaaatgatgtcttaagctgggcatagtgactcacatctataatcccagcacttggggaggctgaggcaggtgaactgcttgagctcaggagttcgagaccagcctgggaaacatggtgaaaccccatctctactaaaaatacaaaaattagttgggcatggggtatgtacctgtggtcccagctactcaggaggctgaggtgggaggatcacttgagcccttgagcctcaacttgaggaagttgaggctgcagtgagccaagatcgtgccactgcactccagcctggggcgacagagcaagactctctccaaaaaaaaaaaaaagtcttaaaaatagctgtttttgttttccatgtttgtttcataaattttttttttttttttttttttgagatagagtctcgctctatggcccaggctggagtgcagtggctcaatcttggctcactgcaaactctacctcctgggtccaagtgattctcccgcctcagccttccgagtagcaggaattacaaacgtgcgccaccacacctggctaatttttatatttttaatagagatggggtttgactatgttggccaggctggtcttgaactcctgacttagtgatccgcctgccttggcctcccaaagtgctgggattacaggcgtgagccactgcgtccggcctaattttaaaagtttaaaatggataatttttattggctgtgtgtttcatgattaccagactatgtttctctctcttgtagaggtcctttgttctccaatgttgctgtcaacattcagtcatttctccttatttcacatggcagcaaatatgtatgttttgtggagcttctcttccagcatagtgaacattctgggtcaagagcagttcatggcagtgtacctatctgcaggtaatatgctttaatctcggggcctttgagagtataagcactctaagctatctgcagaacggacaaagggaatgattactgccatattctacacgtagtgagtgctcagaacatatttgtttctcacagtgtatgtagagaagggagccacagattggtggagatgttgccttttctgttcattttgctgatttcttcttacatatgaattatgtgggtatgtttaattttaagttaggataaacaggcgttaagtaagggttagtgtagaatttaagcatgtcatttttgtaatctcatcgggccttgatttcattagtttaggccctccattttatagatagtggttcccagacttcccggctgcctcaatctcctgggtctttgttaaataaccttaagcaagctcatttcccccagtgtgttcagttcacagaaagctttaaatcagagctatacaatatgattgtcaagagtgagtttgttctgtcttctttgcaagaatgtagcagggaaccacttcctagccatggtcttgaagatggtatcgtttcttatttcagttaggaaattctcatgcatgaatccaggtccctagatgctgctaacgtgacagttggtcaaattttacttacctctctgtttgtaaaatgtacttacttaatacaatataaaaattaatttctaaaatctctacatttagaaacagtatatctggcagttgtgctgtgatgtagtgaaaaacactaagcttggcgatagacccaggttcagatcctatttctactaccagctgagtgatgttgcaaaaatgactaaacctcatgatacttacctcctcatgacaaggggttaaagaaaggactacataaaagcatctaccacaagccccagagtagatgcttaattagtgttcatcgaatacttatgtgtatctagtccttcaaaaaaagaagctgagcattgtgtttggcttgtaagataagtgtatagttctttcccaagcactagttatgttgtagttacagagggtctgtttcagatacattaattcctgctccataggaggtttttaaaaatgagccacgttgactcaaatggcactgaagccaaagagacttacgggatcatccagtctgttgtcccaccccagatattctgatttcgtgtgtctggagtacagccagagaatatactcttgggaatgagtcttcatgttatagttgaggaaaatggtaactgagaagtggagtgaatgaccgtgtcgctcagcagatcatgcagcaggtcagacttttcatcccctgtaaagtcgctgaaatgataggcaggagaagtattcatgcccgtaccctcacagtgatccagattgaaacccgacactgtttatctgtgtagaaatcagaaatgaaaaccattttcatggctggatgtggtgccgcacgcctgtaatcccagctactcaggaggctgggggacaagaataacttgaacccggtaggcacaggttgcagtgagccaaaattgtaccactgcacttcagcagccggggcgaaagagtgaaactctgtctcaaaaaaaaaaaaaagaaaagaaaaaaaaaagtaaaccatttttatacctcacttaaattattgtaatgtgacttgtttttcaggtgttatttccaattttgtcagttacgtgggtaaagttgccacaggaagatatggaccatcacttggtgcagtaagtatttctattgtaaattttttttaatttaatttttaaatttactttgaaataagtttagacttagaagaatgttgtaaaattgataagaggttctcatatacccttcaccctactgttaactaacatcgaaaccaagaaattaacattgaaacaatacagttgactaatttagaatttatacatttgtaaagctttgtaaatgtccggctatagcttttaaccattggtcatatatatatgtttaccagagcagagtatatctcagaacagtaagtgtgcaatcctcgtaaaccagagagcctaatccagtattggaagattctaattatagatttgaatctggtactttatcctcctatttagtcaatattggagtgcctactaggtgctatgctagagcctggggataacagctggtgagcaagatgatcacgattatttgtgttggttttagaaagtggggaacaacaacaacaaaaaaggctcctgccctcagagctcttatattctggatgcttaaaaaaatttttcttaggctggatgcagtggtttacacctgtaatcccagcactttgggaggccaaggtgagaggatgagcccaagaattcgaaaccagccctggtaacataccaagatcctatctgtacaaaaaaatttaaaaaattaactgggggtggtggcttatgccggtagtctcagctactcaggaggctgaggaaggaggatagcttgagcctaggaggttgaggctgcggtgagctgtgattgtaccactgcaccccagcctgggtgacatagcaagaccctatctcaaaaaaaaaatttttttttaagtgtgttttgaggctgggtgcagtggctcacacctgtaatcccagcactttgggaggctgaggtgggcagctcacttgaggtcaggagttcaagaccagcctggtcaacatggtgaaaccctgtccctcctgaaaatacaataattagccaggtgtggttgtgcatgcttgtaatcccagctactcgggaggctgaggcaggagaattacttgaacccagcgggtagaggttgcagtgagctgagattgcaccactgcactccagcctgggtgacagaacaagaccctgtctcacagaacaagaccctgtctcaaagaaaaaaaatttttttaagtgtcttttgagtttaatggcagatttctgggcacatggaaatctttatgtaatatttccttacacattcagtttgtacttatttaaatactaattcatttaaatgcattcaaatagggaatttcctatttaaaggaactctaaaaaggtcaattttgaaaagaattcttatgtaaaataaccattccctaatttgtatgttccccaaatttgtttacacttaattttcctagtgaggcctgtgttctgtcctgtgaccacatgctttcttaagcctccttctttcccttcgtggaatgtttattttctttatacaatttcgctctgatataatttatatatttcgaatcatattgtctacctcattcaacagctaagcacctaatatatgaaggcagtgaagaccactaggatgaatcagagactcagaattcgaatttagctggggagaaaacatacacacatctaatacacactgaaaggaatgaggattctctagaggactttgggggctctaagagtgaagagacctttctaattagctgaaaggacctgcgagggcattttgatgtgctcttggacagctgttgtcctcatcttatagataagaaactgaagtgcaaacttaatgaagtatggcagtaaggtatttggagttagagtgggggtgaatcctggttctgctacttacgtgtgatttctaggacatattactgaacttctctgaatttcagtttccctttataaaatggggataacaccatctatttctgaggtgcaaagcaagtacatttagagtgcttagcacaataagaagcacatggtaagaaatgtggacatggtagttcctgttcagtcatcaaaatcctacagcgccgtggtaggataacattatccccaaatatcttaatgaatctgtgattaaaattcaaggaaattaaatcaccaggtataatggcatttttaatgagaaatctgggaaaaaaacaccattaacaaagttgtgttgttacaaaatgtaaagcgttagtcctcttggtttagtgagacgttataagatgcaggggacagccaggcacagtggctcacgcctgtaggcccaacactttgggagccacggcaggaagatcacttgagcccaggaggtttgagactagcctgggcaacaaagtgagaccccatctctacaaaaaatttcaaaattaagccgggcatggtggcatgcacctgtaatcctacctactcaggagaggtgggagggtgggaggaatgcctgagcctaggagggtgaggctgctgtgagccatgagcatgccactgtgctccaacctggacaacatagcgagaccccatctcaaaaaaaaaaaaagaaagttgaatgggactgttaaaatatgtttgtaaattactgtattggtactatcctggataatttttaaacttttctgtagagacagggtctccctatgttgccaaggctggtctcaaactcctgggctcaagtgatcctcctacctgggcctcccaaagtgttgggattactggtgtgagccactacacccggccaattgtcttttcttattcaagttgagatttttctggttcttgatatgatgagtgatttttcagttgaagcctgatcattttagatatgatgagactttggatcttattgaaatctgctgtttcagtggtcttcctctgacactgttctgatgaggagagggggtgccgtgactcgttactgctgggtgtaggagtagacgtccaggttcctcactcagccgcctttgcctcctgagtgataggggctcttgtcactgcagggcagggatgggagctgagggcgtgcaggctacctagtgtgcctctgctaatgtcgctgtggctaggaggagcaagggtgcttctttccgctgacaccgcctgttaggcgtattgggatgcctcattacagtgtggcaagggtgggagtctaggctctgctcagcctttgctgggcacccgtttctctaaatattgtctaaaaggtctcttttgctaggctatctttttttggtccttgactagagagaacatgttgagggatgatcgatatgaggccaaaagaaagcccagggaactcaccaccacaacattgattgaatctcaggcttcctagctggtccgctttcctctctcttcctttcacagtcctcttacatttgtttcatatgtaacacccagggtctttagctgtacttagcttttgtaagcagagggagcagattcacttaaattataataccaaataaagttaaaaaacataagtatgatagatttgaagattatatagatacagaaaaatgtttgtgagcccaggcgcagtggctcacaactgtaatcccagcactttgggaggccgaggtgggtggatcacttgaggccaggagttcgaaaccagcctggccaacatggtggaaccccatctctactaaaaatacaaaaattagctgggcatggtggtgtgtacctgttagtcccagctacttggcaggctgaggtgtgagaattaacttgaacctgggaggcggaggttgcagtgagatcgtgccaccgcactccagtttgggcaatagcgagactctgtctcaaaaaatatatgtttatgaaataagtaaaaaaaaatcagatgtgcatattgattacaggtatataaccagtacataaaaatattgatggagaacaaaagaccttcacctcttcccatggacccacacctcttaggtctgttggatcagggttcatgactcactgtacttaaactgtgtatgaatgtgagcgttttctgagaagagaagggttcattttcattaaattcttctttctgactcgaaaaagtgaaaaaagtctctctgcatgggagtaagcccaaatatttgtcaaaaaacaagttgtgatttattcagacatataaatatttaaatttatataaaagccacatcgagaaaattctagaaggatgatggaactgtgtatgtaataattacaataagttataatcacaaaaaaaccagcgttccatggaattgtacagataacgacaattttttttaacagatggagaataatcatctatggaatagtagtttagaagaacttcatagaattttttttttttttttttttttttttttttgagatggagtttcgttcttgttgcccaggctggagtgcaaaggtgcgatctcggctcgctacaacctctgcctcccgggttcaagcaattctcctgcctcaacctcctgagtagctgggattacaggcatgcacgaccatgcccagctaattttgtatttttagcagagactgggtttcttcatgttggtcaggctggtctcgaactccagacctcaggtgatctgcccgcctcagcctcccaaagtcctgggattacaggtgtaagcgactgtgcctggcagaacttcatagaattttaatgctctttcatatcaactaatcaaattatatttgcttcattttggggaaacgtgtaattttgatttgttttggggtttttttgagataaagtgtcactctgtcgcccaggctggagtacagtggctcaatcttggctcaccacaacctcagccttccgagtagctgggactacaggcgcccaccaccacgtctggctaatttttgtgtttttagtagagacggggtttcactatgttggctaggctggtcttgaactcctgacctcaggtgatccacctgcctcggcccctcagagtgctgggattacaggcgtgagccaccgtgcccggctacaattatagtctcttgcacagaagccagcttggtcaaaattcaggtcttcttgggtcctccttttgaggagtgttcatgctgtccttccatcttgcagttaccctgacttctaagaatgcaacccgagcttgtttccctgttgaggccacttggcagttatatgagggactggggacatctgagatctctgggactcataataattttctttaaagttttagtaattccccaaatgtaagataatcttgtattctgaagcaacccgtcacatagaagacattaagaaaacattgattaagagaggtagatgctattttccagaaacaaccgtttttatatgaaaaggtaggaacctttctttttaatgataggggcttctttcaaaagttattttgctcttaggtgtcttttttttttttttaaacatctcattcataaataattaaaaacttatggaaagttgcaggaaatagtacagaggactcccataaagtcttttttgtttgtttgttttgttttgttttgagacagagtctcgctgttttacccaggctggagtgcagtgggacaatctcggctcactgcaacctctgcctcccgggttcaagcaattctcgggccttagcatcctaagtaggtgggattataagcatccgccaccacgcccagctaatttttttttttttttttttttttgtatttttagtagagacggggttttaccacgttggtcaggctggtctcaaactcctgacctcaggtgatccacctgcctcggcctccaaaagtgctgggattataggcgagagccactgcacccagccccatgtagtctttttaaaaagcaggcaactcaggtttactagttaacatgcaaaaaactgcacatatttaaagtttggtaagctttgacatgtagacacccgtgaaaccatcaccacactcaagatcatggacatattcatcccaaaagcttcctagtggtcactccttcctgcccctcctctacccctggcgacaacttacctacttctactaaagataaattagtttgcaaatggaaccatacagcatatactagtatttgttgtcctggcctcatttactctgtataattactttgagactcatccatgttctgtgtatcagtttattcctttattatttttgagacagggtcttactctgttgcccaggcaggagtgcagtggtgcaatcatagctcactgtaaccttgacctcctgggcttaagggatcctcatgcctcacactgtgctggaattacaggcgtgagccaccacactggcaatgttttgtttctttatgaagatgaataaagatttcacatgaattttttaagatgaaacatgcttcatgcatgcaggtttctttgggcgtattcatgcccactccctctggttggagctttgtcagagaagtgtgagcagttctttcctaggccataggtgaaagatgcgcatgacacgcttagcactgtccttgcggttcatgaggcacatacatcttactgccccgtagtaaaaattcagtctttccaagcgattactgtgtgaaggacatttagttccttcacctattattggggacataagtaactgaaagctttgaagctttgtgctcacctagaaatgtgcagcatgtaaactttctagaaaatgtgctgctctttagaccttgtagccactaagcagttgcatattgagtttcccattctccctgctgtgttactttgcagtctggtgccatcatgacagtcctcgcagctgtctgcactaagatcccagaagggaggcttgccattattttccttccgatgttcacgttcacagcagggaatgtaagtatttttatgaagtgcagtgctggggatagtggtgatgtttttatgttgagtgggttcttgcccttaagttagaaatgtcagtgctggagcaatcacagttgtgccgcttgtttcttgctgcctttcaggccctgaaagccattatcgccatggatacagcaggaatgatcctgggatggaaattttttgatcatgcggcacatcttgggggagctctttttggaatgtaagtttgagtgtaattgattgctaaactgcttccttgggtcatgcgctcctcctaccccagcctcacccctaccccccatccccatggcagagacattgaactatgcaacggaagcagaagcaggtgggcttgggagggtgaggaaacctcaacgtggcttgctttgggtttacccagcatacctggctcattgtagagacagtctgtgcctttaccctacgcttaaccttaagttgccccaactgttggcctgttattcccagccccctcttagaagactgcagcctggcccccagtctatgctgacatcttctttttccccttcagactttcctgccctcctctcccctgcctggcgtcccaccctgctaccctgacctctgtctcgccagtgctatttagacatgctgagttggcggagccattgctctgtatgactggagtagaggccggtgactgcaaaccaatgtggaccacttactgagtacccgctgtatgcaggcaccaagctagttcccttatgttatactattactactcccattttactgatgggaaactgaggctcagacatcatcttccccaggccaaacagctcttcaatagcagagcagagctgtaaacccacctctataagccctttccacccccaccacaccatatggaattggttgctaaactgcttccttgggtcacagcaaatggcattgtggttacaagaccttccacgtgtgcttcaaacaatggggttttgcctagactagtgcttagtagtaactgtatcacggaaacacggtcaggactcttggcgtccatctgatcgtgggagacccgtcagcatgagctggatcccctcggggcctgtcttttcttacataaatgttgccttttgcccttacttggtttttattttgttccgcgacaatggaaaacttaatttttttttttattaaaaagaaaaatctattctggccaggtgcagtggctcacgcctgtaatcccagcactttgggaggccaaggcaggcggatcacaaggtcaggagatcgagaccatcctggctaacacagtgaaaccccgtctctactaaaaatacaaaaaacttagccgggcgtggtggcgggcgcctgtagtcccagctactcgggaggctgaggcaggagaatggtgtgaacccagaaggcagagcttgcagtgagccgagatcacgccactgcactccagcctgggcgacaaagtgagactctgtctcaaaaaaaaaaaaaagaaaaatctattctaagtgaagcagtttttcccagtaggtggcagaactaaatgccattatgccatttataattttaagtgattaaagaggagtagtatgtagtatatgcaaggtctagctctaacagcagtgcagtataaatagtagaaactgacctgatattacagtatgagaaacatgaaggggttctgttttgtgagctctaaatttatcttccatgtatacttcaaggctcttctccccagtagatttttattcatctgaactataattaggtggcctttttccattctgaaaataattggatcaaatgcattttaaagtccagggtctgaaaggtggaggaatcctttctctttactgtttctaatttaaactccttttcatttactagatttcagtcatgtccagaattcatcttttctaaaagctttaatctagatttagaaatctaaaatcttttatttatttttttttcgttgaagtgccctgattttgttggtggtaaagactccattagtatccacttatacatttccctgactttgcctctgaccaaaccttacagtattcacattgtactgttgcaataataatagctaacatattaatacgctgaatatttgctgtgtgcctaagctaaggatttaattctcttaaaatcctgtgaggtattttattttacagaaaaagaaactgcttaaagaaagtaacttatccaggtcacacaagtaacaattgcagagctggagtttcagatgagggctggcttgcgctgccgctacagaaaagagtgccctagaaatcggtcatcttgcatttcccgattttagtttagccaaatgaaaaattccttttggatttatgagtataatcagacagtatacctgtgaaattaaagtatttgactctttgcttgaaataagtaggttaaaaagatttgggtggccgggcgcagtggctcacgcctgtaatcccagcactttgggaggctgaggcaagtagatcacttgaggtcaggagttcgagaccagcctgaccaatatggggaaacctcgtctctactaaaaatacaaaaattagccgggcgtggtggtgcatgcctgtaataccagctacttggaggctgaggcaggagaatcacttgaagccaggaggcagaggttacagtgagctgagatcacgccactgcactccagcctgggcaacagagcgcgactctgtctaacaacaaaaaagatttgggaaaacactttattaatgaagagttcctgacaaagtgatttttttggggagaatttttataattgcatttgaatattagggtgctcctttttctctcattctaaattcaccagagacttaagcacagagaatttttattacatgcctgttaattaatgtgtataatcagattttaactatatttagtgaatattaagattcaggtacaaatcaagccctttataattaaacatacacattcagaacatttttaaaatattaaaacattaaactgctcttctcacccactccaagtcaaatagcattttttcagtcaggtgtctgggagctcgatgcaagataacaaaatctggtctctgcctcagggaacatgaaatctgtttggggaagccagagcaaaaataaaggttttaatagcaagctctcactaactgcccctggaaatccaccccacatcctccaggaagcctttctctacccccagtgccctcaggagcttctccaaggcaggcccttcccagagcgcagtgtgctccccagctcacagaagatgctccctacacgctgcaggaaagtccagtgcctgcagcacaggcttcagcagcagactcgggttctagtctcagtctgctgattcctagttgtggaacctgagcaggcgaagttactaaacctctctgtgcgtcagcctcccaggctcgttgcttcaggccgcagttaggctgtgtgaacaggagagtggggatgggaactaggtatcttaaagcggggcagagtttggatgagcgggccacccttcgtatagttaggaggaagatgacgggaggcatggaagctgggatagccatcctgagtcagtgctaattctgacacttcagaacatcgagtcagtctgacctgcgagtgagctttcattgaccacttagaaactattagcaccttggacaaactactttctttcagacctggttgcttcatgtctgcgatgggaaaactgatacttaacttgcagatagtggtgaatcaaaagtagtatatgtgaagtactcacacactgcggagcattcagccatcgtcccatcctacttctaccttttacatattgtaatatgaaagctaaaccatttctcgatgtgagtcagttttaatcggctacatagtgagtggcattcgattttaaaaatgtcaacttgggatctgtcaccatgctacttaccatttgtatgtcacactgtttgaatgtcggacctggtttgtttttctccagatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaagcaga

SEQ ID NO: 707 - DNA, 102144 bp, Homo sapiens
ggcctctcgagagtgcaggcgccgtggggcgtcagctggacaaaagccgacccgacttcatttgtctgcctcgaccccgaccccggctggtagacagcactcctgatgcacgggacgagggagcggcacgagcaaaggccctgaaacaggagggagcgcggtgagtgccttgcccagatccctgggccgtcgtgggacttgggccttctgtgcgctgcggggagccgtgcagggctgcggcgtgggatgctggactcgccctgggtgtcgggggaaggagatgggggaggttgtactggggccatacagtcattgtagaacctgttccccccgagggccgtctgtcgggtcccagagccaggaccacggttgggacaatttgagcgcccacctgagcaccgttgtccctgtgcgaatgtgctttggtgaaaactgtgcctccttctctagaggaaattagataccccctacccgcaaatcaggccaagcccaccatgttattcctggtaagctcctagccctggggaggctccgagtgatggcagtgggaggccaggtgagaggtacaaagctggcatccaggtggaactggccacacccaccatggcccagcatccaccaggcaggtcctgtggccttcccttgccgttggtctgattggctggagccaaagggcctggccgagaatgaaccgctcccttgtaaatatacaccatgaggcaggaagccgaagcccatttcaccaggccctctgcttagatcatctccatccagcagccaggccagatcaggttacctccacgttccccatcaatcttgaaatccacactttccaccaaggtctacaggaccccacgtgcccgggcccctgcccatccctcccgcttcttcacccctcccactctgccagccttcttgaacgggccgaactccttcctgactgagcgcctttgcactcgctcttccctctgcctggactgctcatctcatctcctggctttgccgggctggtgcctttctgtcattccaggcacaataatttcagtgtcacctcctgacctttctaaaagagccccatccactgtccaaccaccctgtcgagttttcatctgaccactgtcactatgtacttggaatgttccttttcctttatttcatgtttggttatttactgtccaaggccctgaatgtaaactctgtaagcagggttcagacccctctattttgttcattcctgtatcctttcggcttagattaatgcctggctgggcgcagtggctcacacctatagtcccagcatcttgggaggctgaggtgagaggatcacttgagcccaggagttggagactggcctagacaacatagggagaccccatcttggcaaaaataaattagccagacatggtggtgcatgcctgtagtcccagctactcaggaggctcaggtgggaggatcgcttgagtccagcaggtcaaggctacaggagctgtgatcacaccactccactccagcctgggtaacagagtgagaccctatctcttaaaaaaaaaaaaaaaaaagaaagaaagaaaaagaaaaagaggaggaaaaggataatgcctgtaacgtaggaggtgctcagtcagtgtttgctatattaacctcaactatcattattggcaccgcatcattcagagatgtatttagcgcctactgcatgctaagttgtgcgctaagcactttctacctattatgtcatagaagaggctcagttcgccgcttcctgggataatgacagtacctactcataaggttgggaggatcaagtaggctgaggcctaggaatatgcattttcaccagattcctcccttatcccatcccctctcccactatttaagcaacccatcctgcgctgggcacagtgattcctgcctgtaatcccaacactctgggaggctgaggtgggaggatcgcttgaacccaggagtttgagaccagcctgggcaacatagcgaggccccctctctaccaaaaacaagaaaattagatgggtgtggtggctcacacctgtagtcccagctactcagtccctgcgctgaggcgggaggattgcttgaacccaggagtttgattctgcagtgacctgtgatctcgccactgcattccagcctaggtgacagagcaagactctgtcttaaaaaaaaaaagaagaagaaacctgtcttgttgtttagagtgggatggatttggtccaagtcctggccatcacttacgagctgtgtgaccttgagtaggtggctgcacttgtctgagcctccatttcctcatctggaaaacgggggccagagttttcagctcaagggtggcttggaggctggtcacaggctgtccccacacccacacacagtccttgtcattccaaagagtgcctcctttcccatggtgcccgccccacactgccctggctcacccgctcagtggggaggacacctccactgcacctgggcccccaactcagtctcttgcacacacaaaccctcctctcacttttcattcttgtaaattgacgtcagcgctgctgaatcatgaagctgaggtttgagagagagacagaatctgcaccacccgggaagccacatggcgctggtgcgcgcgcacacacacaaacacacacacacacacacacacacacacagccttttcccccttcagtgatgcctgcacacactttgtcacacgggacgtggggtgcagctcccagggctttaggtcactgtacctatgttagtatggatttaagtgactcataaagggaggaaggggccagctctgggaagtgtgatcagagggggcctttactcttagctgttctgcttcaagttctgcaaggggaatgggtttggatacccaacacttgcgtaaggaaaatacgattttcatacttttttcaaaggaggaaaaaaaactgtaacatattgcaagctacctgctagctgacccctcttttgaggaggacctgttttcccatctgtaaaacggggatgttcacagtccctacatcggaaggctgggtgtgagttcaatgttttacacaggtgatgcgggacctgggagcagttcctgcacagacaatgctacatagaaatatgagcagctgctattattactgcagcggttaggtcctccggttgcctagtggtacccagcctctgaaaaagtcctgagtgggtttgcaaaacctggctccaccccttgttgtggtcctgctttgcctcttggagcccgttttcccatctgtaaaatggggccagcacagccactgagtggtcactaagggtctgtgagtatactagtattacaaccagatccccaagcattgccatcttggatttctgtttctccagacactgcccacagcaggcaacagacaggaaagaacaaggacaggacttaattaatccacagcagagaagaaagggcaggggtgtggcaaaaaaaaaaaaagaaaagaaaagaaaagaaaagaaaagaaaaagcaagatttttggagatagagacaagacatcacctccttccctcccacttcaccttattaagggatgaaattgccaaagctctctgagatcctaaatctcttctggccatccttaaagtcctggagcctacttaatccccaagacaggcctgggctgctctgactctctgaccatcaagttaattttatgttgtactttcaagtctgaaaagtattattaagcattagaacactattatatgtgtctccaaggctgaagagggccactctatcttctaaagatgaagtatgacgtgtccaccaggctgcttaaccctaaatctgaaaatgactcagttcaccatgtgttgagtacaaccctcaagttaccaccatggcccatgtgtcaggctggccaaagacacagaagttgccagaaacccaggtcctggacactttctggtgctgtgggccagccccacaaacgtcctggagccactcttcccttccctggctcctgaaaacatccacctcctctatgatgcgcagaaagttgcccttagaaaggtggaggcccagggaggcaaggggaattgccctagccgccagcagcaccctcccgccaccacagaccacacagtctccttctggctccaagttgtgtgttcaccaaaaagtacacaagacagagcagggtgagaagaaggaagctagacccagccctgtatcccccatctcatctcaactgagtatcccttgatgctggttcagaatgtgccactcctctgtccaaaaactcactaagcccccacccccaccccttcctggaagctgttgtggtcatagaaccaaagaagtttcctctctgttatccatttcaagcagatgtttagtggacagccaaaaaaaggcccaagtgttgtctttgacaggaatggccacaggcagatttactcagttttcccttctgtagaatggaaataagagcccgtgcctcacagggttgtgcctctctttataggattaagtaaatttaagtatgcaaagcacagaattagggctggcacgcacaaagtgctcaaacgcgagctgctgtcttaccggacacacgccaaaactagaccaaccgtttctctccctggagagttgtgggtggaaccgtgagggatgcccagccacagggcaggccccgtacaccacctgcagcccagcaggtcagccttaggaccctctcccctggacctgttcagaaccaagttaaacttttggccaaagcacactcgctagaaaacttatttttttttaaaaaaaaaactttcataataaagtttattacctaaactgactttaaaaaatataaaataggattctgcacagcagaaaaataaagccagagaccctcccccaacccctggtttgtgcaaagatactgggtatatgtaaacatgaagaggtaggaggtgcgagttcaggtcctggctccagatacagttaagctgctacaacaaccagggggacccagagggagcaccaggagggggaggaccccctcaagaggtgagaaggggtctgcggcctcgtctccagccgagggcgggaggcgcctcgcccctacacccatccgctccctccaacccaggccggggagggtacccacatggttccaggcaagtaataacaaaataacacggcatcccagttaatgctgcgtgcacggcgggcgctgccggtcaaatctggaaggggaaggagctcaggtagtcgcggaggacggggttgagggggatgcgagccaggttctcgcggcccacggtggccacgatgcgctggcggcacagctcctgcagcggccgcacgcggcgctggcgcagcggggcccccagcatgcggcgcggcgccgccacgtagtgctccagcagctcgaagaggcagtcgaagctctcgcggctgccatccaggtgaaagcggccggcctgaaagtgcacgcggatgctcgtgggtcccgaggccatcttcacgctaagggcgaaaaagcagttccgctggcggctgtcgcgcaccaggaaggtgcccacgggctcggcgcgcagccgctcgtgcgccccgtgcacgctcaggggcccccagtagaatccgcaggcgtccaggagcgcgctggcgcgcgtgatgcgccggtaatcggcgtgcgaacggaatgtgcggaagtgcgtgtcgccgggggccggggccgggaccgcggggcacggccgcgggcgcgcgggggccgcgggcgaggaggaggaagaggaggaaggttctggccgccgtcggggctctgctgctgtggagactgcattgtcggctgccacctggttgtgtgctaccatcctacagaaggggccagccggaggggtgggccatagcgtccgggggtgcgctgcgggagagacaaagaggtgagctggggcgctgcggggccgggcaggtgtgcgccggccggacaactccggagggcggcgctcccggcggacccggccctagggggcgagcacggagcaccaagtccgcgcggatccgttcagcctcagtggacacagctagaaaatgggctctgtactccgcggagctcttcccggcgggtgggggctcggtggaggcggagtccggcctccgggcagcaccgagaggggggcgtggagagcagccggttctggctccagccgtccggccccggctcgccgccccgcgcccgccgcctgctggccaggctgggatccgcgcctggtctgggcgatttgggctagggccggagaaaggctgtgctgcgggagccccgcgcgcggggggcggcctgggtggggccggcgagggtcaggggcatcgcggccgcgaccccattctgcagcccccgaggctcgcccgactcctggctgccctggactcccctccctcctccctcccgcctcctcgcccagggcccggctcacctggcggcggggcgcgggacgccgcgggcgggacggcggggggctccggggcgctccggggcggctctcgcgcatgctccggggccaggagccgtgcagctgccacggccgcagctcgctctgttcggcgcccgcccctgcgccagtcttttaaaccggctcggaggcggggctggcgacggcgggaggccccgccccctgccggccccgcccccagctccacttttggtttctctttccgcggtggcgtccggcgaggaccgcttcggccctgtttccctctcttctggaccctcccgcggggccctctgcccgcctgttcgcacctgccccagcacccgcctctcgaggggctctggccccgaccctgcgccttccggccacttctcggacccctccttcggacttggcgaccccgattttgccccgctacctcgggttccactttctgccgccaggccctcttgggacgcgccctgacacaccctcctccgccccagctgtctccacacccgccgggggcagagccctgtcctctcctcccctgcagccagatccccctaggaggccacagaaggtgtccccaaccctgagcctgaccccacccgtagaccccctcctagcccctgctccacccgccgtcgacgccctcagtcgcccgccctgctgtcccgaagccccggccggccgcggtctctggtcttggctcgggcttcccgggaagcggcggcctgaccacaggcttcagaggaacccctggcggcgcgggcgcctccaccccggcccagttcctcggaaactgggcggggccgggcaaggtccctggtggcctcgactgccctccctgcgctcccactacccggctgcggaagaaactgaggctggggaggggctgggatttgcaatggcttgcagattgggagctctggacctggatctcgccttccccgtcttcattttggggagaggtgcagctggacgacatcaaattggagcccagtgaaaaaatggtgcattctcagacgtgatgaatccccaaacctggtttcctagccctcctctcccccgaccccttcctcatagatttccccctcctactgctccgtcaggcatctgcccttcaaagactgccttcccaccacacacacggccggggcttgggatggtgggcggtcggtggtcggggctgtaatttgcacacgtgtttgtgatttagtgattccgattgtcgtgcgaggccatggagtaggtgcctggctgctccgtgtatttttgaatgaaggcatgtgaggagccccagcatcacaaggggccacataaaaacctggctaggctgggcacttggttactggcctcacactgggacacactgccctctacagacagctctcagacggcttctctcctggaagccctggtgcccagtcccttcccgcctccctggccccacgatacctctttccccaggcagagcctaggtccttattaacctcctgaacacagggagtggcccagaatcagcccagcttagcaccccatcagtgccctgaatctgcatgtggccagggctggtggtggtcattggtgtagcctcctaggttgtgcgtgtgtgtgcgtgcgcgtgcgtgagggggtgagagaagatgcagaaccttgcctgcaccagaggtcaggtgtgtgatcattcgagagatgtccactgaacatctgctggaggccacactctgtggagggtgatggaatacaaggagacccagttccaaatctgcacctttctattcttgtgaccttgagcatgtaattaacctctctgccatggtttctttatctgtgaaatggggataataatagtacctctagcagggcgcagtagctcatgcctataatcccagcacttggaaggccaagacaggaggattgcttgagcccaggagtttgagaacagcctgggcaacaaagtgagaccccctctctacaaaaaaaaaaaaaaaaaaaaaaaaatagtacaaaaatcagccagtcgtagtggattgcacctgcagtcccagctacttgggaggctgaagcaggaggattgcctgagcccaggaggtcaaggctgcagtgagccacgattgtgtcactgcactccagccggggcaacagactaagaccctgtctcaaaaaaaaataaataaatagtacctccatcccggggttgtatgggaattaaatgagtgattatgggtcaggtgcttaaaacagcccgtagtgtctaataagcagtcggtagatgtttgttgttcatctgagggtgcctgtgggtgtggcagtgtgttggagcccacagacgcatggcttcaacccctgtgtccatttttttaaagagatggagtgtagctctgttgctcaggctggagtgtagtgataggatcgaggaggcactatagcctcgacctcctgggctcaagagattctcccatctcagcctcctgagtagctgagactacaggcacatgccaccacacccggctaattttttaaattttttgtagggatggggtctcactacgttgcccaggctggtctcgaactcctgtcctttagtgaccctcctgccctggcttcccaaagcactgccttatatctatgtttgaagccctagtccagggaccacaggccagggaaggcacagcaagggagcaggaaagcttctaaaggtacactcagcacacgtgggttctcctcactgccaccagtgacagacagctttggtttcattttctgaagtcctgtgttcaaaatgaaaccaaatccagatgccgaaagagaaaaggaaatctgctggttgacaagcatccaccttgtgggctgttctgctggagggctgggcaccaggctcacaggaagccaggcagtgcgaaaccctgaggggctcagagtgctcggtaggatgggaccaggctctgaccccagacctgctgcatgaccttgggcaagtgacctgtcctcttgggacctgatttgccccaactgcaaagtgatctctggacatctcgtacctcacagagcagccagacatgcagagccaagggcaaaatgccaggcatggagtcggtgcttggcacaatgacctcttgtcacagggcggatggaccagccctatatccacagcttactaaaccacagccacagccagatgtgtggaaacattctcctccctatcttggcagatcctcgtaccccaaatgtgaggggcccagccagcatctgggggaagtcaagatcctggtggcttatggcacttagcttttcagtttctctttccggctttggtggcgccttgctgggaaaagtagctcctggccagggtgtgtaatcgtgaaactagcctctgccccggaattcctcagccctgcttttcctctaacccatgtgtcgggaaggttcccatgggagtctgtgcccctgggaaccccgagcagtggggctcacagtgtggattctgctgaccgctggtctgaatttaaatgggtcatttcataagtatgtggcctggggccagcttcttagcttttctgtgcctcagtttccatatttgcaagatgggataataacatatctatttcacttcttcagtatttattcagcagatatttactgagttcttactgtgtgccaggcgcaggggactcagaggtcttcaggcagacctaggggagtcagtgaattcacaccatcagtgcagaccatactgggtgctatgtgggaaagaaacagagagaaaggggtgactgggtgtttgtaaggtgagataaggaagttagggaaagcctcttggaggtggtgacattagcactgacgtctttctaaaagtgggatgaagaccccaggtggcgagaacagccagtgcaaaggccctgtggtgggggtgcttgaagataggaaaggagagttggtatagcgagccagggggtggtgtaggggtgaggcataggggttggcagggtctgatccatcaggcacggccttgctgggctgtggcagggctttggattttgccctgagtgcatggaccagccatccaggcccaagcgacagcataggactgagtgtggaaagaaccttctagctgctgaccttcccagctgctgggctttagccacgatgagctgtagtagtggccttgggacactttcccatggtcctgtgaattggaaattatgtgtttcccttgatcagatgaggagagcacaactcagggaactggtggaacttggtgaaggtgttttggggagccctggggcttggcagaacctggcctgaagtcctctgtcgggagaggttgctttgatgtttggagtagatcctttctgctcccaccacaggaacgattgtgtgtctcagtggcgggtagaggggtgtgagctcagaggacctgagtccaaggagaaggtgtgagaggccagggaacgatggcatgagccagtggctgactccaaagtggcgccagtcctggagacttgatgagactcttctagcaggcacaggtgaagaaaggagaggtgaagtcagctgttacttgaagtagtcagtagtcactggctttcagaaagcagtcaagattgtttcgttaacagctgcaaaataggaggggcaggaaagtagaattctaggaatgctggtggaggggtccagacacacctgcttccagtcccagctcccctccccatcagctgtgtggcttcaggcaagttgactgaatccagtggtccagagaactctcacaaagcccgagcctgggaagcacagtgcctgttcctcagtaaatcccttgggatctttgtcgtggcctattcactccatttttgcacagtattccaacaagcctaacaggtttctacccaccccaccccatcccataagtgacaaattaggtgtcagcagctgacagcaaggaccagtagcggtgacatagggggcaaagaacttgcagaaactatgaaactaggcacaagagctagcacgcagcaggctggggacgttagagtgtggagcaggaagattcctcatgtccatgggccctcactgtggtgatgctgttgagaatgtcgggtatcgcaatgagaggtagaatagggcccagttctctctgaggaggcgtctggtctcagggcacacagagcagcagcagtctcctcccatgccacgatgtgggaagcccagcgtctactggcccaattggcagtgccctgaacaggctcagggaggggtaaccctcaaccgagttgtaaagagtgagcatcacggccgggcgcagtggctcacgcctgtaatcccagcactttgggaggcggaggcaggcagatcacgaggtcaggagatggagaccatcctggctaacacggtgaaacgccgtctctactaaaaatacaaaaaattagccgggcgtggtggtgggcgcctgtagtcccagctacttgggaggctgaggccggagaatggcgtgaacccaggaggcggagcttgcagtgagcagagatggcgccactgcactgcagcctgggcgacagagcaagactccatctcaaaaaaaaaaagagtgagcatcacttgagttcaggagttcaagaccagcctgggcagcatgacaaaaccccatctctacaaaaatatgaaaaaattagttgggcatggtgacacatacctgtggtccctgctacttgggagcctcaggtgggaggatcacttgagctcggaagacagagatggcagtgagctgagatcacaccactgcactccagcccgggtgacttagggagaccctgtctcaaaaaaaaaaaaaaaaaaaaaaaaaaaaaaaagagctctcaccaagggaacggagggagaacatattccgggcagagcatgacaagaatgtgaggccctgggcagagcatgaggccaaaggtaagccggacaccccaaggcagccctagtggcttctaggaggagactcgtctggaggaagggagagggctggactggacctctgcctgccctggagtaatgagtccctctgtgggagagcgttctgggtcaccttgcccaaaccagcaagcccagagcaggggctgatgttatatccacatgcctttactgcctctccagattcaacagagcttcgctgagcacccattagacacattcactgatgctcattccttttttatcctctttttccttcaattttcctccctctaggtaacccaggcaccagcttggtctgttctttgggatcttttttatttttatttttattttttgatactgggtctccctctgtcactcaggctggggtgcagtggcgtgaacacagctcactgcagccttgacacccccaccccacccccactgtgctcaagcaatcctcctgactcagcttcccatgtaggtggcacgcattgccatgcccagctaattttttcatttttagggagacagagtctcactttgtttcctaggctggtctcaaactcctggcttcaagtgatcctcccgcgtgggcctcgcaaagcgctgagattataggcataagccactgctcccaccctgggatctttttctatgcatctacatgcttgtattttgacccataaaaattatgttccttggccaggtgtggtggctcatgcctgtaatcctagcgctttgggaggtcgagctgggaggatcacttgtggtcagttcgaggctgtggtgagctatgattgtgccactgcactccagccgaggtgacagagcaagaccccaattatttaaaaaaaaaaaatagtattcctttgtgtaggacttttccctctatcaatgtcatgtctttctccatcttgcactttccacccaacagatactctggcaatctggctagatcacatatagatcgaccccatgctccttaagaactgcatgatactcctcagcgtatgttcatttagccgtccccggtgggtggacacataggttgtatttttgctcttgcaaacagcgtggcctgcacctccctgtacagcctcttggcacacatgtgataaaccgttcttaccgtttgaatgttcataggtgccacccagtcacctgccagcgtgctgtgcacatttaccttctgggcaaaagcattcaacaatgtttccccatgccttcaccattatcttactttttccatttttgcctatttgatgatttggtaagtggtggcttctcattgttgctttaatgcctgcttcttctttcatttattcaacaaatacttactgcactcctaatatgtgccaggcactgtgctaagtcccggagatgcagcagtgaacagcatggcctcctcggttctctttacaaagtgtgagacgcacctgagactcagagagattaaggaatagtcctggggtcacccagcgagggaatgggagagctgggatttgaagctgggtctgtgtggctgcagggtttgagatgtttttcctttcgaatcatagctcacatgggcatctccaccagggtctgccctctcatctgacccactccattcccgactcctgccccaacccaggaccactgcatttccccttggtgatccctcaggcccacaggagtgacagccctgcagctaaccccaccacaggacaggctgcacctcattgttccccagacctcacctcaccccctagtagcccactgaaattaaatctctgagtatcaagacagctcatcttcagaacccacgtactctcttgctggctggatttattgtctgtctctctccatttcctgaatttgggtctccagcaggcctgtccccaacctgctgccacccaccccaagccgagtaagtgaaagcatgaatctgtggttggattattttttcctgtcatcattgtacgtctgactgtacaagggtggcgtgtattgtgagtgcttgcctacatgtgtgtttcctgtgggaagggtcaggggaggtgactgagagccttcatgcacatgtaggggtgtgtatgtgtacttggggtccacatgtgaatgtgggtctctgtgtctgagtgggtttgaacagctgcttcttcatacgtgtggccaggagttcgaggctgtggtgagctatgattgtatatatgactatccgtgtttgtgccacttttgtgttggttgtgttggtgttgctttcagggaaatgtggagttaaaggtaggtccataagccacacgtgtgacccagtccattggcttataataaaagatttaccttcagtaatcatatcataaaaggacactgcccaggaagtagggaggtcctttggtgagtggggctcaaagtccctgactttatgtctaaccctgtctccacttcctctttcaaaatatgttccccagaagggcctccctaactcttttgcaccgatgtgtcagtgactatcatggcttaatgtggccttacatttgggaaccagtaagttttgggcaaaacatgaatctcttatctcagacctgcctgccaggagtccttgaccaagttgtttcacctctgagtctcagcttcttcatctgtacagtgggaccaataatgtctcttgttgaggagcgtggattccgtggaaatatttatgtcaaaacatctggcatctagtaggtgctcgataaatggaattcccgagtatgcttgggtgcttccccataccctctcctaatagaaacaacctggaacatttccctgctgtgagaggaggataaagggacccaaggaaaggagactgatggtgacattgagtggcattgatcgggtggaccaggccctctcttggatgcttgcaggtgcattatctcaatgaacctccactgggacccctccaggcaggcaccattagcctcccattttacagaaaagaccaggatgcagacaggggacatgacttgctcaaggccacacagctgagatctgaaagaggaccttccatgtcatgccactgcctgggatgggctcagcaaagcttggagtcctgcaaggccttccccaagacacctgggtccatttcccttccctgcagacagcccatcaccactcatttctactcctgccccacctcccttcacctgttcaccctgttccttcagcccaaatgtcaaatgcagcacaaaagaaaacaaagtgaccctgtgtctggcgctatgctgggcagcttatcacacaccaggctgctgggtaccccgccccccagtatgtcagaacgatgagcccattagacagagggggagagtgaggctcagagtggtctagtcccagccgccgcagctaggatagtgagaactagggcaaacttgagtctgaccctaaaaccaaggcttgtgggtatgaaggtcagaagccaatttacccaagaccctgaccattccccagtccttttgtctggcagccggcattccttcacgaaaatctgcctggtactttttatgccatgttaacagcagaggtttactgagtgccaagcactgagcccagacaccatgtcacatgcatgacacactgacctctcccaacctcccagcaagggtgcccattttgcaaatgagagcaggtttcctacttggaagcagggttctgtctggttcacccttatcttccctccttggccttagcccaaagcccacacaagtgggtgctcagtaaatgtttgcgaaagaggaatgaggaaggcaggactctgggcattatcttgggaggaacctccagcccacccgttgtggaaaatcaccccgctagaccgggctgccattctgccaattgctgtaccctgtcccatcccctgcagtccagtctccacacagcagccagcaccactttgaaaacacacaccaggtggccgggcgcagtagctcacgcctgtaatcccagcactttgggaggccaaggcaggcggatcacaaggtcaggagatcgagaccatcctggctaacacggtgaaaccctgtctctactaaaaatacaaaaaagttagctgggcgtggcggtgtgcacctgtagtcccagctactcgggaggctgaggcaggagaatggtgtgaagctgggaggcggagcttgcagtgagacgagatggcgccactgcactccagcctgggcgacagagcaagactccatctcagaaaaaaaaaaagaaaaaagaaaacacacaccaggcttggtgcagtggctcacgcctgtaatcctaacactctgggaggccgaggtgggaggattgcttgcgctcaggagtttttaagaccagcctgggcaacatagtgagaccccatctctacaaaaagtaaaaaaataagccgggcacagtggctcacgcctgtaattccagcactttgggaggccaaggcgggtggatcacttgaggtcaggagtttgagaccagcctgaccaacatggtgaaacctcgtctctactaaaaaaatacaaaaattggggtgtggtgggaaaggggagggagagcattaggacaaatacctaatgcattcagggcgtaaaacctagatgacgggttgttaggtgcagcaaaccaccatggcacatatatacctgtgtaacaaacctgcatgttcagcacatgtatcccagaacttaaagtaaaatgaaataaaaataaaaagcagtgacaaaacttgcctgcacagtgggggaaaaaaattacaaaaattagccaggtgtggcgggcacctgtaatcccggctacttgggaggctgaggcaggagaattggttgaacccaggaggcagaggttgcagtgagctgagatggcgccactgccctccagcctgggcgacagagcgagaagtcaaaaatagctaagcatggtgatgcatgtcatgctactcgggaacctgaggcgggaggatggcttgagcctgggagatcaaggctacagtgagccatgattgcatcactaaacgccagcctgggtgacagagtgagatggtctcagagaaaaaagcacacaccagactctatcaactcacccagttgagaccctcccctgacttctcacaccaagaataatgtccaagctccttcctgcggagattggtacaaccccggcatggtctggcccccacctggtgcccccagctcatgtcccagcaccttcagattctatgccagctcctctggaacacaggttctaacccaggctcattccctcacggggacatgacatcaccctgctcccttgatacagctcattctgacaagtcttgtgtgtttggactgtaagttccatgagggcagggccttgtgtgttctctagttctgttcccagagcccagcacagtccctgaacagactttggtcccttagtaaaagtttgttgaaatggctgctttgaggaacgttgaggttggtactatgttacagaatcaacaagtgagactcagaggttggtcacagtccagggtcacacagcgagtacgaaagatgagccaggattcaaactcaggatgctctggattgcaaaaggcacattctgaacccctcttcctgtctcctgtcgtgttcttgggctacatacatgtggatcacgtgaataggttgtggacatgtgtgcatcttgtgtgtccacatgtgtacacacccatgtgggagcatacagggcaaaagattgttatccaagcagagtggactctgcaggcttcttggcatcctacccccattcatttctgcccctgtgcaggcccccaaaacacataacacctttattagtgaaatcaaaatgactatgactactcagggatagtcttccaggtacaagctttaattagtgttgcgtagaaatcaccatagtaacatgttcctgcaagaagattgacttcatcctagcattttctcctttgggtgaaacacgcaggaacaagccaaggagtgcggtctcattagttggatttccatcctaagggataagagtgggaaaggaacctttaatagctgagcacttcatgaagtcagtgacctccttgacctcctgtaaggtcttacaactactcatttgtgattgaatatgggacatagatagagtttagactaccgtcagtgtccttttgacctatgtgaatccaggtatccatccatttatcccttccatttgtcatccacccattcattagttcactcattccattcatttattcaacatttctttcccattctatcccattagtctagatatctattcttctctctgtttattcaattactctatattactctattaagataatatttaaccaatcaaaccaacccatcaaaacttctacaactatttaactctatttctaaccaattcatccaccaaccacaatcttcaaactgatcatctacctaaccaaccaaataactagccagccagtgcattcatccatttatccatccatccagctaatcgtatccaaacttcctatcattcagccaatgcattcttccaactatcctttctataacctatttattgtttacccacccagtcatccacccaacctctcaactccattcatgctttcatctagcttatctgctatctgtccatctttccatcctcctaatcaacccatccaatttcaaagagactttccgtcaatgtatcatacattcagctagccaactgccattgtttctcttctccctcttccttcttgcctgtggttcctttgtgacctggctgcagccttcctctcactgcccccaaggtctgctctccatcatctgtgggctcggtggcccttccccacctccttaaagggtacctgagctccgcgtcttggttttgtacacctgctggatcctcttggccatttttttctttttcagcttgccttccaagttctttctgttcttggggcagcggcagtgcaggatggtgggccgcatgggagagtggtgggagttcatagtctttttgtggcgctttggtggtggactagtgttgggactctggctctggtggccggatgagctgtgggctccagttgggttgcggtggctggccgggctctggctggagctctggctccggctgccacgatggctctgtctgcaactctggctgaaggtttggcaatggcgggtgcaggtgcggctttggggctgagagttgctatggagctgagtgtgggtgataggaaggctgtgagtctgggtgtccataggaggccacgtttggaggggcagggcctcctcctcatcctctcccagcaggcctagctttacagaggccctggcagcccacctggttatatagttggggctgattatgatggcccaggccacaggggtgtgagagatgtggctcagccaagacaaagccccctaccccttaccctcacccccaggctggggcagctctcaggggtaccctggggatagtcccagctactggttcagggtaggagcccttgggtcagattaagctgagtctgcatcccagatctgctttttccacatggtcagccctgggaattcgcctgaacaagtcccagtttccccatctctgcagaatagggataataattgtactgacctcattcggacattagaagaattattaataaaggagagaatttatatcaagcagttagctcaggcccagcccacaataagagctcagtaaacatcactgaccagcatcatcaggtgtttttcttaacgccctgggcaacttgggtaccaggagtgcagccctgaccctggtgatggcagctgaatggtgggcagttgttaagacagatgattagtgcccagatgatggggaggtgatgaattggtcagatggcttggtggatggatgaaagatgagtaaccacatggaccaaggggtggtcctggggctcgcttggcaagcctacctccccagccagatctaaagtcgggaaattcagagccgggttcaaatcccagtttgcactgatgtccagtcttgggtaggccattgtggtttctgaggcttaattgccgtatgtgacaaaggggtgtctttccttctttcctggtattctcgtgagcctgagatgcctgtcaagctacaggaggcccttggaaacccgtctctctccttcagtttctgcctcttgattctcctccccttcctgctaacgaagcctcgccataccgtttgaatcacgccgtccctgctcagataccccagtacctctagaagaaagcccagacttatgtttgaacactaagccatttgatcttctagtctttgggtttccatccagagccctccacccctccctgtcttggccgatgcctttgggcttagcccttggccctgtactttcccacttctctctgcatggaacttcctctgtctctgtctgtcctccccgagcaggcctccggcccaagccaacctctcactctgcccatgtgcaactttgcctcttgctatgaggatttgcaatcgtctgcttttatggaagtttttttctttttctttttcttttgagaaagggttttgctgtgttgcctaggctagagtgcagtggcacaattacagctcactgcagcctccacctcctggactcaaacgatcctcccacctcagcctcccaagtagctgtgactacaggtgcatgccaccacacctgtctaatttttttatttttatttttgtagagatggggtctcactttgttgcttaggtgggtcttgaactcatgagctcaaggttttctcctgctttggcctcccaaagtgctggcactacaggcatgagccaatatgcccagcctttgcagtttatttcttaataaacatttcaaatttcttacagtgagaactgctttcatttactgaatgctttctatgtggctgggctctggaccttaccctctccaggcagctttgccctcaaacctcacagtgaccctttgtagtggaatgaatggcaacccccaaaaatctatgtccacgttataactcctagaacttgtcaatgtgatatttggaaaaggggtctttgcagatgtaattaagctaagaatcttgagataagcatgttggcttagctggtgggccctaaatccaatgataaatgtctttatgagagacagaagaggtgtcacccagggagaagaggaaaccatgggaagatggagacgagcttggagttgtatgagctagaggaggcaaggaaggattctctgctaaggcctccggagggagatcagcccagctggcacctcgacttcagacttctggcctccagaactgcagagaatacatttctgttgttttagccaccaagtttgtggtcatttggtatggcagccccaagaaacttatgcaccccatgaggcagatactatgattacatttagcaaagagggaacaggctcagagaggtggagtaaccagcccagagtcccttagccgatcacggcagagccagtcatattcaggtctggcctcctctcgaggtcactaagggattctcggcgattagagggacagctgcagcagggttctcagggccctgccttgggtggcctcagcaggtccggttgtggggtatatgctagaccaagccgtgaagactctctgggtctctggaccccccttcccatggtctcctgctcctccactgccaacgccccactttcccatcctgaagcacatagcctggaatggagatcgtggcctgccatcaaccagcctctcctccacacacctttccagtcctcccagggagggctgacctctcccagcagcgggtgtgcggcacgtcacgtacctgcccccgcacccatgacagtgaactctctcccaggacagcggggactatgttttattaccagggctccttgtgactagcaccatgtggggcatacaacagggactcagctcatgtttcctgggcaaatgaatgggtgggtggacctttgggccttggacaaaaggacaaggctgaccaaccgagtcatttgtgggtctgggagtagtgggataacagggcctcccttgccctaggccattgccgggcagagccgtggcctccccacagggtagcccaaggctccttcctacgtcaaacatggcccccagagaaaccgaggcttccctgaaaattccccatcccccagccccactgccacggtaccaactaggatcccctcgggaacaggggatcagctgatccagagaattagctcaaggtggctggtgcttggaggactgtgagggaatgtggtggagatcgcatttgtggcttctttgggatggaaggagtgagggaggagccggcagtagggtgggcagcagacgcactccgaagctccttgcggaaggcgcaccgagcccagagcgagaggatggggcctaggttctgtgtctgtacccagtcgcctccctgggcctcttttgcctactgctctcatggggtactgtctccgcccccagggctagaccccttgaagaaggcgggagtgagcttccaggtaggggtgcaggtggttgccagcagcatagactggcagtggaagagtctgcagccaagaaggacctagaggaaccaccatgaccccagcaacaatccctgtcctagctcagcactgactggtgccaggcctggtcccacccatcacttgagctaatttttctgatcatctgacccatgagtagctattagcttcccctaaacgctgggaggggcagcctgaggctcaaagacacgcagtgacttgctcaagggcacgcagctaccagaaaagaagtttgaacccaggtctgctgaactcccaagccagtgttcttaaaagacggtccatagttggggcagcacagtggggactgcgatgaaggcagttaccctgtcccgctggatgctctcggctggggtgtgctgggactcgcagaggaatttcccgtcccagagatgggaagatttggcggagatgatttccccctctcaaagcccctcaacctctggctggggcttgggaacaaggtcaccgagccttgctgttcagccttccttggcagctggcctccctccgtgtgcacccacacacacacgccttcacacacgtgcacacgtggggccagaagggatagggtgaggggaaccagagacagggaggattcctcagagactttttattgactcttctctgaacactgtcgccggagcagcagtgggcgtcccttcctgggccttcgttgcgggtcgggagggtgtccgcttgggctcggggctctgctgggcctcggcgttgtccttgtggccctcctcctgccgctcaggctccagcagcagcagcttgccctgcaccggcagctcttctttctcctcctcttccccctcctcctcctcttcctcctcttcctcgcccgctgatgacaaggagaagttatcctgactcacacaggccatgagctttttcatggaggattcgtggccccggccatggcccgtgctgtggcctgggctgtggcctgggctctggcctgtgttgagcttggcacagcgggaacccatggtctacgttgcctgtctctctgggcaaggaggtgaggcggtgggtgaaggggctgcgagtgggggcaggatgctgacatcacaaagggagcccatccccacttgggaacctgggtctgagccaacagttaactcacacctcagccactggcagctcccagcccccacaggggaggtctgcaaggctgagcactggggccagttcggatgccacaccatagtcctcatttgccctggagaaagtttcccttgtagctgggatgggagttagggattgaatttctagaagcaggaggggcacacacagactcctccccacatcccagaaatcgccagccagagagagctgtctctgttgagtttcttgactgttaacccttggaaataaatcatcaagctgtgtgcttaaaatgtatgcactctgtaagctcataaaactcaggaacccttggaagtcttccttcgggggcctgaaagtgtgaaatcttcttgaaaggcaatggctcctaagcattgtttgtttgtccaaggcatgggaacaggccagaaaccaagctgggatgaacaaggggttgctttgtccctgactgatgcaagatggacaccaccaaccagaggccactctacccaggtcagggtggagtgacatcctcttaagtgttttggggccacagagaagacatcatggagctgccccttggcaaggttccacatctgtgcagcacaatttcagcatggggggagggggtttaggactttgtcttttatacattgaaatgagtcgtttgtacactgcaatggtattttttaaatataaattttttgaggccaggcgtggtggctcacacctgtaatcccagcactttgggaggcgaggcaggcagatcatctgaggtcagaagttcgagaccagcctggccaacatcgtgaaaccatgtctttactaaaaataccaaaaaaaaaaaaaaaaaaaaatttgtttagctccttcagctactcaggaggttagggaggagaatcagttgaacataggaggtgcaggttgcagtgagccaagatcgcaccactgcacaccgccccagtgacaagagcgaaactccgtctgtttttttttttgttgttgttgttttgttttcagaaactcgttgcttcctaaagattggtcatttctgagcaccagaaatccatttgccaacatatggattggatcttgccagtcttatccccccagtcctcagtggctatggttggctaaggttggcactctccgaagtgcccccttcctgatcctggaatctatgatgtaaggattgtgagatggggaggttatcttgggttgtccagaaagtccctcagtgcaatcacaagggtccttgatttcagacaggagggaggagtgatgcagccacaggccgaggagagcaggcaacaaggatcggattctgcctgggtctccagaggcttcagccagcacaggcctcacacagcgcagcccattactctgcattcatctactccttgccttttgccgtctctgtgctgaccaagttgttgctggagcatgccagacctgtttcccacctcgaagctgtggcctgcactgagcagtgcccccacctctgcccccaccgtttacacttccaaccacccaacactcaagatgggttgtgtttttaaactgtggcacacagtaggcatttaaatatggccacaaggtgccttggcatctttgtgacttaattaggactcgatctgttctaaccattttctcctttcatgaggtaggatcaggttcttcactggagggggatccagacagactaatgtggcctttgacaccatggaaggatgcacaatagacaggacagcatcatagggtggcctcccaggcacagtaaccctctcctaggtgtcctgagagcatcagaactcccgccctacctgcctctgaggaagggctgcagagaagcctctacccgccctgggcgtgagggaagccaggtttgtgtgattcgtgcaaagaaaacccgacaggccagcgagtgtcttgtcaagctttattgggcaggtgacttttgctcgtttcactcagatcttgtgggcttctcggcggcaactcagggcttgagcatttgatgtaggggagttgctatggcctcactcggtgtttcttgggcaggtgactttctcttaacttccagctgggggcttgagcatttgatgtaggggaattgctatggcctcacttggtgtttcgggcgactttttcttaatttccagctgggggtgaggggcccaggaagcttagtgccttctgcatgttctcttcctggttctgcagccttttgggaaagaaagttctggttgagggggtcacctagggactctgggtggggacgggggttagggggctggagcttttgtcaggtggggtgggtccccgcctccctcctgtgcctggggtggtcagggacatgcagggcaaggcgggggcgcaggcagacctctgcgatgcctcctccggtgcctgcaggagcgtcttttgcgccttctgcaggagcgatgctgccgcctgtggatccggtgcagcctccttcgagagcagtgtctgcgcctatagtgagactggccatgggtcctctcgtagacctcgacgtgctccgggctcagcccttgctcctcttggccgtggtgtccttgctcttgcccatgcaactgctgcctgtacacctcgtgcgagcgttcgctcaggctcctcacgcggtatcggaccatggtgttgggagatctggtggctcctgggctgaggctgcagtgggccctggagtaggggaggagggcggaggcctgcccacctgcccttggtgttactgttggtctggtctgcaaggctccccgggagcttgtatataaagggggcgcccactatgactctgcggccccgcccagtccccaccctgcccagcctcctctgtgagggcagcacagggccaggggtcacaactagcagggccctggcacccaagctgcagggctggaagggcgagagacccccttgccttgcctgtaaagcatgtcctctgtctcttgcagtaggtgaaccatacagatggcaggtgttttattgcctaatccaagccctcatctccccaagccggtgggtgcgcacattgtcatttggaagcttccttgccaactcactgctgtgccacagccaccatgtggaagggacttccgtgcttggatctctgtgcacacagcttactgttaagatggcaacagcagcaaacagttccctaatagctcctatgtgccaagcattgattcatttatttcccatacattcactcattctctctctctctctctctctctctctctctcctctttttgttttgaggcactgtctgtcgcccaggctggagtgcagttgtgcaatcatggatcatagcagcctctacccctccagctcagatgatcctgccacctcagcctcccgagtagctgggactataggcgtgtgctgccactcccagctaattttttgtattttttgtggagatagatagggtttcaccatgttgccctggctggtctcacactcctggcctcagtgagcctcccatgtcggcctcccagagtgctgggattacaggtgtgagccaccacccttgcattcctcactcttacaatcctcattttctgtggggcaaacaggcatgaagaagttgagttgctcaaggccactctgctgagaaggccaggccgggccagcattcagacggagacagcctggttttagtcatacccttggctctccacctcctccctagcccagggaatgctcccctctccgcctccaaaatattcatcttctcccctcccgctcggccttgccggggcttctcattgaactttgatgatcccattaaagtccgggatcagaatcacagaaactgcaaaaccagtttccctttcatggagggcagggagaatgtgggaatgtggcagatacacaaatttaaggacttgaagatgcagagatcatcccagatgatctgggttggcccagtgcagtcacgagggtccttagaagagagaatagggaggcaggagggtcacaggaagagaaactgggagacaccacactgctggctttgaagatggagggagaggctataagccaagggatgcaggcggcctctagaagctgggatggacaaggaaatgggttatcctcccctcgtgcatccaggaggaacacagccctgctgaccccttgattttagccccatgagacttctttcagaattctgacctgcagacctgtaagataatgcatttatgttgtttaaagctacaaaatttgtgatgatctgtcacagtggcaataagaaacaaattcaggaggcttaatcttcagatccttacaggaggtgatgggtgatattgccatgcccttggtgtttctatgctgcctctctttagggataagaaggtcctttatgatggccctcaagctcttcgagggcgcgtgttaaaaatatgaatgctgaggccttaccctacgtcccgctaagtcaaatctccatggccaaagcttgcagatgaaaataagaaggggcggggcagggctcggtggctcacacctgtaatcgtagcactttgggaggctgaggcgggtggatcacctgaggtcagaagttcaagaccagcctagtcaacatggtgaaaccctgtctctactaaatatacaaaaattagccgggagtggtggcgggcgcctgtaatcccagctactcaggaggctgaggcaggagaattgcttgaacccaggaggcagaggttgcagtgagctgagatggcaccattgcgctccagcctcggcaacaagggcgaaacttcgtctaaaaaaataaaataaaataaaataaacataggaaggggctgggtgtggtggctcacacctgtaatcccagcactttgagaggccgaggtgggaagatcacttgagcccaggagtttgagaccaccctgggcaacatagtgagggctctgtctacaaaaaataaaaaaaatagcctgggtccatggtggcatgtgcctgtagttcctgctactcaggaggctgagatgggaggattgcttgagcacagatcaaggctgcagtgagccacgttcacaccactgcactccagcctgggtgacagagcaagacccttatctcaaaaaaaaaaaaaaaaaaggcacacccaggggtctgcctgtccagccaagctgctatcatgatccgagtgtgttatggggagtcattgctaaagtgatcagggtcatggtagtgccagggctagcactgaactctcatgtgctcacttgaaagaacatggttgttgatacccaccgtaggtgagtgcagtggctcatgcctgtaatcacagcactctgggaggccaaggcaggagaatcgcttgagcccaggagtttgagaccagcctgggcaacatagtgagacctcgtctctacaaaaaaattagaaaaattagccaggcaaggtggtgcatgtctgtggtcccagctactcaggagtccaggaggctgaggtaaggaaatcacttgagctcaggagattgaggctgcagtgaactgtgtttgcgctactgcactctattctagcctgggtgacagaaagagaccttgtctcaaaaaaaaaaaaaaaaggaagtgatgtatgcagaataccaggcacacagttggtgtcccataaacagaagtcatactgtgacatttctgaggtgcttggtgggccctgtcacttcagggaactgggtctcagagcctctggtctctgccaaaatgctctgggtttgctctaccatcaggaaatgactgtgacccagggcctgtgtcaaggaatcggagaggtgggctttcttaggctgtgggtgagccaaggagaccagtgcccagcaggacttcttatgtccttccccagatctcactggggtcttaaactcttgccttagaaattttagtataggtggtatatcaagcagcttgagtgtggacttagatccgaccagatggacaagttaacctttgtttcttcggtggacataacgttgtgaaaccgtgccccaaagagtaaagaaaccggtggttaacaaaaatgtttgagtttacaggatggcagataagagacttccttaatggtgcttgattaaatgtgaaaagttcagctccactgctacctggacaagttatctctgtacccaaatggggatgaaaacttctggcacagagtgaggaataagcagttttgaatttaattttcctgatggtgactggcttaatctatttaagttataacctaagagttcctttgttgaagagtggaaatttcagctttgggctgaaataaacccgggtgggcagctaggggacaggtcagatgggatgagctggttcaatcttgagctccagctggtaaatgtttaactggctttggggttcctgggatggagggaacccagatttgtagcatttgctgatttctgtaaatactccatggtccatttcaagctgccaagatgaggtcaccaagcagagtggggaaatgtacacagtgggtcctcaaactcgagagacctggatagagcaccccactgggtagggatctgttaagagggtttaggaggcaggttctggttgtgacttggggagactggttcttgttgtatcttagggaggcaggtttgggttgtgacttgttggtactactaagagtttggaacaatggccaggtgcagtggctcatgcctgtaatcccagcactttgggaggccgaggcaggtgaatcatgaggtcaggagatcgagaccatcctggctaacacagtgaaaccccgtctctactaaaaatacaaaaaattagccaggtgtggtggcgggcacctgtagtcccagctactcgggaggctgaggcaggagaatggagtgaacctgggaggcggagcttgcagtgagccaagatcgcgccactgcactccatcctgggcgacggagcgagactctgtctcaaaaaaaaaaaaaagtttggaacaaaacccagcgtgacaactgtctttcatgtcccccccaccgacatctttctcccgttgcatgcccaggccctctccccctctgctcatccccgagccctcctccccactgagcctcccctctcaagaacaaggagagaagagtgggatgacttttcaacatttattgacaggcggcattgttccttagcaggctcctgatttttattggatggtggcattttcaagatgtggcaagaggatcttgaagtctggtaacattctcaggcaggagtttggtggatgtgctattttgtgcaattagtgtcttctacatcgcggtctgtacctggggcggcagcaccctggtgagaccaagaaaagtggtgagaggaaggctgggccctgagagctcccagcctcagccccagcccaccctcagctgggcccacttactcatggctctcctccgtgtctggcagctccgcctccttcgtctgcgacttctttgtctctggcggtaatatctgctccggctctggctgcgacagcatctgtacctggccatggtgcaggatgggcttggcctgaatgctcagagcagggcaccaccttggctgagccagccaacctgtgagcaggtggaactctgtgggctgtgagtcaggggccagctctgcggcctgttatagatgccagggggccgttggtcattgtgagggcaaaggggctgggacctcacaaaccatggccaggtggcctgcatcatgtccatatatgggcatttgagaggcgggcaggcccccgagtgtaggggctgcctatgtcacagctggggcgatacaagatgactcctccgtgggagcaatcatctagttattcaattaacaaaatattactgttaatattttggcctgttccatgccggattttggcctaggccctggtatatagtgataaacaagacagacatgcccttgttaagaagtattattattattattttatttttttaattacttatgtattttgtttatttttttgagacagagtctcattctgtcacccaggctggagtgcagtagcacaatcttggctcactgcaacctctgcctcctgggttcaagcaaacctctggccgcagcctcccgagtagttgggactacagacatgcaccaccacactcaactaatttttgtatttttagtagagatggggtttcgccatgttggccaggcttggtctcgaactcctgacctcaagtgatctgcccgtctcagcctcccaaagtgctggaattacaggcatgagccaccgtgcctggccattattattatttgtagagacgggctttccctatgttgcccaggctggtctcaaactcctgaccttgagcaaatctcctgcctctgcctcccaaagcactgggattacagatatgagccaccacaccctgcccctaatagactttataatctaactacagaaagcatgaatgaaacagccctgaagaataattgtaatagtgacaaatgctgataatggaaacctcgggtttctgaggatatgtgctgggagaacttgacctcaggtgaggctctagggagagccccaaaggggtgctggcgaagtgaaccctaaatggatgctatagtaagaggagggaggagcacctgggaagaaagagctgctcctgcaactgttctgaggcggtgcaggatgtgcagttctgtttctatgcagggccaggcagcaggggatccgtggagacagaaagtgatcggggtgaccagggcgggtggagcagggagcagctgtgccatgggtggggggcttccttgtgggctgatgctttggaacttgatagaggcggtggttacacaacattgtaactgtactaaatgccactgaattacacactttatttatttatttaattttgaatgaacgaatgacagggtgtcgctctgtcgctcaggctggagtgcagcggcgcaatcttggctcactgcaaactccgcctcctgcttcaagcgattctcctgcctcagcctcccaagtagctgggattacagacgcccgccaccacacctggccaatttttgtatttttagtagagatggggtttcaccttgttggtcaggctggtctcgaactcctgacctcaagtgatctgcccgcctcagcctcccaaagtgctgggattacaggcatgagccaccacacctggccttgaattacacactttaaaatgatgtattttatgttacctgactttcagctcaattgcaaacacgaaaagctgtgaggccaaaaggtgctaacaggtgtgagggattggagcagagcatggtgcagggcactggtcatggtgtggtcttttccacagccccatggattttaagggtaaagaggggagcagttagaattggtttggctacttaaacagaaaaccgaaatgagtgagttgggtggaagttttatgtttttcttaaggagtcagaggtgatttcgggggtcattagattgtccctgtttgggggatacacatgctggaggatttaggggtgatgacatatgtttgccaactactctcaaggatttacccatagagaaagagggagaagaagggagagagaggagacagagatgggggcggggagctgaacagatgtgacagaacgttcacaactggccatgccaggcgcggtggctcacacctgtaatccagctctttggaaagatcggctgagcccaggagttcgagaccagcctcggcaacatagagcccatctctacaaaaataaaaaaaaaataaaaaagatttttttgaaaaaacaattggccaatctgtgtaaaggggaggtgtttgtcaggggttcttgcaagttttctgaaattttgaaattatttcaaaatagattattaaatttttttaaaaagaacaaaagaaaacccagggaggtcagccagggctggtgtgaggctccatccttttcaagggtccaggcttttgtcttttagctctgccttcagcaagtgctttccatccacaaagttgcctcatagtccaagatcagggctgccagggatggttgtgcagtttgtgtcctgctccaagctccctgccaaagggattgagtagggactgaaatccagcctgtggtctacttgccactccaggccctgtactcacagggaatgtttcagcccatcggagctgtctttttcctaatttgcctgctcacagcagaagtctcttccaaatttgaacaaaggcacactaagggctaaacttggccctgctggagtcccacccatatccaccgtgcaagcaggaaggagaaagaggaggggtggcaaagggagttcttgtctcttttttagagacaaggtctagctcttttgcccaggccggagtgcagtggcgcaatcatagctcacagcagcctcaatggaatcctcatggtataaagagctttcccagatgccctgtccagcaacttccccttctgatcactggcctccctgcaaaagcacactgccccctggggtaaagcagggctcctagaaaggagaaggggctgatggataccaggtagacagttagtactctcttccccgaaggggatggagcccacccctgaccccagcaagatggggaaaccatgaatttgaagctaaagtctattgtcactaagagggatacagtagcacatagtaggttagcagtaacttttcattaattgattcagatctagattgaggtaaaattgttacccccaatcctctaacacttacttttttttgtttggttggtttttttgtttgcttgtttgttttttagatggagttttgctattgttgcccaggctggagtgcaatgacaccatcttggctcactgcaacctctgcctcccaggttcaagcgattctcctgcctcagcctcctgagtagctgggattataggcatatgtcaccacgcgtggctaatttttgtatttttagtagagacggggtttcaccattttggccaggctggtctcaaactcttgacctcaagtgatccacccacctcagcctaccaaagtgctaggattacaggcgtgagccaccacacccagtccagggtgactatcaatcttcgacatctcatcaggttcctctgagaccatgtgagttaccctgtctctactaaaaagacaaaaattagctgggatggtggctcttgcctgtaatcccatctactcaggaggctgaggcaggagaatcacttgctggggttacaggcatgagccactttgcccagccacagagattagttctgagttctgggaagaggatgccctggagctaggcggtggggacatttggcctcgtctgggatcttgaagccttccgtggtcatctgaaattttgggtttgtcacagcagctggctgttactctaatacagtacttgccactcactgatactgtgtttataatttgtctccccaagtgggatggaagttcagtgagactttcttttgttcagtgtgacaatcctaatactgagaataacctgaactaaaaggaactgaaatatttgttgaatgaataagtgaatggcaaatggatgctttgtatgataggattcttttcttggctttttccaaatctaaaattgtgttatcatgatttttaaaacgacgtttagcttctccctgccagccaccccacttctgttgggtattgtccttggcactggcgattagaaatcaccaagactcctgccagttaaacacacgctgagtctcataaggggacatccaatactgttccctgaggtcctaattgggcagccacatggcttgtccctctgccgacccccacgtctgtgttgtcacagtggcctctcacccccgccctgttcaaggaaagacatcaccaaaggaggaaggcaggggtaggggatatgtgccctgctgtgccactgggaggggtgaatgcaggcagttcattcccagaataatgaaaggataatttagcagtaagatgacagtgttttaaatgtgccatcatagccacaattccatagtcagggatttatcccaaagaaattctcctgcgtgttcatacaggtgtgagatggagggtgttcattaaagcattgtttgtgggggaaaattagaaatcgcttaatgttcatcttaaggaaatggtaaatcagttgtttcacccatgttgtggaatagctcacaagcattcagaaccctggagagtgatgtgatgtggactgatatggaaggaggtctatgctatatcgaaactgagtgagttgccaaaatgtagggtgtcatcccatgtttgtaaaaagattagaaattaacactcacatacacagaggaaaaagtctagaatgtgatacattgacctgacagtgggaggtggaataatggaaggcttcactttctactttattcatttctgtattttggggggatttttcactgtaagggtatgttgaatgagttatttccatgaacagaaagaaaacaatgtctgtaatcctagcactttaggaggccaaggtgggtgggtcgcttgagcccaggagttcaagaccagctcgggcaacatggtgaaattccctctctacaaattatacaaaaattagctggatatggtgatatgcacctgtagttccagctatgctggtgggaggaccacctgagcccaaggaggctgaggctgcagtgagtcgtcatcccgtcactgcattccagcctgggcaacagagtaagaccctgtctcaagaaaagaaaagaggccaggcgtggtggctcacacctgtaatcccagcgctttgggaggccgaggcaggcagatcacgagatcaggagatcgagaccacggttaaaccccgtctctactaaaaatacaaaaaattagccaggtgcggtggcgggcgcctgtagtcccagctactcgggaggctgaggcaggagaatggcgtgaacccgggaggcggagcttgcagtgagccgagatcgcaccactgcactccagcctgggcgacagagcgagactctgtctcaaaagggaaaaaaaaaaaagttgcagagttagtaaggggatttccatatacctctcacccagtctcccagtctcccccattgttaacattttacatcactggggcacatttgtcacaattaaaacaccaactttggcacattagtacttaccaagcaagctctagattttatttgaatttcaccagcttttctactaatgctcattttctgttccaagatccagttcagggtgccatacccactttctgctactattaacatcttatgtgaggatagtgcatttcacaattctttaaccagtagtggtgcattattattaaccaaagtctatactttcctcagattgctttagtttttcctcaatgttttcctgttccaggatcccgtctccctttaggctcctctgggctgtgacattcctgtctttgatcatgttgacagttgttttgttttgttttgtttgagatggagttttgttcttgttgcccaggctggagtgcagtggcacaatcttggctcactgcaacctccgcctcccaggttcaagcgattctcctacgtcagcctccccagtagctgggattacaggcatgcgccaccacgcccagctaattttgtatttttagtagagttggggtttctccatgttggccaggctggtttcgaactcctgacctcaggtgatccactcgcctcggcctcccaaagttctgggattacaggcatgagccactgcacccagccggtcacactgacaattttaaggagtacttgtcagatattttgtgaatattccctcttcctctatttttggaatagtttgattgagtaggattggtagtttttttttagatgtttggtagaattcagcagtaaagccaccaggttctgggcttttctttcctgggagactttttattaaggcttcgatctcattacttgttattggtctgttcacattttggatttcttcatgattcaattttagtaggttgtctgtgtccatgaattgatccatttctccagattttccagtttattggcatatagttgctcatagtagccacactaatggtgctttgaatttctgcagtatctgttgtaatgccttctttttcttttcttttcttttttttttttttttttgagacggagtctcgctttgtagcccagggtggagtgcagtggcgtgatctcagctcactgcaagctccacctcccgggttcatgccattctcctgcctcagcctcccgagtagctgggactacaggcacccgccaccacgcccggctaattttttgtatttttagtagagatggggtttcactgtgttagccaggacgatcttgatctcctgacctcgtgatctgcccacctcggcctcccaaagcgctgggattacaggcgtgagccaccgcgcctggcctttttcatctctgattttatatctttaggtcttctctctttttttcttagttagtctggctaaaggtttgacaattttatcttttcaaaaaaccaactttttgtttcgttgatcttttgtattattttgtttcaatttcattaatttctgctttgatctttatttcttattttctactaattttggatttggattgcccttttctagttctttaggatgcattgttaggttgttgatttggtcaggtattttgtagagtgtcactcaattgagttgttttcttttttttgaaatggagtcccgctttgtcgcctaggctagaatgcaatggcatgatctcagctcactgcaacctccccctcccaggttcaggtgattctcctgcctcagcctcctgagtagcttagattacaggcaagcaccaccatgcctggctaatttttgtatttttagtagagatggggttttaccatgttggccaggctggtcttaaactcctgactttgtgatctgcctacctcggcctccaaagtgttgggattataggcatgagccgctgtccttggcttccattgggatttgactgatacttttctcatgattagactggggttatgtgttctgggaggaagagccaggaggtgagtgcccttttcctcacgtcctacaaaggggacgtgctctcaggaggactaacttgatgcctggctgaggcagtgcctgtcaggtttctttatagcagagctactgttttcccctgcatttgatactgtgctctttggaaggaggtcactctgtgcagcccatgcctaaggaatggggagttaagctccacctccttcagggcagggcatcttcatcacttattggaattttctaccctggagatttgtctcttctccatttatttattcattcatttatatcagtatggatccatggatcctgtatactttgggtgtaatccaattctactgtattttgttgctcaaattgttccagcattggctactggatgcctttcagttatctcccatgtccctgtgacacactccatcattgtgagattttgagcacttccttaactttctggcaccacaagatgctccaggctcatcttgtctgtttcctgtcttagacctagaatcagctgtttctgcaaggagccctggttcctttcattggtgaatggtattagaaaccaagatcagggtgcaagatgtgctcagggctgtagggtgctgttgcttcttggccgtcttagcggacagagcaaggaaatctgtgtgtgtactaacctgtatgtacacaaatctatatttctataggtaaccatctatggtactgttttagctaaacctgttcatgctaacatctccaactctaatccatggtcatcacatggatcattctaaatacctctccttgctcatctgtaacagtgggaagcctggctcctaccatcctccatccatttacttagttgttccctttcactctgcacgtatggtggctttagaattgttaacctttctaaaggctgggtatggtgcctcacacctgtagtcccagcactttgagaggctcaagcaggaggatcacttgagcccaggagttcgagaccagcctgggcaacatggtgaaaccctatctctacaaaaaatacaaaaattaggtgggcgtggtggcgcaggcttgtagtcccagctactcgggactgaggcaagaggattgcttaatatgagaagttgaggctgcagtgagccatgatcatgccactgcactccagcctgggtgacagagctagaccctgtccccccaaccaaaacaaaaaacaacaacaaaaaaccccacctcacccctgatacctttccagtcattcatttatttattgaatgccctctatgctgggcactgttttcaacaccatgaacaaaacaaagatccccgccctcgtggagttatgttctagtgcaggagatgagcaaaacaataagaatgatagatggataaacgatactttatattgaaaggaacacagaaaaagtagggcacagtgagaacccttgggcctgatggaggtaactgggacaagtggcaattcagggtgctcagggcaggccttgttgagaaggtgacatttaagcagattttgaaggcagtgagggagttagtcatgaggacatcagggaagagtgctccaggcaaggggaacatgatggggtggggacaaggggggaacaaggggaaccctggggtggggatgcacagcccttctgctgtgcccagggaacagcaaggccagcatggctggagcagagagaggtgggggttggtaggagatgaagtcacagaggtgggaggggggcaccacattataggtggccttgtcagcctccctgaggattcgacttttacaccaaatgaaatggggatcgtaagagtgacactctttgtcttaaggacccctgtgctcctgtgctgagaagaatgtaggggcagatgtggaggcagggaggctgttgctgtcacacaggcccaaggctgtggaggctcacaccagggtggtagaggaggatggtgaggagtggtcggaatctggttgtgtgttaaagatggggccagcaggactcaccagcagcctggatgaggggagcgatagggacagaagagttaaggctggtttcgagactttgggctcaagcatctcaaaggatagcattgccaccaactctaatgtatggagaaggcttgggaggagggtccagaattcagacatctcagtagaggtgtccagtaagtaggcagctgagtatctgagtgtgacatttagcctggaagtgatatatttgggcattgtcagtgtttacaatcaggagactggccaggatcactgatttagtttttgctgctgctgtaacaaagtaccataaactttgtaacttaaaacagcacgagttcattatggtttttcgcccccaactctgtcacccaggctggaatgcagtggcatgatcacggctcattgcaccctttacttcctaggctcaagtgatcctacctcagcctgcttgagtagctggaatggaagcctggctccgtgtccagctactttttttcttactttttgtagagagaggtctccctgtgttgcctaggctggtctcaaattcctagcctcaagcgatcctcccgcctcggcctctccaagtgctaggattactggtatgagctgctatgcctgtcctattatctcacagttctgcatgtcagaatttcaaaatggtcttaaggcgctaaaatcaaagtaccagcaggatgacattcctttccagagcctctgggggagaatctgttctccgccttttgtttttcctcatgtttctagaggcctcctccttggctcatggccccttcccttgtcttcaaagccagcagtatagcctcttcgaatctctctctgactctggctctcctgcctctgtctttcccttatgaggtttcttgtgattacactggacctacccgggtaattcaggacaatctccccatctcaaggtccttcatttaatcatatctggatagtcccttttgctacataaggcagcttattgacaggttccagggattcacacatgagcatctttggggccattattttgcctacctcaagcacgaaggggatgatggagaggaagagagtgcccaggaccaagcattaagaagtcaggagctggctgggtgcagtggctcatgcctgtaatcccagcactttgggaagctcatttgggcggatcacttgaggtcaggagttcaagaccagcctggccaacatggtgaaaccgcgtctctattaaaaatacagaaattagccaggcatggtggtgcatacctgtagtcccagctactcaggaggctgaggcatgagactcgcttgaacccaggaggcagaagttgcagtgagctgaaatcacgcacagaactccagcctggatgacagagtgaaactccatctcaaaaaaagaaaaaaaaaaattcaagaactcaagagtttgagaccagcctggccaacatggcaagaccccatctctacagaaaatacagaaattagccaggtgtggtggtgcacactgtagtcccagctactcaggaggctgagtcagggaatcacttgagcccaggagattgaggctgcagtgagctgaggtcgtgccactgcactccatcctgggtgacagagcaagaccctgtatccaaaaaaaaaaaaaaaaaaaatcaggagctgaggaggagcagctaggaaggtaggaggaaccaagagacctgggtccaggaagcccggtggacaaagggcactggggagggggtaagcagcagctgtgtcaatcacatcagaggtcgactcagaggtcacccatggacatggcaatgtggcagttactggcgaccttcagaagaacagtttgtgtgtagcagtgggggccaggcaaacctggtgggagtgggatttatttatttgattttaattattattattattttttttttttttgagatggagtctcgctcttcgcccaggctggagtgcagtggtgcaatcttggctgactgcaacctccgcctcccgggttcaagtgattcacctgcctcagcctccagagtagctgcaactacaggtgcctgccaccacgcctggctaatttttatatttttagtagagacagggtttcaccatgttggccaggctggtctccaactcctgacctcagtgatccaccttctttggcctcccaaagtgctgggattacaggcgtgagccaccgtgccaagcctgggggtggggtttagaaggaacactggccactctttcaaggactttcactgccaaagagaacagaaaaacgggaatgtggctggcagcgtaactgggccgggagaatatttggtttagttggggtttggtttccagcgggacagcagagcaggattgtttgctggtgggaatgtgcaacaacagagaatgacagatgaggtggttttgtggctcccaagcacgatggtctggtgttcacgagggtgtgtaagatgcacctccctcaaaccttgttacaaggttggcatgttacccgtctgatgtgaaaaaaaaaagaaaaatagacgagactgaggagggagttgtttgatgaataaatggatcacaccacacttctgcaacttttgttcacttaaccacatatctcagcaacatctccatgggtagtattgctccgagcagttctgcttgattctgcttgcataaatctatcctgttgatcagggtcagtaaatagaaagataatgcaagccaggcaggtaaggtggctcatgcctgtaatcccagtgctgtgaaaggccagggcaggaggattgcttgaggctaggaatttgagaccagcctgggcaaaatagtgagatcccgtctctaccctcctcccccgaccaaaaaaagccaggtgtggtgtgatgctcctgcagtcccagctacttgggaggctgaggtgagaggatcacttcagcccaggagttcaaggatgcaatgagttataattgcaccactgcactccagcctgggcaacagagtgagactatatctcaagaaagaaagagaaagagtagagaaagaaagaaatataatgcaagaaacaaatgtgagctctatgtcatttaaatggtgttttaatgttttatttaactcagtatatccaaaatatcatcacttcaagtggtcaatatagaatggttgggctactttacatacttctcttcatacctagtcttcgaaatccagggtgcatttcatccttacagtgcacctcagttcaaacaagccacgttttaagtcagtggccacatgtgactcgaggctctattgtggtcagcacagcccaaaaaaaactcacatagctttgggaggccgaggcaggtggatcacaaggtcaggcgttcaagaccaacctggccaatatggtgaaaccctgtctctactaaaaatacaaaaatgagctgggcgtggtggtgggcgcctgcagttccagcaactcaggaggctgaggcgggagaatcacttgaacccaggaggtggaggttgcagtgagctgaaattgtgccactgcactccagcctgggtgatagagcaagactctgtctcaaaaaaaaaaagaaaagaaaaagaaaaggatctcacatagatgagcagaggctacatacgaaacagatgatcgcagtgctgctggtataaccacaaagctagagccagcctcactgtaccctggcatggggctgacaatgtatatattgtggctttttgcttttaaaagcattaaaaggaaacattcatttgggtttaattcgtttatttaaattttttttttttttttttttgagacagggtctcgctctgctgcccaggctggagtgcagtggcgccatctcagctgcaacgtctgcctccgagttcaagcagtcctcccgctgggactacaggtgtgcaacaccacacccagctaattttgtttattttttgtagagatagggtttcatcatgttgcccaggctggtctcgaactgctgggctccaacgatccacccacctcagcctcccaaagtgctaggatgacaagtgtgagtcactgcacccagcctgaatcattttttaaagagcatgtgtccattaaaaattattttaatgaagcttctcaggcattcaaagtatctcatctccaatccctggcttaaattagaaaacaatctcggcagattggaagccctcatttaccccttccttctgtcattcccatccctcctctccctggacactggtgtttatcgattcgaagtccatctttatatgtgtaagtatgtgtccccaaatgatcagaataccgttttgaggtgttgaaagctttgtgtccccgaacagtgagaacagttttggggtgttgaaatcttggtctggcttcacactctatgtctcacataataacttgctttgtcgctgaggggtacctgagtgagattcatcgtagatgcctggatgaagagaggggccttgcgcttctatttgccttgttacatagtggtaagttacatattatgttacatagtaatccttatgtgcctaccttgtaactgtcttaattgcctcttgttttttgtgggggtttttttgagacagagtctcactctgttgcccaggctggagtgcagtggcacaatctcggctcactgaaacctccgcctcccaggctcaagtggttctcatgcctcagcctcctaaattgctgggactacagacatgcaccaccacgcccagctaatttttgtgtttttagtagagatggagtttggccatgttggccaggctggtctcgaactcctgacctcaagtgatccacccacatcagcttctcgaagtgctgggattagagatgtgagccaccatgcctggccttcattccctcttgatggacacttgggctgtttccaattttctgccattataaacagtgctgctgtggctagaatttctctggaatatattcagtggactagcagttctcaaattttagcatgcaccagaatcacctagagggctggtaaagacacaaggttcaatctagaatcccacgttgcatttacgctactactttttctgttttttcctcttaaaaattaaaaaacaaaaaatagaaacgggttctcaccatgtttcccaggctggtctcaaactcctgggctcaagcaatccttccacctcagcctcccaaagtgctgggattataggcgtggaccaccatgaccagccctattcctttttaaattaatagtaataataagcaaacctggaaaagaccccacacgtccagaggtgttcaggtgaggagtcgggggaaggatcatgagacaggatcagcgtcttgacccagacttgcttgggccctgcaaggacctgtgggacctctgggcccctctcacctccagacagggcggctcctccccacacccagctgggtggagtgggtgacctatctatactgctggccctgtgggccctgtaattagagagatctactggagttcagcatctctatgacctaggagagtccctacaaagagtctcaggcttcccctctgtggaggagtccagggtgggggtgagaggctctgaggggctgcactcagaacctgggtctttcatttatttggcaaatcttaaatgtcccaagtattcaccaagccttgtgctggtgctggggggacagcagagagcctgacactcccagggggctcctcatcaaaggggaggcctacagtaaacaaataattacacaaataaatatagaaaatgaactgtcacttggggaggcgtgggtcttggagtggggttttgaggtgtgaataggagttcacaaagcctcagaggaaggggaaggactacgttattcataaaaatctcactggaaatgaaaaacactttgagggttccgctgtctgttgtcagactacccaaataccattgccaggaaattccagcaggcccacacagcagagcggtccagggccaaataacttcaaaaagtaaaattagaaaagcctctctgaaaagtagctgtacacctaaagtctatgtttaatgtggcccatagatgtgttttgtaggtttgctctgatgtggattggggtcccccaagcagttgtaccagtcacacctctgagctcctaaagcagctctggcagccaggcaggaaaaccatgggcagtttcttataaagttaaacattcacctacgctgagacccagcagtcccactctcaggtatttacccaagagcaaagaaagcatgtgcccatcaagatctgtgcacagatattcataggagctctgctcctaataatcccaaactgggaaacgtcccaaatatccatcaacagtgagaatggataaacaaattgaggtacctccatacaatgggacactgctccccaataaaacattgcaaaccattgcacacaccacgtcatgcaccgctctcgcacgtgttgtgttgtgtgaaacaaaccagacaagaagggacgcatcccaagtgactgattggtttatgtacagtttaagaacaggcaaatctcactgctatttatagatggcacagcagtggttacctctgctagtggggccgggggtcgcttgtgtactgggaaggggctccagggaaccttctggaggctgagggtgcccttgatcctgatttgagtggtgactatataggtataaaaaatgatcaagctggacacttaaagtcaacatagtttatgcactttcacgtgtaaacattattccttaagaaaataaaaacagcaccagtggctccccccttccctgcagactcccccgacaccaccacctccttcttcgccttgcatcggtacgataaggcacttgcttgacgggaaagagaaactcagctgccagctggggttcatttgcactttcccccgcctggtctgcggtctggctgtgcagctagccgctctgacggggaggaggggcccaaagccactgcctgccgcctgggcaggggagaggggcacgtgaggctcatggcagaggcacagccagcttcttgcatgtgccctccccggggaatgtctgcagagcccaagactgccacgccgtgggcacagccctggcaacaaacagccacttacccagtcaccatgctctacttctcagctgcagccccacggcctggactcgcttgcccaggccccccagccacaaatcctgggcccctccctgaaacctccagacacaaactcacttcaggctggggccttggtttccccatctggaaaaggggtgaaaagccccatctttccagtgtagcagtcgaggcatttgcagcaggtgtttgtgctcagtgtatcgatgtaggaggctctcaaaaaggatgtagaaaacatgaatagttatgagtcctgttttaataaaattagaataaaaaataaaagccaggcaaggtgttgtgcgcctataatcccagctactcatgaggctgaggcgggaggatcacttgagcccagttcaagcccagcctgggcagcatgatgaaacccaatctctacacaaaatacaaaacatagctgagcgtactccctagctactagggaagctgaggtgggaagattgcttgagcccatgagtttgaggctgcagtaagctttgatcacacaagtgcactctagcctgggttacaaaaaataaaataggccaggcacagcggctcacagctataatcccagctctttgtgaggctgaggtgggaggatcacttaagctcaggagtttgagaccagtctgggcaacacagcaagaccccatctctacaaaaaaatttttaaaaaattagctaggcatggtggcgtgtgcctgtagtcccagatactcaggagcttgaggtggaaggatcactggagcccaggagttcaaggctgcagtgagctatgattgcaccattgcactccagcctgggtgacagaaagaccctgtctttaaaaaacaaacaaacaaacaaaaagagtgaaagataaacaaataattaaatttaaaaataaatagaactagaagaggaagcccaaactatttctgaatgtgttcatctgagaagagggcaaaatgtaaaatacacaccaattgtttcaccattattttcccccgaagttcggattaaagaaagggaggggattagcgcttcaacacacctccctttgtcctgggtgtcgtgcttcagcatgtgtggatggtagctttgtggttaaaaaaaaaaaagaagaagaaatgagagcaaaaagtactttgagaactctttgtagctgtcacgtccccagaccctgtggtgagaacctccagggacacctgtgaacatgcatgttcccaggcccagcctcaggggtctgcacgtttaagaaatggatgcacttgtctaatgatgagggcaatggtgccggacactgcccacgtgtctgctctctaggacaagcccttgagacaagtatcattatcccgtttaaagacgagaaaactggcagggtgtggtggctcactcctgtaatcccagcactttgggaggccgaggtgggtggatcacctgaggtcaggagttcaagaccagactggccaacatggtgaaaccttgtctctactaaaaatacaaagattagccaggcgtggtggcgcacacctgtaattccagctactcaggaggctgaggcgggagaatcgcttgaacccaggaggcagaagttgcagtgagctgagatcatgccactgcactccagcctgggccacagcatgactccgtctcaaaaaataataataataacacaaaataataaagatgaggagactgaggccagcatggctttgattctggcgtgagagtccacagtctggaagtatctgatttggcactcctatccctgaaggccccactttacaggtggaccaactgaagctgagggagatgaccagacttatccaaggtcagggccaatgaggggcactcaggtctgaggttcccttcatttcccccaggggaacctggtgaaagtaagccatggattcacccccagactcttctcttgtgccctgaaacctgatttctctaagacccacagcctaggaaggctgggccagggtgagcctggatagctgcttcccccgccattcccccacccaccccaggccagcaggcagtcatttcttgttttctgccaccgctgggtgttctgctctgacgaggaggccccaggtaaacagtaaggctgcctgaacatgcactgctggctcgaccttccccaggccccccagccacaaatcctgggcccctccctgaaacctccaaacacaagacccagttttgcatcaaatgagtctgcagagggagggaaaggaagctgcctgtggagtcaggtggaacctggtcaggtgtgtttgtgtctctgagcctcagtttcctcatttggacacagagctggtaagatcagccttgtagattctatgtaaggattagaaacatcaccagggtagggcctggcacatgtgctgagaggccggagggtggtggttctagcagggggtctggagcccagtgcttggtttaagtcccagcataggacttaacttccctctgtccacccaggtcacactcagaggatatctgctgagcacctatggtataccaggcactgtgcaggggtgctcttggcctcagtttccccatctgtccaatgacaactctcacggccattgcctaatagggctgttgggaggattaaataccttagcagtgcctgtcacagcaagcaactgagtttgctgcttcaggggcagtgcccctcacgggatgatggtgactcgatgacaagtagggcagagagtgcaggctgggccaggactgctttccaaattgggcctctctgttcccttgctggcctggattttgaaacgccttgctcaggctggccaagcgttcttggtcctcagcatctgtctctctcctggtggcctgtccagagatgcatggtggtttccatggacaccttcttccataaaaaagagaaaatgaaattgtacttacgaccacattggtataacgacaaacgtaatgcaggatggatttgttattacattgtcatcatgatcccatgtgttctcctcctttcttttaaaagaactttaaatgaaaacatttccgtgggcacctgaagtgtcatagccccaggagctgtgcctgctgagcccacaaggggtccaccctgggtgggctttttcagattgtaaatcccccccattacctcttcttagaaggtcacccttgcccgggcgcagtggcttatgcctttaatcccagcactttgagaggctgagatggaaggatcacttgagcccaggagttcaagaccagcctaggcaacatagtgagaccccatctctaattttaaaaacaaacaaaaaaacaagctaaggtcatgtgcaggtgtgtttaaaaaataacaaaaaattggccaggcacggtggcttacgcctgtaatcccagcactttgggaggccaaggcaggcggatcacgaggtcaagagttcgagaccagcctggtcaatatggtgaaaccctgtctctactaaaaaaatacaaaaaattagccaggcatggtagggtgcgcctgtagtcccagctactcgggaggctgaggaaggagaattgcttgaacccaggaggcagaagttgcagtgagccaagatcaggccactgcactccagcctgggtgacagagtgagattccatctcaaaataaataaataaataaataaataacaaaaaataagcaaaaaaaaaaaaaaaaaaacaaagccacccttgttgtgttagaaacttggaacttcccaaggaacaacattccccatctagacctcactgttctgaaacctactcctcctgcccttttcctttcctactttcccatttaaagtagggtgcagaggaccctgcttgccaaagccatttgactgactgtgagactgtagccatgaccatggaaatcacagctgctagcagtggtggagtatttcacatatttcacgtaaaccactgctctccccagtagacagaagcccagggaagccacagaacgtgcccagagttatgcagtaagtgatagaatcaagatcagccagagatcccctgaagtgtctgatcttcttccccacaatgtcatataaaatatcagcaagaccctcagtggtggatgtgaacttattaattatatacattatattcatttcccaacgttgtggtaacaaattcccacagactgggtggcttaaaacaatagaaatgtattctctcatggttctggaggccagaagttcaaagtcaaggtgttggcaggcagggctggttcctcccagaggctctaggggagaatctgttccatgcctctccctagcttctgggagctgctggcgacccccaatgctcctgggtgtggagatgcattagtcactccagtctatgcctccctcttcacaaggcctcctttccattgtcttctacccttctaagtacacttgttgttggattcagggcccaccctaatccagaatgatctcatctctagatccttcacttaatcatgtttgcaaagatcctatttccaaacaaagtcaccttcataaggctttgaaaggggttaagatgtgaacttatctttttggggccagtacacatgggacacagatgagtgccaaaaggaatcccaggaagctgtcaaaagcaacaataaggatgtgaataaaagtaatatcttaggctgggtatggtggctcacacctgtaatcccagtgctttaggaggccaaggcaggaggatcacttgggcccaggaatttgagaccagcctgggcaacatagtgagaccccacctgtacaaaaaagtttaaaaattagccagaggtggtggcacaagcctgtaatcccagctacttgggaggctgaggcaggaggatcatttgaggccagaagttcgagacctgcctgggcaacatagcaagaccccatctctacaaaaaataaaacaaaaattaaatagtaatatattggcatatggcccagcacctggcatatgacaagtacatatgtatgtatatatgtatgtgtatattatatatatatatacacacacacatacatacttttcttatatctataaagttttcaatctcagagaaaatgtttggatgcgctggttttgcccagtttcaatgttttcccaaacactagcaggtctcctccatctctcttgactttgttgaaacacctttagtctcgttttctgtttggcagatggccagtgttcctgcagctgcttcaggtctgtacaagccccacttgtggacactttatctgcaaagggggcccctgatttttccagcctggggcctttcctcctgcctctcttggcccaagatgcctccaccctccgcctttcacctgttgagacgcattttgtaaaataagtttgccctctgtctgcccttgttacagtaggcagtcagacataagcagggcaggagagggtgccccccaaccaggactgtcaggccaccatcaggtgatggtcaggtgatttaactgtctctccaaaataataattggttgtagccagcactgaggaaaggcaggctcccaatagattaaaaaacaccagaaatatgatcagcagctttgcgataagatctcagagttggctcaagcatgcatactaagaggcagaatggcagagtctggtctgtgacctgcttctaggaacgctggactggtaagggaaaaacgcctcaagtgagcatgcgcacaacttcagtaaacacactgcgcatgctcccctcccaaggacaggcaggccacggctaaggggacggcccaccccaagggaaggatcgggagaagtagtgcaaccctggaagcgtgccagcatataagacctcaagtcaaatggcaaagtgggcagttgactcgttcaagtcgcccgcctggcactcttccaagtgaacttgacttcctttcattcctgccctaaaactttttaacaaatgttcactcctgctctagagcttgcctctctttgccttatgccccctgcgtcgaattctttcttcggaggaggcaagaattgaggttgctgcagactcgtatggactcactgccgctaacacacactggtgccctgtgactcagatatgttccctagtgctaacattcccagctccaaaagaactgggtcaagtctgtcctgtttacattgctgggtccttgtgctggaaaaggagcccccacccgcccccactccacaaaaccatttccaatagtcttgagatttctcaccctgccccgacccacctttctgactccatctcccccacccctccacatgcgttatgtttcagttgccggaattgaaatcacgttgccgttccctctgcctggaatgcttttctgcattagggcatggctgatgccttcctagcttccagatctcagcaaagtgtcctggggctgctgtgcctggaagggacacattttgggtgcctccttacattatccgcccataccactggacaatcgggtgctctgtcttgcctctctgtgtgctagctgcttctctccaccaaatcacaatatccttaagaacaaggacgttgttttgttcatggcttcagtcccagcacctagcaagtcgtaagtgcttagaaaataatgtgttcagaggccaggcgcggtggctcacacctgtaatcccagcactttgggaggccgaggcggtcggatcacgaggtcaggagatcgaaaccatcctggctaacacggtgaaaccctgtctctactaaaaatacaaaaaattagccgggcgtggtggcgggcgcccgtagtcccagctactagggaggctgaggcaggagaatggcatgaatccgggaggcggagcttgcagtgagccaagattgctccactgcactccagcctgggtggcagagacagaccttgtctcaaaataataacaataataataataatagtgttcaatgtgtgaattacatcattctctctctctgaaacaagggattcaacttacgggtcatgggtagatttcatggtagagaatctcctaaagttgtaggcaaaatatggtccctgtggaagcatttttctcactgtgtccattttaggggtcagcattccccaaagacagaaccttcgctttacttaagtaatactgcctacccctgcagtcgtcctctccttccattcttgtttcattctacttgttattaaacatacaccaggcctcctgtgccagtagttaaggacaccaaaccatatgagggaaagtctccgtcatggtcatttgggtctcacagtgccacgcatgcagtcagcatctcattcgtgctgccaaatggaggaaggaagtcagattccacttcagctgcggaaccccgggctgaaatgttgcctgtaatatctaccctggaatccccaagcagagaaagcagcatgagtctcagcactggaagcagatggaaccacctggaggtttctacagatcgtggtgccccacctcaggctacttggatcagtgtgtctcagttggggcaccagcatcggtatgttttaaaagctcccgggcctggctgggcgtggtggctcacacctgtaatcccagcactttgggaggccgaggcgggcggatcacaaggtcaggaggtcgagaccatcctggctaacacagtgcaaccctgtctctactaaaaatgcaaaaaattagccaggtgtggtggcggatgcctgtaatcccagctacttgggaggctgaggcaggacaatggcatgaacccaggaggcggagcttacagtgtgctgagatggcaccactgcactctaacctgggcgacacagcgagactccgtctcaaaaaaattacaaataaaaataaaaagttcccgaggcatgcgatggaatattattcaacaacaacaaaaaaggaatgaggttctgagaactgattttaaaccacgatactacattcaaactacaccatgagtgaacgtggaaaacacggtgtgtggaagaaggcaggcacagaagaccacttattatatggttccatctatgggaaatgtccagaataggcaaattcgtggagacaaaattagattaagcctgggcagcatagcaaaaccccatctctataaaaagcaaaaaaatctggccaggcgcagtggctcacacctgtaatcccagagattcgggaggccgaggcgggcagatcacttgaggtcaggagttcaaaaccagcctggtcaacatggcaaatgctgtctttactaaaaatacaaaaattagctgggcatgttggcacatgcctgttttcccagctacccaggaggctgaagcaggagaatcgtttgaacccaggaggtggaggctgcagtgagctgagatcacgccactacactccagcctgggtgacagagtgagactatctcaaaaaacaacaacaacaacaacaaaaccttttgtacacccatgttcatagcagcactattcacaatagccaaaatgtggaagcaacccagatgcccattaatgggtgaatggatgaacatgatgtggtttatattaggttggtgcaaaagtaattgtggtgtttgccattgaaagtaatgacaaaaaccgcgattacttttgcaccaacctaatacacattgctatggtctgaacgcttgggccctccggcaatgcatatgatgaaattctcacccccactgtgatggtgcattaggaggcggggcctttggaaggtgattagttcatgagggcacagccctcatgaatgggattagcacccttataaaacaatcccatgagaacgggttcacacctttcgccattaaagatccaacaagaatccttctttccggtctgtgaaccaataaacaggcccccagcagacattggatctgccagcaccttcatcttggacttttcagcctccagaactgtaagaaataaacgtttggccgggtgcagtggctcatgcctctaatcccagcactttgggagatccgaggcagacagatcacctgagggaaggagttcaagaccagcctggccaacatgatgaaactccgtctctcctaaaagtacaaacattgcccaggtgtggtggtgggcgtctgtaatcccagccactcgggaggctgaggcaggagaatcacttgaacctggaggcggaggttgtagtaagctgagattgcactactgtactccagcctgggcaatagggtgagactctctcttaaaaaaaaaaaagaagaagaagaagagaaagaaatttctgttgttgataaactccctagtttatggtagtttgttatagcagcccagattgactaagataacatgtagtggaatataattcagccctaaacaggaagagaactctgacacatgcaacagcatggatgtgcctcaaggacattatgcaaagtgaaagaagccagtcataaaaggacacaggtcatttgattccactcacaggaggtacccggagaagtcggattcagagaaacagaaagtggaatagtggttgctggggcaggagggaggggaaatgggagttgcttaacaggtggaaaggttcagttttgtaacatgaaaagagttctggagctgcatggcggttatggttgcacaacaatgtaaaaatgtacttaacatttctgaactgtgcccttcaaatggttcaggtggtaagtcatatgtgtattttattacaattaaaaattttcttaggctgggcgtggtggctcacgcctgtaatcttgttgcatgatccttggggtgctgcttttatggccagaaacctctgtggctggtggcatcttttggccaagttttgcttgggcccactgggctagttctgcccactcagcctggcaggctgtgctcggctcacactaccagcctggatcccacccttgcttgggcaagccaggtgtggcacagtgaggggtgtgtgagcaagtgcgcatggggtctggccactgtgcatagtcaggcacactggctgctacaacggggcagggaccaggtgcccgcacaggcgccagctctctgcgaggctgcggcgggaccaggtgtaccacaggcagcctccacggctgccactggggaatgcattggtgcctggaagcctggaggctccaggaaccacagggccccaaagagggagtcccagtcctgacttgggctcccaggtctgggctccctgaagggccacagctcttctctccttctcttcacccacaatatggcaagcaacgggcgtgtttctgccctgtttgtgttacagttccttcagccctgccattcggcagttcccgagttcttgtcttgcttccaagaagaatgaggtacgcagacaagcgtagggcgaacaaggtgatgaagagctttattgagtgacagaatagctcagaggaggccttggagtgggtagctgctctctgcagctggttgacctgacgtctgctcagctctggctgagtccggtgcttttatgggtctcagagaagaggaaatgcatgccaaacggtccatgggtggccgtgagtgggcccagaaaaggcaccacaagttcccactctggtcctgtgggactggcagcctggcccacagccttcggaccctccctgggtgaaggtggggcctcaccggggacccagcgcctgcaccaaggaacctgtctgcctcttgctgccgttcatgggcccaggctgtaggtgccaaggggtgcctgcaggtcagcaccaagctgccctcagctccccttcaacttcccttctatgcttgtcagtgctcaaagtccagagggggctgaggcagcaggggactagcatgtcagcactgccccgggtgttcacacctggccgggctttgctttgctccaagatcagagtgggcaccgacagcagggagaagccaggcagtgggagcaggcacttctgagcctgtgaggggaggggggtcttcctgggccaccaagagtgcagggatgcctgggtccacagctgcaatttgggcagctgcaggtgtgctggagacagggagtgcaaggcttctgcctgctctgtggggtgggaggcctgaatctgcagctgtggtttgggtggctgcagctgtacccaggagggggcagggctcctgcctgctccatggagcgggacgcccaggtctgcaggcacgacttgggcagttgtggctgcatccgggaagctcccaccccactaactcaaaaggggcggggctcccacttgtccccagctcctgccacctccagagaatgtgcagccccagccatgcctccttgctgcagctggagtgacggcagaggccgctccacatgggccaccgctgccatcaatcctagcactttgggaggctgaggcaggagaattgcttgagcccaggagttcaagaccagcctgggcaacagagccagaccctgtctctacaaaaaataaaaaactagccaggcatggtggcacacacctgtggtcccatctattcaggaggctgaggtgggaggatcccttgaacccaggagtttgaggctacagtgagccactccactccagcctctgctctccagcctgggcaacagagccagaccctgtctctaaaaaatacaaaaataaaataaagatacaaaaagtttttaaaattattggcagaacgcggcggctcatgcctgtaatcccagcactttgagagaccgaggcaggcagatcactcgaggtcaggagttcgagaccagcctggctaacatggtgaaaccctgtctctactaaaaatacaaaaattagctgggcgtggtggcaggcgcctgtaatcccagcaactcgggaggctgaggcaggagaatcacttgaacccggggggtggagattgcagtgagccgagtttgtgccactgcactccagcttaggcaacagagtgacaccctgtcttaaaaaaaaaaattattatggtatgcagtaaggtccacaaatcttccaaggaattgtacatgagtacacactcgtgtggtgaccacccagactgagatagagaacagtgccagcttcctgcctattcagtccctctcttccctccccccagctccctggggatcagactgtatcaccagagtctgtttctgtgaccaaacgtcctataaacagaatcacgtggtgtatgcttctctgtgcctggcttcctcctctgaacatgatgtccaggtgcttcaccttgttgatgtgtgcagttgtttctttgttttgttttctgagactggttttcattctgttgcccaggctggagtacggtggtgtgatcatagcgccctgcagccttgacctcctgggctcaagtgatcctgcacgtcagcctttccagttgctgggactacagacacaggccaccacactggctgatttttgtatctttttctagagatgtggtttcaccatgttgcccaggttggtcttgaactcctgggctcaagtgctccacccaccttggcctcccaaagtgctgggattacaagtttgagccactgaactcagcctgttatgtgcagttgtatccattccttctcactgctgtgtaatattccactgtctgaatagaccataggtttatctgacctgatgtcaacaagctctgctgttcccagtttggagctgtcatgaatagcgctgatgtgtgtgtgcttgaacgtgtcttttggagaacgtaccaccacatttctgttggacatatccttggaagtgggattgtggggtcataggctgtgtatgtgcccagcctcgggaaatctgtggcaagcagatttctgaaacattgcaccaacttacgttcacagcagcagtgagtgggggttccagttgctccccatcctcaccactcttggttttgccattttcactttgcaccttctggtgggtgtgttgtgtgtgggcagctccttatttcaaagtgatcaaggttagggctcactggtgagcccaggccacaggctctgggatatgtgtgggtatcatgagaccttccgtgaagaatctctggttggagggccttgaagaccagctcttgtccagtaaaggctcctatggaacgtatagaattacccggcgcttgttagaaatgcagactcttggctgggcacggtggcccatgcctgtaatcccagcactttgggaggacaaggcaggaagatccctggagcccagaagttcaagaccagcctgggcaacatggcgaaactgaaactgacccaatagtcccatagatagttttttggataaacaaagaaattgacccttcttgtcttaaaacttgaagcttttatttgtttacgtgagttctatatcaggaaaggaccttcaggcctctcaaaaaagtatcaaagaactgaaactaaccaccacatccagacaatgagatgtggaggggcagggaggggccctcattcatcacgattgtttccttgcccctcctagttcctgttttcttgcacatcgttacatttctttcctgctgtataaacccctagttttagttggtcagggaggtgggtttgtggctgacctcccatctgcttggctgccagcaccggattaaagccttcatcctttccttggtaatactcgtcatctcagtcattggctttctgtgtggcgagcagcaggacctagtctgaacctctggtgtcttggtaacaaaacccacctctacaaaaaaaaaaaaaaaaaaaaaaaaaaaaatatatatatatatatatatatatatatatatataaaacccaggaggtggaggttacagtgaactgagattgcaccattgcactccatatatatatatatatatatgtacatatgcatgcctgtagtcccagctactctggaggctgaggtgggaggatggattgagcccaggagttcaaggctgcagtgagtcatgattgcgccactgccctccagcctgggcaacagagcaagacagtgtgtcaaaacaaaaacaaaaaccaaaaaccagactctgtggctcacctcccactcacagggtcaggaactcaagaggggcccagcacgaggtattttcacagacctgcctgtgagagcctctgcccagagctcagtggtgaggacaagcgctctgcctttccatagctccatggccttggactcagtgcttaccctgtctggcctcagttttctcgtttgtaaaatgagcataataacaggacccacttcataggatgttttggggattaaagggactcatgtttgtactatgcttgaaacagtccttggcacctagctagcactcaataaatggccgtaaaatttaaagttaaggccctggccaggcacggtggctcacgcctgtaatcccagcactttgggaggccgtggtgggtggatcacctgagttcaggagtttgagaccagcttgtccaacatggcaaaaccctgtctctactaaaaatacaaaaattagccagctgtggtggtgcatgcctgtaatcccagctacttgagaggctgaggcaagagaatcacttgaacccaggaggcggaggttacacgagctgagattgcaccattgcactccagcctgtgcaacaggagcaaaactccatctcaaaaaaataaataaataaagtttaggccctgtctcgcccaagggaggttggcactagcatgacttgacaaatcagtgccatataactgttgttccagttgggacacaggaaacttgccacctgcaagccctggcccagtgtaaagctcaagtccagagggctggggtttgtgggagacagaactgtcaccccaggactatcagagagagaggggctcctggctcttatttctgcagaagcagctagatggacaggtccctcactccaaggagcctccaccacgtgcccacacctttctctggtttcactttcagtttcttggaaaggctgtccttccctactccaagcccctcccctcactccccacccaggatctgggcactggaggcgccagacatcttatgccctgtccaaggctagcaggtaagaaacgccccttgtatctgccaaggtcaaaatcatacacacccaggtggggcagtcccacctctgggaggtgtcttgcagaagcactcctaggagtgtgaggtgatttggctccacagtgcttgtggtcagaaacaactggaaagaagttgtgtgctcagcagcatggtggggtgagggggttgcagggcatcccacgccataacccacgaggtagcctctatgggctgatgggggatcagtgcagggtggtaagggccagggccaggtctgaagggagagtgggctcccattcatgtgagtgggaaaagcaatgtatgtgtccaggtgcgccaggtcgtgcagagcatatcttgaaaaggcacacaagggattgatcagagaggttgcctcaggcaggataactgagatctggaaatggtgtgggaggggaaccagttttttttctgtgaagtccttggatgctttgaatttttgtttaagtcatgcgcatgcatgattattgtttattccctgcccccaccccacctcaagtacagaagaaaagaaagacagtttctttcttaaactagtttgctggagggctggacatcctttgttgctcattttctgggagatgtaggttaaaattaacctacatctttggagggctttggagtcagactgtctgtgttcaagtcctggctgccccactttgtagcttctcgagcaagtcgcttaacttctctgagcttttattttctctcctgtaaaatggcacaatattattgatataatgttgacattattatggatacattgatttttttttttttgagacagggcctccatctctcacccaggttggagtgcagtggcaagatcaaagctcactgcagccttgaccttctggactcaagtgatcttcccacctcagcctcttgaatagctgagactacaggcatgcaccatcaagcccagctaattttttgtagagacaggagtcttgctttgttggccaggctggtctcaaacttctgggctcaagcaatcttcctgcctgggcccctcaaagtgtggggattaccagcatgagccaacccgcccggactgatgtgaatatgttgatattaatgtgatactaaagtttctgccttataggcttgttgcgtggcttcaatgagacagtgcagggacatgcctgagaaagtgccaggcaccccccaccacatgacagcaagactcagtgtctacagtacacttccactgctatgggcggcgggttgggtggagatcttcatgcctatttgcagatgggtaggttgaggtacaaagtagcaaagtcccagggtaagaggcctggtcggggccgcttgtgccctggatctattagtgacctgctgtgggaccttgggatggtcccttccccttgtcagtgaattgatggggttggaaaggctctcctgggaatcgtgaaatgcagggtctccaagcactagtgacaagtgaggtggcagcacctcagatcctgttccaggccctggggctaggcatctgccctcaggcttaggagcctccgtctgtgtcctctgccagcacacccgctttaccaagcacacgactttcccggggtcttgtacagtagaatgcagatcctgacccagaaggtgctggcggggcctgcagttctgcatttccagcaaggttcctagagaggtcagtactgctggtctgaggaccgcactttgagtagccaaagtctgaatttgatgtgggtcatggtatacacctgtgtaaaaagctatccaggccaggcgcagtgactcatgcctgtaatcccaacactttaggaggccaaggtgggaggatcacctgaggtcaggagtttgagaccagcctggccaacatggcaaaaccctgtttctactaaaaatacaaaaactagcccagcatggtggcacatagtctgtagtcccagccctttgggaggctgagacgggagaattgcttaatcccaggaggtcgaggctgcagtgagccatgatcgtgccactgcactccagcctgagtgacagagtgagaccctggctcttaaaaaaaaaaggaaaaaaaagccatcaagctgcacatttaagatgagtgcacttgtctggtctgaaggtagtaagttatctcagtcaattgttcacaggcagttacagatccaactcctcattttactctttcccctttctcatgactgcacttgactagtctaaaagccaaaaagggctggttgcggtggctcacgcctgtaatctcaacactttgggaggccgaggtgggtggatcatttgaggttaggcgttcgagaccagcctggccaacacagcgaaaccccatctctactaaaaataaaaagtaattagccgggcgtggtggcacgcgcctgtaacctcagctactggggaggctgagggaggagaattgcttgaacccggtggcagagactgactgagccaagattgtgccactgcactccagcctgggcgacagagcaggactccacctcaaaaaataaaaataaaaaaatatccagcccaagaagggccgcaggatgaactcagaatggttaatgaaccatgagccaagtggtgagtactggccacccacggtgccccttagccctcccctccccctccccatctcctccatacactcatcctccaacacgccctcctggtccaggtgctagggcgggatgcaggcgcctcacattccagcagggcagccgtgtctgtctcaggaaatgcgtgtggtctccagctctggccgccaggagacaaagccacccgctttgttccttggcccccagcaggagggggaaggggagaatttccttaggagaggttccaagaagaggaattactgcttcaaagggagtgcaccatttcaggcggctgagagctgctgcgccgccttccagaaggggcccggcaccccttattgttcccagcatgtgggtcccggctgggtctgccttagggcccactctcctgtcacctgctccctctcttgcagttggcgacccctggggtctcctctgagtggcctctgccctcagttgcccacccaccctgccccctgtccttgctgtcctcttggtggggatggatagccccttcttttcccctcccctactgccccactgcctcactctcgtcatttatttcctcacttaggtccttgtccctgaagggccatggagctaagtgaccagcgtgcctctctgggtcccgtgtgtgtggtaggaatcttcacactgccttgctgtgaccgtgggccatcgcatcacctccctgtgccttggtttcctggcctctaaagactgaccttaaggggttgtttgtaaggatgaaggcacaaatgcaagccaagtccttagaattctcagcacatagcaagtgctcaatgaaccgcctggctgctgttcgctggggacacagtcttttgctctctggatgtctgaccgtgccctgtccctgcctcacagggccatccatcagtgctggtgagctgagctcagctgacaagccagcctggcacggagcgctgcccctcctgctggtcccagatccgttctgtccggaggagaatttcttatccccaggagatgcctggcctcgttaggagcctcctcacccgcccgcccgcaccaaccctctgactccctccacctcaccgcctgggaacaacaggaagagagcaggacagcagcagaaaggagtgctgcttatgtggctcttctcagaatcaggaggctcccaggccaggaatgtgaaaccattatgcagatgaagaagatgaagcccgagaggttatgaaacagacccaagtgggctcgctcttcagtctcggcataaggaatccggaacctgggcccgtgtccggaactgctgtgcccaggcagcttgcctggaaatcaggtagcgtggggggaccccaaaatccccctgtgacagaccacgaatctgccgtgtttgtgcacctctgttttgcttcccagaaacgaaactttggcaactggagagggatggagtggggcgggtggggtacagcaagatcgggaaacagcaccgtcctcaaatgcctgcagaaggtgagagaaccagcaagtgtgatgaagcacctgtgtgcttcgcagccattaccgtgtctaaatctcacaaccacacagtgaggaagggtttctgtttccattttatagataagcaaactgaggctcagagaaagtaaagtcacttgcccaggagacacagctggaaggaggcagggcgggaattcataattgttttttggtttttttttttttttttggagatggagtcttgctctgtctcccaggctggagtgcagtggcgcgatctcatctcactgcaagctccgcctcgcgggttcacgccattctcctgcctcagcctgccaagtagctgggattacaggcgcccgccaccacacctggctaattttttttgtattttttagtagagacggggtttcaccgtgttagccaggatggtctcgatctcctgacctcgtgatccgcccgcctcggcctcccaatcataattgtttttgagtgttcaaaagatactttttatttgcctgttttcaaaaaatatttctcccttactttagacaattagtaaaagttacaggagccaacaaaaggtggagagagcgtatcattcaaggccttttcaaaaaacatatcaatctgaagaatgataaaaagaatatggaattcaaaaattttaaaaactccttgcattaaaaataagtcagtatttgtaataaaatcttgtttctggctgggcgtggtggctcatgcctgtaatcccagcactttgggaggccaaggtgggcagatcacttgaggtcaggagttcgagaccagcctggccaacatggtgaaaccccgtttctactaaaaatacaaaaatttgctgagtgtgatggcacatgcctataatgccagctactcaggaggctgaggcaggagaatcacttgaacccgggaggctgaggttttagtgagctgagattgtgtcactgcactccagcctgggtgacacagcaagactctgtctaaagaataaaaaaaaaattaaaaaaaaatcttgttttaaccaattatttagttttgtattagtgtattttttaatattaaagatgcatctctagaaagattattataatttttaattatagccagctgaattatacaactcctttaaaaattccttttactggggagggatagcattaggagatgtacctaatgtaaatgatgagttaatgggtgcagcacaccaacatggcacatgtatacatgtgtaacaaacctgcacgttgtgcacatgtaccctagaacttaaagtataataaaaaagattccttttactaaccttattatgacttacatagaccattcacaatgtatttttttttttttttttttgagacagggtctcacgctctcactcaggctggagcccagcggcatgatcatagctcactacagcctcaacctccctgactcaagcaattctccctcctcagcctcctgagtagctgagactacaggcacgcaccaccacacctggctaattttttattttttgtagagtcaaggctcactatgtttctgagactggtctgtaactcctggactcaagtgatcctcctgcatcagcctctcaaagtgctaggattacaggtgtgagccaccgtggctggcccagggctggaattctgacccaagccctcatctcacaggctgcagaactgagctcacattccattgtgggggagacaagtgatgaacaaataaataagattaatttaggcagaatgatgttttggaggaagttaaatgattagatgatgtaacagaggatgatagcaaaggggtggaatctagaccagccagatggttgggggtagtggggtctcttggcagaagccgtgtttgaactaagatggggaggaagaggaggaagagccagatgtgtgaatgtcagagggaacagtgtcctgggtgcagtgacggcacgtgcaaaggccctggggtgaacttagcctggcgtgcggaggaacagaaaggcctgcgtggccggagctctgtgagtgatgaggatggaggagctggggctggaaaagtaggcaggggcctggcaggtcacgtggggaggagtttgggtttattctgaaggtgggaggaagccaccaggaaggactgaagcaggaggttaaccagatttttgggagccacagccttacctttcctcagccctggtcaggttggggtgggtgccttggagaatggttatgggagtgtcctgaggccccgaagcctggaactgtcccagactttgaggttccccatacctgggatcgcattcttgctctgccacttaatggcttggtgatcttgggcctatagcttcagttctctggggcttagtttcctctgctgtaaaaatggggatgtcagccaggggcagtggctcatgcctgtcattccaatgctttgggagactgaggtgggaggaatgcttgagcccaggagttggagaccagcctgggaaacacagagagccccgactctacaatatatgtatatttttttaattaggcaggagtggtggcacacgcctgtagtcccagctactctggaggctgaggtgggaggattgcctgagcccgggaggtcgaggctgcagtgagctgtggtggtgccatcctccctttgcagagcaggccttgaatgaataccaagcccttggcacagagccaacaaccatgaatggcgcctggtatttctgcagttgttgctgtgagcatccctgcagcaccttctcagacccaaggtcggtcgtgttctggctccctgggggtccccactgcccaggggaggctctgaggaattgcaggagcctggggatggcccagctcccagagcaccccattcctgtttccttgccagggccagctcagcaagatttccatggacatcaagtgttctttcctgtgggggcagtgcaaggagggtccaaagagcaagctcctgtgcccccgggggtgggggtgggtcagggagcctcagtttacccacttgtgaaagggccatagtaacctcagacctcttcagcactggttccctgatttgaggatttcaaagatcagcagacttaaaaatataaacatagaggcaggggttcccaaacccctggccacagaccagtactcatctgtggcctgttaggaaccgggctgcacagcaggaggtgagcagcaggtgagtgagtgaagcttcatctgtgttacagccactccccattgttcgcattactgcctgagctccgcctcctgtcagatcggcagcagcattagagtctcatacgaatgcaaacctcattgtgaactgcgcgtgcgagggatctaggttgcgtgccccttatgagaatctaatgcctgctgatctgtcactgtctgccatcgtccccagaagggaccatctagttgcaggaaaacaagctcagggctcccactgcttctacattatggtgaactgtataattatttcattatatattataatgtcataacagaaataaagtgcacaataagtgtaatgtgcttgaatcatcctgaaaccatcccttacccactagtccatggaaaaattgtcttctataaaaccggtccctgggccaggtgcggtggctcacgcctgtaatccccgcactttgggaggccaaggtgggtggatcacctgaggtcaggagtttgagaccagcctgtccaacatggtgaagccgcatctctactaaaaatacaaaaattagctgggcgtgatggcgggcacctgtaatcccagctactccagaggctgaggcaggagaatcacttgaacctgggaggtggaggttgcagtgagccaagatcgtgccactgcactgtagcctggatgacacagggagactccatctcaaaaaaaaaaagaaaaaaaaaaaaagaaaagaaactggtccctggtgccaaaaaggttggggactgcggtatggagggattggtagagttaactaccaatttaaaaaattcgccaaacatggagttgcaaagaaatcaaatactatctatggttttcatcccttcctaaaagaaaagataattagctggtgcacgtgtgttagctcctatcgtcagatggaagctggtccctgaaatgccaagtgctgctctggatgcttaagaactcattgagagatgcatgcccggggacaggaagtagccatgcaactgtgaggtggcagatctgggattcaagtcctcaggggccggctcccccatctgtactttgcatccctaaggccagtggtcctcaaacatcagtaggcaccagtgccacctgcagcacccacctggagctccagtagccggggtgggcctgagaatggtcattcctcacctgtccccaggtggtgccagtgctgctggccccaggccacccttcaagaactgctcctcatgggggctgagcagggtggatctgcttgtaatcccagcaccttgggaggccgaggctggaggatctcttgaggctaggagttcaagaccatcctggacaacacagcgagccctcatctctaaaagaaaaaaatacacacatgcaaacatacatatgtgcatacacatgtgcaaacacacacacctaatgcacatacacatacatgcatatatacatgcatacatacacatacatacacgtacatacacttacatgcatacacgcctgcatatacacatgcacgcacacatgcatgcatatacacatgcatgcatacacagacatgcatacacacatgcatatacacatacatgctacacatacacatgcatatgcatatacatgcataaacatacacatgtataaactcatacatgtatacgcacatgcatgcacacatacatgcatacacaaatgcatgcacacatagttgtatacacatacatgcatacacgtttacatgcatacacatacatgcatacacatacatacacatgcacatgcatatgcacatgtacatatgcatacatacacacatgcttatacgcgtacacgtatacacatacatacgcacatgcatacacacctacatgcacacgtacatgcattccaccactctctgctctcctatgccccagatgggcttctgctttatgaaaaacctattcacttgttctggtttctctttttcctttgaagatgtcagggagcaaacccattctgggacccatcacatgagaccttcgattggggctaggacaccaggtctggggctcccccacttccagggctgtgttctcatctgacaagatggtgacctccactgtctccctccaggaggccaaaaatgtgaggaggggaatccagagagatgcttggtgaggaattttccggaagatggccagttccctcaggcagtgttagcacttactgagggtccggggtgtccagacatgattttccctttgtttttttttggttttttttttttttttttttttgagatggagtttcattcttgttgcctaggatggagtaaatggtgtgacttggctggctgcagcctccgcctcccaggttcaagcaattctcctgcctcagcctctggagtagctgggattccaggtgcccgccaccatgcccggataattttttgtatttttagtagagatggggtttcaccatgttggccaggctggtcttgaactcctgacctcagatgatccacttgccttggcctccctaaatgctaggattacaggcgtgagccaccacgcccagccccgacaccattttctgtattgatctatcaaatttttgttgagagctttctaggttccaggcagccactgttctgatgctttacatcaactcatttaatttccctcatgaggtaagaactgtcatccccattttacaggtgaagagacaggcacagagaggctgagttatttgcctgaggtcccacagcaagtaacaggcaaggccaggattccaggccaggccaggaggctcccggctctctgttggcccagccctggtcttcttaatgagatcccagatcaaggctgggacgaggggagagctgtgcctggcactgctgcttgctttccaggtgtagtgggttaaaagtgtccccaaagagataaatccacgttctaacccccccagaacctgtgacagtgaccttatttagaagatgggtctttgcagatgtcattaaatttaggatctgaggatctggaaacgagaacatgggtggaccccaaatcccatgtgaggtgtccctggaagagagaggcagagagagattttggacacagacacggaggcgaggaggccctgtgcagatggaggtggaggctggaatcacacagttccaagccaaggaatgcctggagccaccagaagctggaagaagcaaggaaggggcctcccttccatcttctggaggaagcagggccctgctgaaaccttgacttcagacttctggcctccagaactgtaagagaatcaagttctattgttttaagccactgagttcatgacttgttgcttgtggcctcgggaaactgacatcctgggtaaaactcctcccctctctaggcctgtgtctcttcacttctgtgcccaccatgcagctcctgggtcccctgctcactggtccctgacaccagctggccagggacccctcagtacctgtggggagtgcggtgggccggcggccttccagaactgcattgggcaggccccgccaggtttatgcctggagcggcctccctcgcctgatgcactgggctgggatcaagaggcatgagctctgctgcagaccccactgaccttggagaagacgttgccctctgggcctgtttcttctgggagatgggagccctgtcacctgctaggtttgctgggagggttcacagggttctttaaacatggcagggtctcagtctgttgtggacgtcattgtcattggtttattacctgtctgtctgtctgtctatctatctaatctatctatctatctatctatctatctatctatctaatctatggagatggggtcttgctgtgttgcccaggctggaatgcagtgacgcaatcatggttcactgcagccttgactgcccaggctcaagcaattctcccacccagcctcccaagtagctggaaccacaggctcatgccaccacacccaactaagtttgttattattatttgtatagatgaggtcttgctatgttgttaaagctggtctcaactcctgggctcaagcagtacccccacttcggcctcccagagtgctgggattacaaacatggtatgttgagcatttaaaatttcaaattattttattttattattattttttgagccagagtctcgctctgtcacccacgctggagtgcaatggcatgatctcggctcactgcaacccccctgttgtgggtttgagcaattttcgcgcctcagcctcccaagtagcacccaccaccatgcccagctattttttgtgtttttggtagagatagagttttaccatgttggccagcctggtctcagactcatgacctcaagggatccacccgccttggcctcccaaagggctgggattacaggtgtgagccactgtgcccggcctattttattttactttattttatttacagagacagagtctcactatgttgcccaggctgatcttgaactcccgggctcaagcagtcctccctccttggtcttccaaaatgctgggattacacgtgtgagccaccatgccaggcccattgttattcttttaatgagcttttttcctgagcccctactatgtgcttggctggacatgaaacccttctcaaggaaataaggtttgtctgatgctaataatgaacttcattttagtaatgaggattctgaggtccagagaggttaagacttttatggaggagcacaagctggcccaggacctccacactttagtgccctgtaactgctgggagcttcctggttggatgggcaggggagagctggcgatttggcatgttgggacagggggaagagcaggcagaagggtgttccaggccgagggcacactccagtgaaatccaggagtgtagactttgatgccgggtaaggctggggcagcaaggggcccggaaagtgccactggctgcagtcaaagtggcctgagcaaggtgttctctgtgtttctgaggctgacctctgtgaactcagagagagaaagagagagaagggatattggtgtgcgcttgtgtgcatgtgtgcacaaccatgcggtctggcaggcttgtgggacagtgcccatgtacaagcagctctcttgtgtgtgcagggctgcttggaggccatggtcctgggctcttgggtgtgtgtgagtgtgtgtgtttccactggtggaaaatgggtgtatctcttggcaggagctgggaatgtgagtgggtctgaggtccagggagagcaagcctacggttgcaagtgggcagactacgtgagaggggtctgggagcctttgtgtctgtgtgcatgcgtatgtgtgcctgcgcctcagagtgtatgcatgagtggatgagtgtatgcacacctgtgtatgcagtcatgcacacacatgcatgtgtgtgtatgtgcgtgtatatatgcttatgtgtatgggagtgaatgtgccgccatgtgtctgcttgtgtctgcaatagcctgagtgtgcatgcgtgtgagttttgctttcacattcagtgctagtcagaggctccaattcctgtaaacctcatggtctcatcttccagcagacatcccacagcagtggcagtgggcaccacagcctaggcttgatctgacttatggcttccccttttcaagcctctggttgcagggtgtagaggggatgtaggtgaaggcaggacacccggcccccagctggccgcaggccccaccatccctggcatctgcggcatgaagccacccatgggagtctgagggaagtcacattactgggactggccagggtagagctgccctgggaaatgtgggttcactttcattctactgaaggtgaaaatcagatcacgcctctcctctgtctctctgaaaaccctccaaagagtccctgttgcatttcaagcgaaacatgagtctctacccagtatctcagatgtcaccagggccctgctggccagaaagacttgggaaggaaccacccatggtgtatccactgtgtcactcttggcttcgagtcccttcctgtaaaagctgagtaggaagtccttgcagggggcagggatgattgcgtgcttgtggccgttcctctgtccagtgggtagacactgggaggctctggagacttggccatgaaggagacagccctcccggtgggccagagccttttccctttccatatagccatatgcgatagtaaagagcggttgcttctccaggctttaaaaaattttttattttatattttattttttgagacagggtcttgctgtgttgcccaggtggagtgcagtggtgcaatcaccacttactgcagcttcaacctctcaggctcaagtgatcctcccacctcagcctccagagtagctgggaccacaggtgtgcaccaccacacctggctaattttttaattttttctagaaacagggtttccctgtgttgcccaggctggtctcgaattcctgagctcaagtaatcctcccacctcagcctcccaaagtgctgggattacaggcgtgggcccccgtgcccagtccctcatgccatttctgtgccactaggaagtaacactggctaaccaggttgacatttctcttgttcccagagtgaaacgaatgagtgcttcttctttaatcctgcaactaccccacatggtcagcacttatattttcactcttacttggcagatgaagaaattgagtcctgttaaggaacgtgcttaggatcacatgctaggaggtggtcgtgctggaattcaaatccaggcaggtgctagcttgagagccactgctctataaagcccttctcaggcctccactcaggccaagggaggaggaagggccctcaggcaggagcagcgtgagcaaaggtctggagctgggactgagcatggcatgtcaggagagagagacaagagctctgtggccatggggagcagcgtgaggtcaaaatggagaggcaagaggagggaggggtgtggaggtccctgaatgccagcatgaacgctccgggccttctgtggggtgggcggcacgggagaaagggagtctagccagctccggctgggtgccctggctcaaaccatccttgcctcaggcaaggacacctgcatggacccagtcgctcaagtcccaaaccaagtccatccttgagttctgtctttgtctcccctcatcgggccgtggggagtagagtgaaaccgcagctgcagcctcctggctagtctctccactcctctgcccccacagcccagtctccacgcggcggccaggggcgtctactgaaaacgaaaatcaggtcatgtctctctctttctctttctctctctctttttttttttttgagatggaatctccctctgttgcgcaggctggagtgcaaccacctcccgggctcaagtgattctcctgccccagcctctcaagtagatgggtttataggccacccactaccacgcccggctaatttttgtatttttggtagagacggggttttgacatgttggccaggctggtttcctgacctcaagtgatcctcccactttggcatcctaaagtgctgagattacagatgtgagccactgtgcccagcctcctctctctgtctctccccacccctcccctcaaaaatgcgcattcctggtacatttaaagcaaaatccaaattcctttaagtggcctgtgagtctctacctgatcttgcctcaccgacctcttgactgcatcactgactgctcccccatcactgcgcacccatactggcctttctgttcctcatacacacagggtcgctcccgctgcagggccttagcattcgccattccctctggtgggagtggcccttccccagcccaccagccccttctgtcattcaggtctcagctgagggagcctgtgcagataagcccctctccccacccctcctggtttattttcttcatctgcatgtgcttagcacccgaaattgtctcttgctctctccccatccttcaccagattataaactccataaaagcagggtcttttgttggttttgttcaccgctgcatcccaggcattcagtgagcacttgttgagtgaagaaatcagactcagtcttcccctctgtaaaatgggaccacatcaaacctcctggcagggtagtggtgtggctcagaggtaacgtttgtacacagttggacttcttccctactggcccaaggacttacctggccacccctcctggaacccagcctcctccagctcccccaagccctctgccttgggagcggacaccttagcagaagggccgtcctccagaccctttgcagccaggcctctctgctcacagatccctgaggacatccggaggttggtgcccagagcctagccccaggctcatgcaaattctgtcttccagttcagcagctgtggcctccttcactcggccttttaaaagaaattcttgggctgactcacacttcctttgtctccagctgggttcactcaagtgtcgctgttttgcaaggctgaggtttgagtccctcagaagcaatctctgatgcaggggcgctgtgtgcttcattgaacttcgaatgaaggtcaggccccccagaaaacctcataccaggacagttgggaaactacccctcactggtggtcagggcattctgggttggagaaactgctttggggctttggcaggtgttcattttgtccatccccctgcctcccacctaaccccatcccaaactcactcaaaaaaatgcccctactgccctggggggtgcatttcaacgtctcatgtaccccgcttttccttccttccctgtgaaatcaggcgtttggattcagcgcactgctcagaaggtttgtttctttctgtgcaaacacgtggagtgatgctctgtctcgattttctagaacacttccactttcacagaattgcggttattttgagaaaaagggtctgttacaggtacaacaatatactggtactggtctgcatttcttgtttctgtccctggaagagtttttatgtaaataaagtcacactgctccaggggaaaggaattcctgaggaattccctggagagaaagggatgagtgatatttaacccattttctcccgtctccagtagaaagaactggagctttggaggcaggctgatttcagggtcaacctcttcctggctgtgaggcattgagtaagttacttaacctctcaaagggcctgaatttcttgggggtagatttagggcacagttatccctggatactatttttgaggggggagtcgaaccttttttatttacttattttttttagagacagggtcttgctctgtcatccaagctgcagtgcagtggcatgatcacagctcactgcagcctcgacttcctaggctcaagtgatcctaccacctcagcctcccaagtagctgggactacaggcacacaacaccatgcccagctaattttttaattttttgtagagacgggggtctccctgttacccagcctggtcttgaactcctgggctcaagcgatcctcccgctttggcctcccaaaatgttgggattataggcgtgagcctggcctggaacctatttttaataaatggaagtgaaattcacgtaacataaaattaactaatttgaaatgaacaattcagtggtgcttagtacatttacagcgttgtgcaactaccacctctctttagttggaaaacattttcatcattcccaaaggaaactctgtatccattaagcagtcattctctactccctcttctccttggtagttaacttaggtactactgggctttcttgactgaagtccctgaagaagaaacaaatattttccagctgggccaccacctgtgacaagttgtcatttgcacggggctgggattctgttctgggtatgtatgtgccattctatatatatgtgtgtgtgtatatatatatatatatatatatttttttttttttttttttttaatgcagagactcactctgttgaccgggctggagtgtagtggcatgatctcagctcattgctacctccgcctcccaggttcaagcgattctcccaccttagcctcctaagtagctgggactacatgtgtccaccaccatgcctggctaagttttgtattttttggaagagacagggttttgccatgttggccaggctaatctcgaactcttgacctcaagtgatccacccacctcagcctcccaaagtgctggggttacaggtgtgagccactgcgcccagccccccattctctaaattttgacacagctgagagtcatctaaccaccaccacaaccagtacacaaaataatttcatccctccaaaaaattcccacttgctacccttttgtcatcatcccctcccctgctcccagcccctgacaatcactggtctgttttctgtccctagagttgtagctatgcccaaatgtcagatgaatggaatcctgtagatgtgtacttttgggtctggcttcttttgcccaacaccaagtatttgagattcatccaagttgctggttgtatcggtagtccacaccttttcactgctgagtagtagtttatggtgtggatgtaccacagcttgttaaattcctctgttaaattgggttgtctccagtttggggtgatgatgaatagactgccctcaacatctatgtataggtttttgtgtgaatgtaagttttcttttctttttgacatagggtcttgctgtgttgcccaggctggagtgcagtagtgtgatcatagctcactgcccccttgacctcaggggttaagtgatcctcccacctcgacctcccaaagttctaggactacaggcgtgagatgccacactcagccttgaatctaagtttttatttctctaggttagacacccagaagtggaaacgctgggttgtatggtgagcggatgtgattctgctctgtttgacctgggtaagttaaatctctgtagacctcaatctcccacttctgtaaaatgggtataagaacagtgccaactccattgggttattgtgaggatgaatgagacacataaggcacagagtaagtgctcaataaatgttgccttttgtttttgggttggaatttttttttctttttctttttttttttttttttgagacggagtctcgctctgtcgcccaggctggagtacagtggcgcaatctcggctcactgcaaactccgcctcccaggttcacactattctcctgcctcagcctcccgagtagctgggactccaggcgcccaccaccatgcccggctattttttttgtatttttagtagggacggggtttcaccgtgttagccaggatggtctcgatctcctgacttcgtgatccgcccgtctcggcctcccaaagtgctgggattacaggcgtgagccaccgtgcctggctggattggattttgtttcatccatatctttggccatgtttttacctgcagcatgggggccattggccagtgctgttgaaagaggtggggtatgaggatttccttgaaccccctttttagggccagaggttggactcctggggaattcattatcaagtctggctgtagacagaggtcctctctgtagaaaaaacatgagttaggatggtccagtccctttattccacagaaggggaaagtgaggctcagagagggacagtgtcttgcccaaggccactcaaccaggcagtggcagagaaacagttggctccagagctcctgacttgccagccccatgtacctccaccttgatccagtagccagtgtttgttgaatgactgagtgtgaatgagtgagaacacattcctaacacattaggaacacaggctctggagccagcctgccagggtttcatatcaggttcttccctgcacaagctgtgtgattttgagcacattctttgacttctctgaacctcagtttcttcatctgtaaaatgggtacaatcattgtatctgctgtacagagtgatcaggaggcttaaatgaggttacgtgtccaggcatggtggttcacacctataatcccagctctttgggaggccgagagttccagatcagcctggccaacatggtgaaaccctgtctctactaaaaatacaaaaaaattagctgggcgtggtggcagatgcctgtaatcccagctacttgggaggctgaggcaggagaattgcttgaacccggaacaaggaggttgcagtgagccaagattgcgccattgcactccagcctgggcgacaagagcgatactctgtccgcccccccccaaaaaaaaagataatttatgcaaagacttaaaacagtgtcaggcacacagtaagtgctgaattaaagctaactttcgccaggcgcagtggctcaaacctgtaatctcagcactttgggagagtagggaaggaggatcgcttgagccccagagtttgagacgagtctgggcagctagtgatgaccccatgtttacaaataatttaaaaattagccaggtgtggtggcatgcagctgtggtccctgctactcagtaggctgaggcaggaggactacctgggcccaggaagtcgaggctgcagtgagctatgatcatgccactgcactccagcttgggccacagagcaagactctatcttaagataatttttaatgaaattaatgacaaggacatggtggggggctgcaaacagatgtttccacagggagtgcacagtcctgccagtgacggagcaggtctccttcttggtttattgaaaagtcgaggaaaatgtggataattcatgtccagggacctgtagccaacagaaaaaagcccctgccttccccgactcagagctgctgtaatacagaagccacaagccacatggggtgactgagcacttgaatggtggcttaatatgagttgagacgagctgtcagtatcagttatacaatggatatcaaagatgcggtatgagcaaaggtcctgaggcagcttacctggcatgtctacgaacagcaaagcagtgagtaggagatgaaagcagtgatgtgatcttgtggtgtctgtttctgtgtctgtcgccccacttgactattgcttcctttggcaggggctgcatctgccgtgtacgtttccatagccacgggctggcatggcatctggcatatagtaggtgcttaccacatgtttgttgaatgaatgaatggatgttggtggtaactacatgcagctgagttaaactgagcccaaggagagagaggaccaaatgcctgctgtagtggacactggtgtgtgcccgggtcccccttctacacagaggcagtcactccccagctgctgggagagctggtggctgatggtttgtgcccagctgagtccctctctgggcatggccccctagaccccctaccccacgggtcagcacacctccaaagactggtgaatatggagtacaaaagcccggcccccttttccccaggcaggacagctctgctgtgctacttgagctccagaactttccccagggatgactgaggcctttgttgcgactgcatctgcatcgcagctcaactcctctgcctggtcctgctgacctcactcccacgcaggtgctgcctccaagagcactccccaataaacctgctcactcgtccgtgggcttccctgggaacctgacttgttactcttctcaagccataaccctgtcattcgtccattcattcagtaaatatgtactgaacagctatgccccaggcattgttttgggatccagcagcaaccccagacagaccaggactgtttgtgtagggatactggccatcgagtttttagatttcaccaagactgaatctcatcatctccagccccaccatggccatgacactcctgggaggcctggctgcttcagctccctagagtggcccttagaaggtgtggacaggtgtggggacaggaagggagcagacccaggagcccaggtctgtggagtcaggcagacccaggttcgaattcagcttagtgcttttttgcatttccctagtgactaatgatattgagcatcttttcatgtgttcactggcttttgtatatggtgttagtccacttttgttgctataaaggaatacctgaggctaagtaactcataaagaaaagaggttcgggcgcagtggctcacacgtataaccccagcactttgggaggccaaggtgggtagatcacttgaggtcaggagttcaagaccaacctggccaacatggtaaaacctcgtctctactaaaaatacaaaaattagctgggtatggtggtgcgtgcctgtagtcccagcaactccggaggctgaggcagtcaagacagtgcactacagcctgggtgacagagcgagactccctctcagaaagaaagaaaagaaaagagggctgggcgcggtggctcatgcctgtaatcccagcacttcgggaggctaaggtgggaagattacttgagcttaggaattcgagaccagcctgggcaacacagcgagaccttgtctctattataaataaaaacaaaaagttagctaccaaaaatgaggtggcgtgcacctgtagtcccagctacttgggcagctaaggtgggaggatcacttgagtctgggagactgaggctgcagtgagctatgatcacaccattgcactctagcatgggtgacagagtgagaccctgtctcgaaaaataaaaaaaaaaagaaaagaggtttatttggctcacagttctgcaggctgtacaagcatggcaccagtatctgttcggattctggtgaggcctcaggaagcttttactcttggtagaaggcagagcgggagcaggcatgtcatgtggtgagagagaagggaggaggtgctgggttcttttaaacaactagacctcagatgaactcatagagtgagacctcattgctgcaaggacagcaccaagctgttcatgagagatccgcccccataacccagacacctcccactaggcccaacctccaacactggaatgatgtcacatttcaacatgagatttggaggaaaaaaaacatccgaaccataccatataccttctttggagaaatgtctgtttaggtcctttgcttatttttatttttatttttttattttttattttttatttttttattttttttccaaggcagaagaatttttcttagtacagaacaaaatgaaaagtctcccatgtctacctctttctacacagacacggcaaccatccgatttctcaatcttttccccacctttcccccctttctattccacaaaactgccattgtcatcatggcccgttctcaatgagctgttgggtacacctcccagacggggtggtggccgggcagaggggctcctcacttcccagtaggggcggccgggcagaggcgcccctcacctcccggacggggcagctggccgggcggggggctgaccccccacctccctcccggacggggcggctggccgggcgggggggctgaccccccacacctccctcccggacggggcggctggccgggcggggggctgacccccccacctccctcccggacggggcggctggccgggcggggggctgacccccccacctccctcccggacggggcggctggccgggcggggggctgacccccccacctccctcccggacggggcggctggccgggcggggggctgacccccccacctccctcccggtcggggcggccggccaggcagaggggctcctcacttcccagtaggggcggccgggcagagacactcctcacatcccggatggggcgacagggcagaggtgctccctgcatctcagacgatgggcggccgggcagagacgctcctcacttcctagatgggatggcggccgggaagaggggctcctctcttcctagataggatggcggctgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggctgctgggaggtggatgttgtagcgagccgagatcacgccactgcactccagcctgggcaccattgagcactgagtggaggagactccgtctgcaatcccggcacctcgggaggccgaggctggcggatcactcgcggttaggagctggagaccagcccggccaacacggcgaaaacccgtctccacccaaaaaatacgaaaaccagtcaggcgtggcggcgtgaggctgcaatcgcaggcactcagcaggctgaggcaggagaatcaggcagggaggttgcagtgagcagagatggcagcagtacagtccagcttcggctcggcatcagagggagaccgtggaaagagggaagaggggaggggcagagggagagggagagggagagggctgctcatttttaaattgggtttttttgttgttgttgagttgcaagtgttctttatatattctagatactagaccctcatcagatatatgactagcaaatattttttcccattctgtgaattgtcttcactttttggataatgtcctttgatgcacaaaagtttttactttttataaagtccaatttatttttttcttttattgcttgtgcttttgctgtcatctctaaagatccatcaccaaacccaaggttgtgaacatttacccttctgttttcttttacgagttttacagttttagctcttatatttcggcctttggtccattctatacatagacagagaggttgaactttcttctttttcttattgttctagcattatttattaaatgattattttcccatggaatgaccttgttggcccttgttgaaaagccactgggggccgggtgcaatggctcatgcctgtaatcccagcactttgggaggccaaggtgggcagatcacctgaggtccaaagttcgagaccagcctagccaacacagtgaaaccccaactctactaaaagtacaaagatggctgggcgtggtggctcacgcctgtactcccagcactttgggaggccgaggtgggcggatcacctgaggtcgggagttcgagaccagcctgaccaacatggagaaaccccgtctctaccaaaaatacaaaattagccaggcgtggtggcacatgcctgtaatcccagctactagggaggctgaggcaggagaatcgcttgaacctgggaggcggagtttgcagtgagccgagatcgcgccattgcactccagcctgggcaacaagagtgaaactccatctcaaaaaaacaaaacaaaacaaaacaaaaaaccaaagattagctgggcgtggtggtgcgtgcctgtagtcccagctaatcaggaagctgaggcgggaaaatcacttgaacctgggaggcggaggttgcagtgagccgaggtcacgccactgcactccagcctgggtgacagaacaagactttgtcttggaaaaaaagaaaaggaatagatgtatgggtttatttttggacactcattctgtcctctggatctatatatgtctgttctcatgtcagtaccacacagatttcattattgtaggcttagtgcctttttgagcctcagttttttttctcccataacgggagggagggcagaagtaggtctctggtaggggtttgtggatgaaatgagctggaatacatcatagcagctagcagcatgcttggcctgtagttgtagtggaagcattactgttattatcatatccaagatgtagattgtgcttaaagactcctcaagagagctggaaatgtgtatcagtcagtttaggctttaaaacaaaataccatagactaggaaacctacaacagaaatgtattgctcataatttctttttcagatggggtcttgctctgttgcctaggctggagtgcagtggtgcagtcacggctcactgcagcctccacctcctgggctcatgtgatgctcccacctcagcctcccaaagtgctgggattacaggtgtgagccactgtgcccaggctgctcatagttctggaggtgggaagtccaagatcaaggcactgggagattcagtgtctggtgaggactcatattctagcttactgtgtcttcacaaggtggaaggggcaaaagagctctctggggacccttcttaaaaggacactaatcccattcatgagggctccatccttattcatgagacctaaccacctcccaaaagacctacctcctaacactttcacgttgggaattaagtttctttttctttccttttttaaattttctttttacattttttcccttttttttttgagacagagtcttcctctcgtcgcccaggctggagtgcagtggcacattcttggcttgctgcagtctccgcctcccaaattcaagtgattcccctgccccagcctcctgagtagctgggattacaggcacccacaaccacgcccagctaatttttgtatttttagtagagatggggtttcaccacgttggccaggctggtctcaaactcctgaggtcaagcaacctgcccacctcggcctcccaaagtgctgggattacaggcgtaaaccaccacatccagagtattctagttttttgagactatacaataaattatagttaaccacatacagtggaacatatgaatttgggaggagagggcacaaacattctgttcacgccatggcagtgtgccgtggacagcagaaatcactactggtgcagagggctagagagtgtcagtcatcaggcactgaggtgtgactttaccctattctacccatgctcccttgagcccagccctgggcctgcgtgaagtggagaaaaaggggcaccagaggccaagatgcatcgactttcacatgacctggtgatactctgtgagtgagagagcagaagtttgcttgtcactgagtaggggagggctgggccccagaatcattctagggtcccacccccagacattccaatgcaggaaggctgtgctgcagccctggaacctacagttgtccccagatgttgtgttcttgaaagaactgtgcagtgaacatcaatcacccaccatgcggattccacaatgaacagttgactctagttgccttatctcagctctagccacctgtccttccctctatccacccatccatccaccttatttcttatctttttttttttttttgagatggagtctcactctgtcgcccaggctggagtgcagtggcgccgtctcagctcactgcaagctccgccttccgggttcacgccattctcctgcctcagcctccagagtagctgggactacaggtgctcgtcaccacgcctggctaattttttgtattttttagtagagacagggtttcaccgtgttagccaggatggtctcaatctcctgaccttgtgatccacctgccttggcctcccaaagtgctgggattacaggcgtgagccaccacgcccagccatccaccttatttcttgttgcatttcaaagtaagttgcatccaaagtaagtaagagacatccatccactgcccctttgcatactttggcaggcatttcattaaatacagttcaaaatttgtgtgcgtgtatgtgtgtgttttcataaaacctgtatttccaaaaaaaaaattccccagagtattcttccacggtgccaatccaggatagtgggtaagacgttatgttaagaaccaccatcctgattactgagacacctaagaggaaccctttataagggttcccagggtggggatgggttcctggctctaccttctcctagctgtgtggtctggggtaggtcacatcacctgtccaagcctcaatgtcctcatctctaaattgggcttaagaaaagtatctacttcttagggttgtcatgaggaataactgagtctctgcacatgaagtgactggcatggtgcttggcacatagtaagggctcagctaataacagcttttgctattttgaagatgtcactgtatggatacccttccagaacaacccattttattttattttattttattttttccttcaagaccgagtttcattcttgtcgcccaggctggagtgcagtggcatgatctcagctcactgcaacctctgcctcttgggttcaagtgattctcctgcctcagcctcccaagtagctggaattacaggcacgtgccatcatgcccagctaatctttatatttttaccggagacagggtttcaccatgttggccagcctggtctcgaacttctggcctcagatgatccacccaccttggcctcctaaagtgctgggattacaggcgtgagccaccacgccccacccagaacaaccccttttcttagtgtagtagggttgtttctggaaaccagaagcatttttggcctgattggcctgggaactggtgaacgagcagattgaggataaagccaaggcctacaattcctctcaccttacctttgtcctcactggtgcaggtggcaggaaaccgccttccaaggatctttgatctcactgggaagctggagctcggggaggctggcacagggggttgcttcaggcctgagtgtgagggtgatggattgtggtgtgggggaggggggataatcctccctagaggggaggcttacccaacatgtgtcaacagaccccacttgtctgctcatgactgtaatttaaaatgctgattttgcaactcttggagctggtggaacactacagccccttggctattttgcaggagatttaaggacctgcacgttagtgaacatgcaggctgccttggtgcctgaagcagaggtcacgttctagagagagtttgcagattggaagcccacgggccagagtcagtccatggatgactttctggggcacatggtttgtttttgttcctttgtttcagaattgaattgtttgccagcattttttttttaaacatggaaattatacatgaaaatgtcttgagctgggcgcggtggctcacgcccgtaatcccagcactttgggaggccaaggcaggtggatcatctgaggtagggagttcgagactagcctggccaacatggtgaaaccccatctctactaaaaatacacaaaattggccgggcgtggtggcgggcacctgtaatcccagctacttgtaaggctgaggcaggagaatcacttaaacctgggaggtggaagttgtggtgagttgagatcgtgccattgcactacagcctgggcaacagagttagactccatctaaaacaaaacaaaaacaaacgaaaaaaagaaaatgtcttgaaaaatcagatctagcaacaatgggcccacagtcctgcacgacaaccaccggctgagtgtgatggacccctgttgccgggacatcagaaggccagtttgcccctgctacaccagggttacctgtctgtctgctgctgacaacttagtttgagaacccaggctttactggtaagatagacacagacacaactatttatggctcaaaacagagggcagtgagtattgtagcttaggacagtggttctccatagaggtgatttagtaccctaggggacagtggcaatgtctgaagacatattttggttgttgcaacttgaggagggtgccatggcatctcgtgggtggaaagcaggggtactgctccatatcctgcagtgcacacgacagcccccacgacaaagattatccagccccagtgtcagtagggctgaggttgggaaactgtggattaggggcaccaccaaactggtctggaaggaagaggttaattccagtggtggggctcaacaaaggctctgtgaagagaagaggtcttgctgctgagcaggcacttgatgactaagccaggtttcaactgagagcgactgagggggaggcatgtcaggcagagaacaaacaacacaagcaaaggtctagaggcacctttgatgggtggaggtgggtgagagtgtgaacagtgagatggagcctgtagttcaagatacatgaagtttggggtcaggtggatttgggtttgagttctgactctgccactcactagccatgtggcttcaggcttgtcattggcttgaacctcagtttcatcatctgtaaaatggggataagacatgaggttatgtagagccagactcatctatccccagtcctccatttctactctgtgtcccagccatccttaactactggcagtttgctacatgcttcttgctttgtctcccctgtctggcccctccatgtgcagttccctctgcctggaatgctcacatgccagatgtgtggattacaccatcaaggtgttataaacccggtgctgacatgctaagacttgtgttttgaaaagatcactctgccagcaacatggtgttgggcttgtgggagcaggtgcagggaatctggaggccaagggaatgatgggggattcccaggctcatacaagaagcctgggggcttctcccttcacgctaactcccttctccgtcacttctctgtccttaaggtacctcgggggaaggtcagtgaggacccaccaggcatgaacgggttggattctctcttggttaatgttcctgctcctttctcagcctaggagcctggttacttcataggtcagggttgaggtgttgtattagtctgttctcacactgctataaagaactgtccaagactgggtaatttataaaggaaagaggtttaattaactccagttccgcagggctgggaggcctcaggaaacttacaatcatggcagaaagggaagcaaacgtccttctttatgtggcagcaggaagaagtagtgccgagcaaagggggaaaagcaccttataaaaccatcagatcttgtgagaactcactcactatcacgagaacagcatgggagtatccgcccccatgattcaattacctaccacggggtccttcccacgatatgtggggattatgggaagtacaattcaacatgagatttgggtggggacacagccaaaccatattaggtgtagaggccaaaacctcatagaggctactgagagtctatgggccagccctctagcttccttaagcctcagtttcctcacctgtgtggaacagtcttttcagggtctgtgggggtacatgggatacttcctacaaagttcttacaataggacctggctcaattttataaaaatgaagctcttggccgggtgcggtggctgacgcctgtaatcccagcactttgggaggctgagcgggcagatcacgaggtcaggagtttgagactagcctggccagtatgacgaaaccccgtctctactaaaaaatacaaaaattagccaggcgggtggcgtgtacctgtagtcccagctactcaggaggctgaggcaggagaatcacttgaacctgggaggcggaggttgcagtgagctgagatggcacaactgcactcctgcctgggtgacacagcgagactccgtctcaaaaaaaaaaaaaaaaaaaaatcaagctcttgctgaatactctctgaatgcctggtactgcaggaggccctgggaactcaaagtttctcttaagaactgaccttgactttaaggattgcctgatttaggatctgtggactttgctgactggggacatccaatttttagggagagattcctgggaattttatttgaaggatgcacaaaaagatttagcttttacgggtggatcacgaggtcaggagatcgagaccatcctggctaacacggtgaaacctcgtctctactaaaacaaagtacaaaaaattagctgggcgtggtggcaggcacctgtagtctcagctactcgggaggctgaggcaggagaatggcgggaacctgggaggcggagcttgtagtgagcccagatggcgccactgcactccagcctgggtgacagagtgagactccgtctcaaaaaaataaataaataaataaataaaaaagatttatcttttaagtaggtccacagtggatatatttataaagtgaaaaattggaaatagccttaatgtccaactgtaggatattggtttaatatgtgataagacaaatcgagtattatgcagtcattcaagaggaagcagatggatatttgctgatacagaaagatgttcattattaagtgaaaacaatatacaaaacactatttgtatatcagtaataggccaggcatggtggctcacgcctgtaatcccagcactttgggaggccaaggaggcaggattgcgtgatcccaggagttccagaccaccttgggcaacatggtaagaccctgtctctacaaaaaatacaaaaattagctggacgtggtggtgcacgcctgtagtccgagatacttgggaggctgaggtaggagaatcacctatgcccgggaggtgaacgttgtagtgagccgtcactgtgccactgcactccatcctgggcaacagagtgagaccctgtctcaaaaaaaatacacacacatattttaaagcctaaaggctaatataccccaaaattaacagtgggtatctataagcggcttttacaattattttcttgttctacatttttcccctattttttttacaataaatgtgcatttcttgtctgaaaaatagcaatatattttattaaccttaaaattatttgatgctattaaaatataactgaaaataataataaaagaaaaggcaagtttgccagctctccccgtctccctccccagccttatctcctgactggattcttgctcactcccaataaacacggactcttaattcgtttcagtatttactaacctcaaaacaaggcaatgtaaagatgaataatcatactctgtaggtgatctgcatccacgccaaattttgagatgcgttgaaagaggaagttctttacctctctgccttcaattatttattctcgtttaacccatttcctccgttcattcctaacttgagggcgtttatttacttttatctacgcatgcgcactcctggctgctagagagggcctcttcgcccggcggtcccgccttctgacgtcgaccattggccggctctgccagcgcgctcctgattggtggctgagggccgggccccgctgcttctcaaagttggcgggaaagcggaggcggggcggaagggtgcggcgaggcggaatggcggcggctgcggactcgttctcaggcggccccgcgggggtgcggcttccgaggtcgccgccactcaaggtgctggcggagcagctgcggcgcgacgcggagggcggcccgggcgcgtggcggctgtcacgggcggcggcgggccgcgggccgctggacctggcggccgtgtggatgcagggcagggtagtgatggcggaccgcggcgaggctcggctgagggacccgagcggggacttctcggtccgcggcctggagcgggtgccgcgcgggcggccctgtctagtcccaggtaatgcccgggccttaccgggcgccctcttccctgctgcccgccgagaagttgccgaggccagattcgatcttgttgttgacactcgaacgggggcggggcgggtctggccctcctccgggcctctgcccctgcgggtccccgcttgggtacccttgctccggtccctccttggtgaagttgatctgatgataagcatcacctgccgtcccttttacaaatacagattcctgggactctcccacccctagtgggaatcttctggggagggactccggcaccttcgtttgtcacaagccccctctcccagttgatatccttgttttgggaaatactgtcctgggaaacttctgctcatccttaacgtctcagctcaaatgtgcctttctcagggaagtcctccctagcccctaggaacgggagaccctcctgtacttctccttaattgaactgtcttgggctgtagctcactcatgtttgcctcctctcttttttttttttttttttttttgagacggagtctcactctgtcgcccaggatggggtgcagtggcgcgacctcagcttactgcagcctccacctcccgaattcaagcgattctcatgcttcagcctcccgagtagctgggattacaggcatgtgccaccacacccggctaatttttgtattttttagcagagactgggttttgccatgttggccaggctggtctcgaactcctggcctcaagtgatctgctcatctcggcctcccaaagtgctgggattacagacatgagccgctgcgccctgcctgcttcctctcttaaaccactgatgctcaaacttgagccagcatcagtctctcctggagggcttggtaaagctgggatggctggggctccaccctcagggtttgtgagtcaggaggtccaggtggggctggaaatttgcatttctaaccagctcccaggtgatgctgatgctgctggtctggggaccatactttcgactttttaaatgttttatttatttgagataggggactcaccgtgttgcccaggctggccctgagctcaagcaatcctcctgcgtcagcctccttgggtagctgggactacaggcctgtaccaccacgcctggtttgggggccatactttgagaaccactgggccagcccaagctactggagggccagagctgtgtggtcctgacaactgtatcctcagcatctggcccagttcctgacacataagtgctccaagaaccaatagtcttgagtgataggcaatgggcatccatctcacttgttccctgggatgtcagttgagcacgtgttgtacatcagcccctcatgtgcagtgttgggctgcagccgagacctagatagagtctgctgggagacaggcagtgagcaagtgtcgcagaggatcgctgatctttggggagccatgaggatgtgcaaggtgctgagtggcccggggaggcttctagaggatgtgaggtctaagctgaggagctctgaggctccatgggccttccctcacctcagctccctctcctgggaaatcaggccaagatcacttcattcctaagggcccttcctgctcagtcttggagtctaactagaggcagatagggctgtggtctggcctgagctgctgtggactcggaaaggcttaggtcgaatttctggttccaccccttcccaactgagctgcctggagcactcttgttaacttttctggacttgtactattttgtaaaaaggagctaatcattcctgcgtgttgtgtggattcaataagtaaacaactgccttagtactgcacctggctcacagtgaggatgcaaaatatcaggactcgtttactgccacatgctcctgttccgtcttcccactgccttacccatcagccttccctctgtctgcctgccctcagccgcagcgttggtctaggacagggtcagcaaactacaggcctcctcttttcatgtgtcctgcgaactaaaaatgcttttaaaatttttatgtattactattattatttttgagacagaatctcgctctgtctctcaggctggagtacagtgacgcagtcatggcttgctgcaacctccacctcctgggttcaagcgattctcatgcctcagcctcccgagtagctgggattacaggtgtgcaccaccacacccggctaatttttgtagttctagtagagatggggtttcaacatgttggctagactggttggtctggagctcctggccaccttggcctcccaaagtgctgggactgcaggtgtgagtcattgcacctggcaggatttcacatttttaaatggttgaaaagaaaatcgtgatatgtgaaaagtatatgaaattcaagcatcagtgttcataagttaagttttattggaatacattggtaatttacagaatgtctcgggccgctgtcccaccccagctagaattttatctgggacagagaccctatggcgggaaaagcccaaaatatttgtctcgccctttacagaaaaagtttgccaacccttggccttagccttggcccagcaagtaacccatgctgcttggtgtgttggtttgcaggcaaagcaccttgcaggcaggctggggcagtctcctatctggtctcagccctggcataagcctggcatctagtaaataagtgtttgaacccatgggcattggtgaacctgtctgacatacccactggcctgaatgccagctggcaggggccatgtcatttcttcttgttaattaatactgagtccagcttgacaaaattgagtcactgccatcagggaggcagggaggtaagcgggccactaaaacacaaagtaacattgcaggcaagagtgaggtggcgcagaggagggacagctgatctaggtttgagggctcagggaaggcttcctggaagaggcagccctgaaggatgcattggagttatctgtaaggaccaaccctcctgggttgcctgggactgagagggtcctgggacgtgggactttcagtgttaaaactgggacacttgggcaccctctgtctgtgtgcagtggcaggagattgtgcagctccatggagcagcctgtgcaaaggcttgaaggggatagagccgcgtgcctttggggagcctggggcagtggtggaaggtaggagggctctatcctgatgagcctcattggctgtctggaaggacctgcctgcttcaagatggccttgaactctgctcactgcactgctgctgtagtgctgttcctccaccgcctcttcctctggaacatccaggagtttgtttccataaacctaaggtgctgaagaggcagagttgaaggagaagctcttcctgccctcaagctgctctctgtctgcaggagaatcagagaaaccatgcttacctagatcgcgcttggatcaactgagttctggaggcaggaggtggatttgacaatgttgactgcagcagtggggtggggatggtttcgaagaggaggaagctggcaggagatgggctggagccattggaatggtcatggcaaccgcggggtggggatgcaggaaggagagggagagacagcggagagctgctttggagtgggagagggtgtgggtagaacctacaaggtcaatttgtcccatcgcgtgccttcgagttcatccggctggctgtgtgtgccttctcagtagagctcctgttcccctctcccggttggaatgcccttgggcttgtttttctcttcgtgggccttcagtcattctacttctgtgtgttccaaccctaccagcactttaggccccttcagaggggatggcaagtgcattttcagaactagcctctgtcacggagggacccaggtggaatgtggggttggagttctgagatacttgagcacatcctgcctggggttgaacagcaggatcaggggtcagcttgcctggggcttcagtcaaagccccaggccccacgtgcagtgcaatgaaagcctcacggggcaggcagcagggctggcaccgggcctgtccttcctgcagcatttggagttttcttttacacaatcgggttttatgtggttgagactggccaagttttgctttcaaggagagtcacttccccaagggaatgggaagagagtcacagttaatacgtcattagatcatgccggtggcagccggcccttgtgtggatttgcttgtatgtgctggaggaggtggcagggataggtcccagcagttggaacaatggggcggggggctgcctgcccagccttttcggcaatgtggagggaaaattggattgcttagtaactgtcagagggtgtctgcagaaagaggatgtgtcctgtgcacagaaaccagtcacatactctgtagcattgagcaaggaacaggattagaggaaagctgaggttttctgcccctacctcagagccgcctaattataactcgctctgatgggagcgtctcctccattccttgggcgtggttacattttacatgacagttttgtttggcctagtaaaatcagaaaccaaagaagatggctgggtacagtggctcatgcctataatcccagcactttgggataccaaggtgggtggatcacctgaggtcaggagttcaagaccagcctggccaacatgtgaaaccctatctctactaaacatacaaaaattagccaggcatagtggcaggcacctgtaatcccagctactcagaaggctgaggcacaagaatcacttaaactcaggaggtggaggctgcaatgagccgagattgtgccactgcactccagcctgggcgacatagcaagactctgtctcaaaagaagaaaaaaaaaaagaacattactatgggcttttcttctttttctaggaaagtatgtgatggtgatgggagtggttcaggcctgcagccctgagccctgcctgcaggctgtgaagatgacagacctttctgataatcccatccatgaaagtatgtgggaactggaggtagaagatttacacaggaatattccttagagtatgttggaactgtcgttaaaaacaaccaaaatcccgaaactatttagaagcttataatgatgtggatttcatggacacttttcaatgcgtatttttcaaatgcttctcagagagccttgctttggttgaccaaggagtccggatgtaggaatgtttaaatcctcggatacttcagtgacacagcctctgctgccccttgctttgcctgtgtttgctgatgaaaagcagatgcttgtgtttcattttccttcctggtttgtgtgtgttaattctctctctctctctcagacacagaagtctcatgttgcattttccaaattttatgagtgatgatactttttccattactgctgcgtccctgttttacaatgcaaaatttaagtacggtcgttgcccatggtgattaaagtgtggttatgggcaggaagacagactgtgtaaaaaaggaatgacatcctggctcctcatcttcttcatcagcaactaccataaccagtttgcgagtcaaatggcatttcctaacggcaggcatggcggcccctgaaagacaacagctccctttctgcttcggacaccactcaaacatttagacgcagctctatcccttttcctagctagagaaggtgatgccttcttccattactcagagatgttgagacgttttcagaatttcttgttgaaatgaaaaacatcaagataaaggacgcctttcaggcattagctaaacttccacttcataactttcggcgagacatggtgagcctcctggtgtagagttcttttgtctttgtatggaatgactttttgctgtgatggttttgaatgttgggtttctgctgtctgcttagtacccatgcctgaattttttgagattgtaaatatcaaaggagttagattgtgttctgacatggttgtagactttcacctggattattgatattctacctctaataaatttttaataggctg

SEQ ID NO: 708 - DNA, 63900 bp, Homo sapiens
gcaggacggcgcgaaaacccaattgacaagaattccctccgaagctctgtggtccgatctgcggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatctgggcccagcctccgctcccgctctctgtcggtgggcgcgggggaatccgaaacggctcagcagaatcccagcagcttgctgctactggagcgggccgcctccatggcctccaggcaggccgggctggaccgcgtgaggtcctaggagacgggattccgggaagcggggagtatggtgggggtcctggccatggcggctgcagctgctccgcctcccgtgaaggactgcgagattgaggtgaggttgagtcgaggatctgttgagttccttcctctatcttttgggggattggaaggtgggtcttggcggaaggtgatcctgactttgtaaggggaaaggtgggacattgtgaggacccacagctgtgacacattgtgtgcaacagttgccagagtgtgtcgtttagagtcgtgtcaagtcctgataaacatttggattctgagatatttgcggggtcacagtaaattggggacttaagataacacggccagttcccagatcccgaaatgttggtggaacgtgatgttttggacttccgacatgtcacagaggatcccagggtcaagttctgggttcgtgatacggaatcactgaactttagcgctgaagaagatctttaagttaaactagttcatacatccacctgtgcttggaatgccactttagaatgtcactacagaaatcaagcaaggtacttaaagaaaacagtttctcatggcttagtatctgcggttaggaatcgcagtgtaacatgttcttttgggtttatcaggtttcagtgacaggcactaagcggtcattataaagagattctaatgccatgaagtagtgggctagcatcttaaggtagacttgttatattttacaccttttcatctcagactagcattctaactgaagcatgtatcttggcgtccttgaagagagttaagatgtatgtatgttcatttaactgcgaccagttgtttttttcagaatctggtgacttgtctacttagtttttgtttttgtttttttttgtctacttagttgttatgctgatattcctttgctaaatcaaggcagttagttactcagcttgtcttctggtacttgatgtacacagttcttgatttctatgtggtctgttttatcaatctttccgttacagtttctggttttggtgccctaatgctaagaaaccctatttcataataatgatacttaccatttaatatgttaggggtaagaaccttaaacacattattttgcttaatagcaaccctatgatctattgtctgtattctacaaatgaaagaaggtaaaaagtagctaaaagtaagttaaattttttgaaaaattaaatggaaaagttaaaagtaatttgcttaacgttttacaccagtaaatgtcagagccagcatttaacttagatttgcctgactccagagcctatgtatgttgcctttgatacaattgcagctttataaataataactgaatggcgtttttctaatacatgtatggtttctttttgttttttgagacaaggtcttgctctgtcacccaggctggagtgcagtggcacaatcttggctcactgcaacctccgcctcccaggttcaagtgattctcctgcctcagcctccggagtagctgggattacaggcgtgcaccactatgctcagctaattttttgtatttttagtagagacagggtttcaccacgttggccaggctggtctcgaattcctgacctcaagtgatccacccgccttggcctcctgaagtactgggattacaggcgtgagccaccgcacctggcctggtttaactttaaagcctattttctttctaatatatcacgtttttcacctaaaggaggcttcctttttttaatcctattatgtaaactattagatccatgtttaaaatttatattttgtattatattgcttgaaataagtgcctttttctcttttaaattgccagccatgcaaaaagcgaaagaaagatgatgacacatctacctgcaaaacaattacaaaatatttatcaccactagggaagactagagacagggtttttgctccaccaaaacctagtaatattctggattattttagaaagacttcacccacaaatgagaagacacaattagggaaagagtgcaagataaagtcacctgaatcagtacctgttgacagcaacaaagactgtacgacacctttggaaatgttctcaaatgtagagtttaagaagaaaagaaagagggttaatttatctcatcaactaaataatattaaaactgaaaatgaagctccaattgaaattagtagcgacgatagcaaagaagactatagtttaaataatgattttgtggaaagtagtacttctgttttacgttacaagaaacaagtagaggtacttgcagaaaacattcaagatacaaaaagtcaaccaaatactatgacctccctgcaaaattctaaaaaagtaaatcctaaacaagggaccacaaaaaatgacttcaaaaagttgagaaaaaggaaatgcagagatgtagtagatctatctgaaagcttacccttggcagaggaactaaatttgcttaaaaaagatggtaaagatactaaacagatggagaatactacaagccatgcaaactctagagataacgtaactgaagcagcccagttaaatgatagtataataactgtctcatatgaggaatttttaaaaagtcacaaggaaaataaagtggaagagataccagactctacaatgtcaatttgtgttccttctgaaactgtcgacgaaatagtcaaaagtggttatataagtgaatcagaaaactccgaaatttcccagcaggtacgctttaagacagttactgttcttgcacaggttcaccctattccgcccaaaaagacagggaaaataccccgaattttcttgaaacaaaagcaatttgaaatggaaaatagtttatctgatcctgagaatgaacagacagttcagaaaagaaaatctaatgttgttatacaggaggaagaattagaattggctgttttggaagctggaagttctgaagctgtgaaaccaaaatgcactctagaagaaagacagcaatttatgaaagcatttaggcagccagcatcagatgcacttaaaaatggagttaaaaagtcttctgataagcagaaagaccttaatgaaaaatgtctatatgaagtaggaagagatgataattctaaaaaaatcatggaaaattctggtatccaaatggtttcaaaaaatggcaatttacagttacacactgataaaggaagttttctgaaggagaaaaataaaaagctaaagaagaagaataagaaaacattagatactggggctattccaggcaaaaacagagagggaaacactcaaaagaaagaaacaacctttttcttaaaagagaaacaatatcaaaatagaatgagtttaagacaaaggaaaacagagtttttcaaaagcagcactttatttaacaatgaaagtcttgtttatgaagatatagcaaatgatgaccttctaaaggtttcctctctgtgtaacaataataaattgtcaagaaaaaccagcataccagttaaagatattaagcttacacagtctaaagctgaatctgaagccagcttgctaaatgtttccacgcccaagtcaactagaagatctggaagaattagcagcacacctactacagaaaccattagaggtattgattctgacgatgtacaagataatagtcaactaaaggcttccactcaaaaagcagccaacttatcggaaaagcacagcttatatacagcagaattaataacagtaccctttgattcagagagccctattaggtaaggtttgtttttgttctaacgttctagtattctgcatgtattattagctggggacaaaaatgcttcaagtattggagggtatttttttttctagaacacagctgtttaaaagaaaaagaacaggatttcttttttttttttctttgagatggagtcttgctgtgtcgcccaggctggagtgcagtggggcaatctcggctcactgcaacctccacctcccaggttcaagcaattctcctgccttagcctcccaagtagctgggactacaggcacccgccaccacgcccagctaatttttgtatttttagtagacatggggtttcaccgtgttggtcaggctggtcttgaacccctgacctcaagcaatccacccacccggcctcccaaagtgctgggattatagtcgtgagccactgcgcccggcctggaagaaaaagaacagagcttcaaaaatgcttctttgtttgccacatgtaattaaattttttttttaattttaatttttaatttaatttaattttattttattttgagatggagtctcactcactgttgtccagtctggagtgcagtagcacaatctcagctcacgacaacctccaccttctgggttcaagtgattctcgtgcctcagcctcctgagtagctgggattacaggtgcgtgccaccatacccggctgatctttgtatttttagtagagacggggttttaccatgttggccaggccagtctcgaactcctgacctcaagtgatctgcctgcctcggcctcccaaagtactgggtttacaggtgtgagccaccacacccggcaagtttgattacttttgaatcagtggtttgaaactgatgggaattatttttttcctcctgtttcagaacattccagaaattggagccctagttggttctttgctgtctatctatctgtctatgcatctctatctatctctctggaaacaagttctcactgtgttgcccaggctggtcttgaactcctggggtcaagcaatccttccatattagggtcctgagtagctgggattacatgcagatgccactgcaccagctctattttatctatatttaattgagattcttgtgtatgttataatcatgaaaatgtttctgaataccttatttttatttcagaatgaaattcaccagaattagtactcccaaaaaatctaagaaaaaatctaacaaaagatctgagaaatctgaagcaactgatggaggttttacttctcagattagaaaggtaattaaaatattagagagtcctataagtgccattctgtttccttaaaaaacaaacaaaaaacccccacattactatgggaagtaatgagccaaaataaaattcatgtatttcataaattggttaactacaaccctatgatatttttcactattatcctgttcctctagttaattaagatatcttattgtgaggtgaaagcaattgataaaggcagagtataatttacttataaaaagctttcttagtgagtttacatcgtgatcatttttcctaacactgccgatcttagtttgggctcctgtagcaaattaccatagactgagtggcttaaacaacagaaacatatttctcacagttatggggattgagaaatgcacgatcaaagcatcagctatgcagtgtctggtgaagctgtcttcttgttttctcacatggtagagaacagctagagagaggggtctccaccctcatgacctaatcacctcctaaaggccctacctcctaataccattacatagtgggttaggattccaacatatgaattttcaggggatgtattcagtctgtaacactgcctataggtcatgattgaatttttcatttatttctatagattatagagactgaaaagcagagtttctcaaccttgctattattgacattttggctggataattctttactgtggagggctgtcctgtgcattgtaggatgtttagcaacactctggcctctatccataagatgccagtagcacccaactaactcctgtataatgacaaccaaaaatgtgtccagacattgctaaatatccctcggaggggaaaataatcacttccacttgaaaaactacagctctaaagggagaagtaagatacataagaatggtttagttgtttcggcaaaataagctccttgtccccaccatggcagaattggagtaggtacaggtatgtgtatttcgaaaaagccaccaaggtgactctgaattaatccttgagtgaaaaccactgctacattggtatctcctttggttttatttaacagctgtcattttttggcatcttaccacattctaggcagtgtgcttagtactcacatcattaatctcataaagtaaatattatttaacccttttttatagatgaagaaacttgctgttagttcatagggtgaggaaacgtgtttttatttgtgattctgggaagtgtctttcctagagttatacaactacaagcagttagaaagacggtctttagtcttttggaaaacatgcgagatgccagctgattgtactacagctaaaggttgaaagtctctttggtgaactttgtcccacatattttattcttcttgatttcattctagaggacagcttcaactttaatttttttagagataattataccttggtttgcctcatgtactacttaaaattgggatttaatagtaaattttccagcaagagaagtctcaaaattaaatgtatccaaattgggacctttatccaaacttacttagatcagttattttatctcatactctgtcaatggacttcttaccacagggcccttgttgttcactgaagacttatccagccttgtgtactagctctaggagaaaatcttagtaattttctgggtgagatttttcttttttatttcttttttcttttcgtttgttatttttgtagagacagggtcttgctattttgcccaggctggtctcgaactgctagcctcaagcaatcctccagccttggactcccacagtgctgtgctggttggtattcaggcatgagccactgtgcctggccagatttttaatgtttctatgagaataaggagtaaactggttcccctaagagccccatattcataacagcttattgtttatcctttcagataatagtttaatagttagatttttttctctccagatattttttctctgcttaaatagatatatcttttttttttttctttttgagacggagtcttgctgtgttgcccaggctggagtgcagtggcacggtctcggctcactgcactctgcttcacgccattctcctgccttagcctcctgagtagctgggactacaggcacccgcctccatgcccagctaatttttgtatttttagtagagatggggtttcaccgtgttagccaggatggtctccatctcctgaccttgtgatctgcccacctcggcctcccaaagtgctgggattacaggcgtgagacactgcacccggccatcttcttttttttttttttttgagatggagtttccctcttgttgcccaggctggagtgcaatggcgcgattttggctcactgcaacctcggcttcctgggttcaagcggattctcctgcctcagccgccccaagtcgttgggattacagacgcccgccaccaagcccagctaatttttgttatttttagtagagacgggggtttcgccatgttgacccagggatgtctggaactcctgacttcaggtgatccacccacctcggcctcccaaagtgctggaattagaggcatgagccactgtgtccagactctttcttctttatcatatataagaagcttgaggctgggtgtggtggctcacgcctgtaatcccagcactttgggaggctaaggcaggcagatcacctgaggtcaggagtttgagaccagcctggccaacatggcgaaccccatctctactaaaaatacgaaaattagctgggtgtggtggtgtgcacctgtagtcccagctacttgggaggctgaggcaggagaatcacttgaactcgggaggcagaggttgcactgagccgagatcatgccactgcactctagccttggcagcagagctagactctgttaaaaaaaaaaaaaaaaaaaaaaaacaaccttgaggccaaggtccatgtattataatactgttttctttatagtatccagcctagagccattcatatagtaggctgggtaactgtttggatttggaaagtactttgcctgaatttggtgactaaaattaaaaaatagattgccaagtctatactacagacatcctcttgggtgttttgctcacatgtaaatatatttacctggatgatttcaagtaagaaataaaggcaaactaatgataactagacacatttcaatttaaggcccctggtaagatttgaataaccatttctttgttgattatttaatgtgatttgtgattgtatttttttctattattaaatataaaatattttcttgtgatgtaaattaatgtttcaattttttgtttaggcaagcaatacttcaaaaaacatatcaaaagcaaaacaattgattgaaaaagcaaaagctttacacatcagtaggtcaaaggtgactgaagaaatagcgatacccttaaggcgctcctctagacatcagacacttcctgaaaggaagaaattgtcagaaacagaagtaagtattataaatatctgttggtataaattctctcctattttgctgtttggagtgggagaaggaaaccattataaagttataaggtaggtttgtgtgatagcttgaagtggtagagagaatatcattttcagttttgctttaaaagccttctgcttttttttgtctgcagaatacagtttgaatccttcttaagtcactcaagatctttcataagctgaactacctcttccttttttttttttgagacagagtttcgctcttgttgcccaggcgagagtgcaatggctggatctcggctcactgcaacttctgcctcctgggttcgagcgattctcctgcctcggcctcccaagtagctgagattacgagtgtgtaccaccatgcccggccagttttgtatttttggtagagacagggtttcacagtgattggccaggctggttttgaactcctgacctcaggtgatccacctgccttggcctactagggtgccagccctcttgcctttcttcaaaacgactctttgctctagtcacacagaattgttcatttctccctaaatggtgcagttttcacggtatttgttttattgttatcagcttgaaatatacgttccaagtactctcttctatgtgaggaattcctacttaaactttgagatcctgctaactgccagtacctctttctaataaaatagtttgagatataattcatatacatgcatttcaccatttaaagtgtacaattcagtgacttttgtatattggaagagttgtgcatccattaccgtagtcaattttggaacattttcatttccccaaaaatagactcttttcttcttggttgtcaccccccaatcccctcattccaccagccatagctaactactaacctgcttctgtctctgtagatttgcttgttctggacatttcatatcaatggtatcatatagcatgtggttttttgtgtctggcttctattacttaggatgtgttttcaagatttatgttacagcctcagtatttcttttctttctgttgccaaatatcccattcatcacctgatggacatttgggttgttttcactttttggctattctgaacattttaccccctcctcttcaaagctgtgcttgtattcaagactcttctggttgaatatataaaaagaaaaataaaaacaaattaaaaaaataaaataatgggatgggcacagtggctcacacctgtaatcccagcactttgagaggctgaggcgggaggatcacgaggtcaggagtttgagaccagtctgaccaacatggtgaaaccccgtctttactaaaaatacaaacattagccgggcatggtggcgcgagcccgtaatctcagctactcaggaggctgaggcagaagaatcacttgaacccgggaggcggaggttgcagtgagctgagaccacaccattgccttccagcctgggtaacagagtgagactccatctcaaaaataaataaataaataaataaataaataataaataaaataaaatagtgaaaataatgaatactgtgcttgctgatgccttcaagacaaatattttctttcctgatatgtacttttgtatatttttttgtgttgatggtgcactcaccatgctgtattataactagttaaactatctgctcatgggctagctctccctctctcccctacattcagatgtaacatttgatgccaattcttgaattttgtctgtgtattcccaatttcttctatattgcttcacatatggtaagtgctcggtaaatctatgctgatgacaggaaaatcacagacttcattacatttctaggatgtacagttccaacagggctataaccagactttttatagcttggtcatattgactgttttatttggagtacagtctgttagttgctttttaaaaattttctgcatatgaataccaggtcatatgttagttgctttattttttagacagagttttgctcttgttgcccaggctagagttaatggcgcgatctcagctcactgaaacctccacttcctgggttcaagcgattctcctgcctcagcctctcgagtagctgggattacaggcatgcaccatcacacctggctaattttgtatttttagtagagacggggtttctccatgtttctcaggctggtcttgaactcctgacctcaggtaatcccccctgccttggcctccccaagtgctgagattacaggcgtgaaccaccgtccggcattagttgctttttcaaaaaagaaagcctttttgggcctggtggctcacgcctgtaatcccagcactttgggaggccaaggtgggaggattgcctgagcccaggagttcgagaccagcctggtcaacatagggagaacctggctctgcaaagaacacaaaaattagccaggtgtggtggtgtgcgcctgtagtcctggcttcttgggcagctgaggtgggaggatggcttgaggtcgggagtttgaggctgcagtgagccatgatcatgttactgcactccaccttgggtggcagagtgagaccctgtcacaatttaaaaaaacacatgaggccaggtgcggtggctcactcctgtaatccccgcactttgagaggctgaggcaggcggatcacctgtcaggagttcgagaccagcctggccaacatggcgaaaccccatgtctactaaaaatacaaaaattagctgggcgtggtggcgcgcacctccaatcccagctacttgggaggctgaggcaggagaatcacttgaacacgggaggcggaggttgcagtgagccaagagtacaccactgcactccagcctgggcgacagagagagactccatttcaaaaaaaaaaaaagaataaaaataaaaaagaaagcccatggtcataataaacgtaccctgatatcatataaacttgtttgatgtaagcatggactcctgctattctattgtgtgttttctgtttcaatgagataatatctgatgggaggtgtatggagctgctaattatgttttctgtggtttctatcactgtgattcttttgaaatttcaatgatattaattatatgatttaattaaaatttattctcttattttgtcttaggattctgttataataatagattcaagtcctactgctttaaagcatccagagaaaaatcagaagaaacttcagtgtttgaatgatgtgctaggaaaaaaacttaacacatccactaaaaatgtacctggtaatcagagttaataatatttatgatgtatattagaatgttttggggtttttgttttgttttgtttttgtgttctggggtatttatttatttatttatttatttttgagacggagtctcgctttgtcactcaggctggagtgcagcgccggcgggatctcggctcactgcagcctccacctcctaagttcaagtgattctcctgcctcagcctcctgagtagctgggactacaggcacccaccaccatgcccggctaattttttgtatttttagtagagacggggtttcaccatgttagccaggctggtctcgaactcctgaccttgtgatctgcctgtcttggcttcccaaagtgctgggattacaggcatgagccactgcacccggcctgtgttttggggtattattctgaacgtgcttatgattgaaatttagtatcttatgtaaaattttaactgtattatatttctattttagtaagtaaagttatggtatagtgaagagtttttctttttttttttttgtgacagagtcttgctctactaaaatacaaaaaattagctgggtgtggtggtaggtacccgtagttccagctactcgggaggctgaggcatgagaatcacttgagccctggaggtggaggttgcagtgagccaagatcgtggcactgcactccagcttgggctacagagtgagactccatctcaaaaaaaaaaaaaaaaaaaaaaaaagaaagtagctgaaggtggagatggtaaacattgatactaacccaagtatttatttttctaaggaaaaatgaaagtcgctcctttatttcttgtcagaaaagcacaaaaagcagctgatcctgtccctagttttgatgaaagcaggtcagtccaatacaaatttttaaatgccaaaatattttatagaatgtatttgtattgatgtgtttactttgatgagaaagcatgtgaattatcatttgaagctctagtaagtccagtttcaaagttgacaatattgacagtgctgcaactgctatttgaatatcttggttttttgcaagtgctttggccatcgctagacaaaacagaaaaataagcaaaccaaaaatacaaaaaagctgataatgaattttattcagtaaatatttaaatacctactagtatgtaccaggtactgtttttggtatcagagatattatggggataagacaggacacattccctgtcctcctgtggcttaagtggagatggaagatggtctatgattaaacattcattgggtcaacaaatgaaaaattgcagttgtgctaaggagaggtataattcatattgaggagggttggtctgattaaagaagacttcaatgaggaaatgatgtctgaactgaaatctgagggatgagcaggagttcatcaggaggaggaactgtgtttcagccagagagaactgtctatgtaaagtctctgtagctggaaggaacttgctaaataccaaaaactgatagaatgctagtgtgactagagcacagagaacaagggtgagaggtgggtgccagccaatgtaggacctaggaggccatgttaagggattttatcattatattaagagcaaataagaagcagccaaagggttttaaacataaatatagacctaaacagatttggattttagaagtttaattggcctgctggataaagaatggaatggaagaggggttagagtagatgtaggagtccaggtattgtgagatgatggaggtaaggactaggttgttgggaatgacatatgaaaagattttaggagatgaattaaaaatccctcgatgattaatgagatttgtgggagtgagagtgtgggagaggaaggtataggatgacatgtaagttctagtttatgcgcctgggtggcatgatggaaggtcaggtctaggagcaacatgggtttagattatctttttttctgttcaagttttactgaggtgtaattatatattgttaagcacacatatcttaagtatgcagttttgacaagtgcatcttatcaagaaataacaatcttctttttagctcagaaaggttttgtgtgctctttcctattatccccaccaccaccatcaccacaagattaccaaaatattcgatttctatttccatcaattagtttgatttctattaccatagattaattgtgtctattctagaacatcacataaacttcatatatatattattttgtgtctggctgcttttgcatagtatacacgcccacaaacaaatgcacacatacatatttttaaatcaacttcattcagttatattgtccatataataatatgtgcccattttaagtaaagagtttgaggtttttttttttttcttttttttttttagacggagtctcactctgtcactaggctggagtgcagtggcgtgatctcggctcactgcaacctctgcctcccgggttcaagcgattctcctgtcttagcctcctgagtagctgggactacaggcacgcaccaccatgcccagctaatttttgtatttttagtagagatggggtttcaccatgttggccaggattgtctcgatctcttgaccttgtgatccgcctgccttggcctcccaaagtgctgggattataggcgtgagccaccgtgtccagccaacagtttgaatttttctctcttttttttttttttttgagacggagtttcgctcttgttgcccaggctggagtgcgatggtgtgatatcagctcaccgcaacctccacctcccaggttcaagtgattcttctgcctcagcttcccgagtagctgggattacaggcatgtgccaccacgcctggctaattttgtattttagtagagatggggtttttccatgttggtcgggctggtctctaactcctgacctcaggtgatctggccccctcagcctcccatagtgctgggattacaggtatgagccaccgtgcctggcccacagtttgagttttgacaaatgtacatacctgtaattaccaccacaataaaaatatagaacattttcatcactctcaaaaaaaagtcttcttgtgcctcattgcagttaatttctgcccaatcccatgcaatctcttatctgctttctgttggtatagactagtttgccttttctagactctcatataaatgaaatcctgcagtaggtatacttttgtctctagtttctttggcaaggtagcatatcagttgtctgttctttttcgtagttaagtagtactcatatgaatatgccgctatatatatatagagagagagagagagagagagagatggagtcttgcactgtcgcccaggctggagtgcagtggcgcgatgtccgctcactgtaacctccgcttcctgggttcaagcgattctcctgcctcagactcccgagtagctgggattacaggcatccgccaccacgcctggctaattttttgtatttttagtagaaacggggtttcactatgttggccaggctggtcttgaactcctgacctcgtgatccgcctgcctcggcctcccaaagtgctgagattacaggcatgagccactgtgcctggcctactgcaatattttttatttattctttattaatgggcatttgggttattttcagtatttggctattattaaatagactgctatgaacattttttttttttttttttttgagacagagtctcactctgtcgcccaggctggagtgcagtggcacagtctaggctcactgtaacctccgccccccgggtttatgccattctcctgcctcagcctcccgagtagctgggactgcaggcgcctgtcaccacgcctggctaatttttttgtatttttagtagagatggggtttcaccatgttagccaggatggtctcgatctcctgacctcatgatccacccacctcggcctcccaaagtgctgggattacaagcgcgagccaccgcgctccgcctgactgctatgaacattcttatacacatgtatggacaagtgttctcatttttcttgggtaaataaatacctagaagtggaattgctctgtcattagggaggtacatgtttaacattataagaacctggcaaactgttgtcccaagttgttgttcggttttacactcccaccagcaatgtataagcgttctggtagctgcctatctttgataacacttggcattatcaggcttttttttttttgagacggagtctcactctgtcatccccagactggagtatagtggcgcaattacagcttactgtagccgtgacctccaagggtcaggtgatcgtccctcccacctcagcctcccaagtagctgggactacaggcatgtgccaccatgccccactaattttttgtatttttttttctttggtagagacagggttttgccatgttgcccaggctggtctcaaactcttggactcaggtgatctacccaccttggcctcccaaagtgttgggattacaggcgtgagccacaaggcaaggtcaattctatcaattcaaagtgtgtattttggtgagctttgtcagttgtacacccagtgaaaccaccataatcaagataccaagttatttccattgcctgcctcagacttgtcatgctcttttgtagtctgttctctaagtggccccaacccaggcaaacgctagtctcttttctttatactaatttatattttctagaattttatattaatgaaatcatatagtatatgctcttttgtgtctggcttcttgtaggtggcatgatgattttgagatttattcatgttgtcaaatatatcattagttttctttttcttttctttttttgttttgagacagagtctcgctctgtcgcccagactggagtacagtggcatgatcttggctcactgcagtctccgccttccgggttcaagtgattcttgtgcatcagcctcctgagtagctgggacgacaggcctacgccaccatgctcggctaatttttgtattttttgtagaggcagggtttcaccatgttggccagactgatttcgaattcctgacctccagtgatctgcctgcctcggcctcccaaagtgctaggattacaggtgtgagccaccgtgcctggctatatttttgctcagtagtattcattgtatggatataccactttttgtctctccatacacctattaatggacatctggattgtttccttttgtcttttccctccactataagagatggagtcttgctgtgtttctcagcctggccttgaactcctgggctcaagcaatcttccttcctcagtctcctgagcagctgggactcaaacgtgcaccgctgcacccagctgtttgcaatttgaagctattgggaataaagctgctatgaacattcatgtataagtctttgtgtggatatacatcttcatttctctttttaattttatatatttgaatggctatgtagtcatatctcatagttttaattttcatttttctcatgtctactgatggtgaacatcttgtgattattggccttttgtatgtcttccttagggaaatcttttgccccttttcttactgacttgtctttcttcttgttgagttgtgaggattctttatatattctgactacatgtcctctgtcagatacatgttttgcaaatatattaccttgcctttttatttgttgtgtcttttgaagtacagaagtttgatgacgtccagtttatgggtttgacaaacctaacatttaaaagacacaaagaacctagaatagacaagataatcttgaaaaagaagaaaaatttgaaggcctctacactacctgatttcaagacattgaacaaacctacagtaatagaagtgtgttgtattggtataagaacagaaaaataccagcctgggcaccactgtgggactccatctctttaaaaaagtaaacaactagccaggcatggtggtgtatgcctataggcccagctacttgggagtctgagacaggaggatcacatgagcctgggaggtcatggctgcagtgagctgtaatcatgccactgcactccagcttgggtaacagagcaagatgcggtcgctaaaaaaaaattttttttttgctcttcttcaaaatttgaaaatatataataaatttttgtttattatggtgaccatatagtactgtagaacactagaagttattcctcctatctagctatacttttatatctgttaaccaacctctggctatgtctccctctcccctcccctctcccacctctattaaccactattctactctctacttctatgagacttcttttttttttttttttaaaggcagcaacttgctctgttgcccaggctggagtgcagtggtgtgctcacagctcactgcagcctcaacctcctgggttcaagtgatcctgccatctcagcccctcaaatagctggaaccacagatgtgcaccaccatgtccagctaattgtttttttggtagagacaagttgttgctgtgttacccaggctaaggttaacttttttagtctccacataagagtgagaacatggggtatttatctttctgtgttcagcttatttcacttaacgtaatatcctccaagctctaagacatctcttactagaggtcctggatagttcaattaggaaagaagaatatataaaaggacataaaggtttggaaggggagaagtaaaactatccttatttgcaaatcatatattaaaaaatcattattttaaagaaattattatttatatttatatatttttatatatatatatatatatatatatatatatatatatttttttttttttttttttttttttttttttttgagatagagtcttgctctgtcagccaggctggagtgcagtggcacgatctcgactcactgcaacctctgcctcccaggctcaagcaattctcctgcctcagcatcccgagtagctgggattacaggggtgtgccaccacaccccgctaatttttttttgtatttttagtagagatggggtttcaccatgttggccaggctggtcttgaactcctgacctcaggtaatccacctgcctcggcctcccaaagtgctgggattataggcgtgagccaccgtgccggtctctaaaaatatatatttaaaaattctgagctgggtgcggtggctcacatctataatcccagcactttgggaggccaaggcgtgtggatcacgaggtcagcagatcaagaccatcctggctaacatggtgaaaccccatctctactaaaaatacaaaaaattagccaggcgtggtggcgggcgcctgtagtcccagctacttgggaggctgaggcaggagaatggcgtgaacctgggaggtggagcttacagtgagccgagatcccgccactgcactccagcctgggcaacagagcaagactctgtctcaaaaaaaaaaaaaaaaaatcctaagggtaggccaggcatagtggctcacacctgtaatcccaacactctgggaggccgagttgggcagattgcttgagagcaggaggtcaagggtcaagacaggaggactgctttggagtgcaatggcactatcttggctcactgcatcctccgcctcccgggttcaagtgattatcgtgccttagcctcccaagtagctgggattacaggtatgcaccaccacacctggctaatttttgtactcttagtagagacggggttttgccgtgttggccaggctgtctcaaactcctggtctcaagttatctgctcgcctcagccttctaaagtgctgggattacaggcatgagctatcttgcctggcctcttttgcttttttaaaaatagagactagatcttactattttgcccaggctggtcttgaactcctggctggggttacaaatgtgagccacccacctggccaaatgccaaaatcttgtttctcatcaaacctgcaattatgggccttaatattgacgaattccaatggaattaaccacatgatgatggtttccaaatggcaattctctattgcagtcattctttctttgttagttggctgctataagagcttttttgtctcctcagtttatctatttattcacttatttcttcatttttattatattcagtggattgtaatccattcatattagttattttgatgctcaaattgtttttaatttggccagtgtgagctcttcagcttggtttctatgtccctttgacatgtcctcataatttatggagcatttcttaatttctggaacaggaagatattctaggcttctattttacttgccttgtctcagctctgcagttagccatttctctgtggacccctggttccttttcgtggaggatggtatttagagacgaaggtctagcattaaattcattgctcctgatgtggcagtgcttctaggccttttcagtagataaagttaggatactgtgtttgtctgttttgcattcccataaacgaatacctaagactcggtaatttatagagaaaaagaggtttatttggctcacagctctgtagattgtacaagcatggttgtacagcatcggcttggctgttagtgaggcctcagtaatcttcaactcatggcagaaggtgaagggagagcaggcctgtcacatggcgagagaagtggcaagagagaggaggaggtaccagcctcttttaaacaaccatctctcgggtgaactaatagatggagaagttactcattactgtgaggacagcaccaatccgttcatgagggatctgcccccatgaccccaaacacctaggcctgcctccaacattggaggttatatttctttctttttttttttttttgagacagaatctccctctcttgaccaggctggagtgcaatggcatgatctcgactcactgcaacttccgcctcctaggttaaagcaattctccctgcctcagcctcccgagtagctgggattacaggcgcctgccaccacagccagctaatttttgtatttttagtagagatggggtttcgccatgttggcctggctggtcttgaactcctgacctcaggtgatctgtccatctcagcctcccaaagtgctgggattacaggcatgagccactgcgcctggcctgtatttcaatatgaaatttggaggggacacacatccaaaccataccagctatatatgtatgtatatgtgtacacacaaacatttaaaactatttatatgtgtgtaatatatgtatatgcatgtaatatatatgtaatatatgatacattatatataatatgtatattttttattagtaccttgtacccctctccttaacacctaccttctgctatagagacatactaatttaactacaactttacccatcttcctccttcccgccaattaacagttaaaaaaaatacacttcttcttttctaaaaaagaaaagagatatctcatttagtatctatctggcttcatagcttattttcccttcatttcactcaaagaggaaaagaaaacagaaatacagaaaaagtttttgtagtctcttttgaattaccagcccaaatatctaattgcacagaatattgtgagtcttgttctttctacaggcaggctaggaaggacatataagctgtgacacaccatcttccactactccaacctcccattctccccacccttttgcctctgtcccactcctgccactgtagtcagcctccctatgatttgcaatctgaagataaactgggcaaaactgagacaataataaggaccctactcttcctcctgttacattgggaacaatattacatcagaagttcttgtattaactttttgaaatatgacagtgattttttttttttctgattgtttagcaagaaaacaaaagacaagagggaaaaaactcacctaccacccaaagatagcccctgttaacattttggtggatgtcctttaagtcacttttttctatacatatttatttttatttaatttcttaacatgggtagactttcatttttgtgatgagcaaaaaagaatttgatcagctaatattttaggtaattttattacctaaatgtattaaataaattttaaaaattaatatttgtcaatatcttatataaaatctaaaacaaaatttttatataattatatataaattatataattatattttatagataaagctaatatttaagcattttatattaattacctaatatatattttatatttaggtaaatttattacctaaaatactaatttattgaatttatttaatacattttattaaattaatttaaattttttttttttttttttttgagatggagtctccctctttcacccaggctggagtgaagtggcatgatctcggctccctgtaacctctgccccctgggtttaagccattctcctgcctcagcatcctgagtaggtgggattacaggcacccgccaccatgcccggctaatttttgtatttttagtagagatggcgtttcgtcatgttggccaggctggtctcaaactcctgacctcaggtgatccaccctcctcggcctcccaaagtgctgggattacaggcgtgagccaccatgccctgccaatttatttaatttttaaaaattaaatttaaaggtgtttcttctcttttctggtttttgttttgttttgttttgttttgttttttgttattttttgagacagtctcactctgttgcccagactggaaggctagatagagtacagtggcgcgatcctgactcactgcaacctctgctttccaggctcaagtgattctcgtgcctcagccacccaagtagcttggattacaggcatttgccaccacacctggctaatttttgtatttttagtagagatggggtttcaccacgttgaccaggctggtctggaaatccttgccttaagtgatccgcccacctctgcctctcaaagtacttatattacaggcatgagccaccatgcccagccctaaaaatgtttattttccagatagtttattcctttaaatgtttataaccttagcttttctttttcaaatcattttcttaaaagtcaagatacatctgaaaaatctcaggattgtgatgttcaatgtaaagcaaagcgtgacttcctaatgagtggtttgccagatttgttgaaacggcaaattgcaaagaaagctgctgcgctggatgtgtacaatgcagtgagtaccagtttccagagagtcgtacatgtgcaacaaaaggatgatggtaagtttgttttttattattgaatatttactcttcagctgttagcaggaacattaaactatgtaagtttcttaaagatgaggctgaagtttaattatcattcttatggtgactttagtgggaattttaaggacaatttctctcactatccatggggtttgattccaggacccccttgtggatactagcactcatggatgctcaagtttcttgtataaaatggtgtaggctgggtgtggtgtctcatgcctgtaatcccagaactttgagaggacaatgcaggagaagagcttgagcccaggagttcgagaccagcctgggcaacacagcaagatcctgtctctaaactagctaactaacttaattaattaattaattaaaatttgctgggcatgacggtgtatgcctgtagtcccagctactcgggaggctgaggtgggaggatcacttgagcctaggaggtcaaggctgcagtgagccatgatcatgccactgcattccagcctaggtgacagagcgagaccctgtctcaaaaaaagaaaaaaaaaaaaaagtttagcctttcttctgtacgtgggaatttcccagctagtcttttcagtaatttattctactttttcttatttcccatctctgccactggccattcagttgatgaaggctttcttgttatttttactagtacagctttatatagcattttccaatagtatgttcaactgtagaaattagttatgcttttcttgactcattttgataaactcattttcacaggagtgctgccataaaacttagcatatctatttgtagatgagcagagaggcaagcacagagggaacctctctctcttacaaccttcagaattattgaacgcttactattgtctggaattctgctgagcaattcatatacatatctagtttaatcctgataacaactctaagaggttgagtattataattatcaccctcactttgaatgtaaggatgaagaaactaagatttaggatctcgccagtgctcacaaggttagtaagtggcagaggttgggtttgaatccaggtctaacttgaaagtttagactttagaccaggttgctaactgcctcttaaaaggtttttgtttgtttgtttgtttgttttgacagagtcttgctttgttgcccaggctggagtgcagtgatgagatctcagctcactgcaacctctgtctcctgggttcaagcaattctcttgcctcagcctcctgagtagctgggattgctggtctcgaactcctgacctcaagtgatccacctgccttggcctcccaaagtgctggaattacaggcgtgagccaccacgcctggccctcctaaaagttttaacctgagtatcaaggttgatttgaaaagaaaggaaagtttgttaatatttgtttgttttaaacaactggaagggaagtctaggtgatttttattaattctatttgttggagggtaggattttgttccctttatagtcatgtggtttttggtatgtttgtgttaattatgtagttgtcaacttttcatgtttacgtatttgacattcagtaaatggatagtgtataaataaggtttattaagatatttgtctatttttctttagggtgttgtttgtggcatttgaaaccaccctcttgtcctctcttaactaaatttaaagaactgaacactaaagtaatagatctctcaaaatgtggtattgctcttggtgaattttcaacattgaattcaaagttgaaaagcggtaactctgctgctgtggtaagtattaaatagttcatccattgtagagtgtttcccttacatcttgcagaggaaaaacatttttggatatctactcttatagcctcgagtgttgtcctagagtttaattttttttttttttgagacagagtctccctctgttgcccaggctggagtgcagtggtgcaatcttggctcactgcaacctctgcttcccgagttcaagcaattctgcctcagcctcccgagtagctgggactacaggcacacaccaccatgcccggctaatttttgtatttttagtagagacggaatttctccatgttggtcaggctggtcttgaactccctacttcaggtgattcccccgcctcggcctcacaaagtgctggggttacaggcgtaagccactgtacccagcctaatatttaaaaataaatcctaattgtagtacacatttcttttaaatacccatagagctttaaaaacattttaagaattaatgattgccagttctcaaagaatgttagattacatagcacatttagatactttataagtaggtcatataatctaatagatataattagttcaaagggagaaaaataaattaattcttcataagctttatatttagtgactaaagctattttttttttttttttgagttggagtctcaccctgttgcccaggctggagtacagtggcacgatctcggctcactgcaacctctgcctcccgggttcaagcgatcctcctgcctcagctccccctagtagctggaattacaggcacacgccaccatgcccagcaaatttttgtatttttagtagacacggggttttgccatgttggctaggctggtctcaaactcctaacttcagatgatccacctgtctcttggcctcccaaagtgctgggaatataggcgtgagccaccacgcccggcctaaagctaatcttacgttgatactgatttatgatggacagaaagtggttggtagtattgtaattaacatgaatagatgatgttggtctgttattgtgcattttattctttattgcagttcatgaggacaaggaaggaatttactgaagaagtaagaaatcttttgcttgaggaaattaggtggtcaaatcctgaattttcattgaaaaaatattttcccttactcctaaaaaaacaaattgagcaccaagtactttcttccgagtgtcatagtaaacaaggttagtgataattattatcatttatgttaacataccagttttgggtttttatattatttattattttatttttatttctgagacggagttttgctcttgtcgccctggctggagtgcagtggcacaaacctggctcactgcaacctctgcttcctgggttcaagtgattctcctgcctcagcctcctgagtagctgggattacaggcacccaccatgacgccctgctaatttttgtatttttagtagagatggggtttcaccatgttggccaggctcgtcttgaactcttgatctcaggtgatccatctacctcagccccccaaaatgctgggattacaggcatgagccactgcgcttggcctattttttctttttttttagagtgttgctctgtcacccaggctggaatgcagtggtgcaactttgcctcactgcaaccttcgcctcccgggctcaagtgattcctgtgtctcagcctcctgagtagctgggaccacaggcttgcgccactgcacctagcttattttattttttaatttttacttattctcttgagactgggttatgagactggctagtttttgtatttttggtagagaccaggtcttgccatgttgcccaggctggtcttgaactcctgggctcaagtgatcctttcgccttagcttcccaaagtgctgggattacaggcatgagtcaccacgcccagcctaacgtgtcagttttgaaaaacactaagacttaaccaatgacacttggaagtgttcaccacagacaacattgcttacacttggcagggagaattgttcagctgaagtaaaagtatcttgtacaatgcaatgtgcaacattaatccccgccagtttccaaaaatgccaactcaaagatagctttaattatgttaaaatattatgtacttaaggaatgccttagataattttagcttatatagcttgtataaaagacagtctaagtattaaaatctccagcttgctttcagtatgttatatttgattcttgcctttttattttattttattttatttattttttgagacagagtcttgctctgacacccaggctgaagtgcagtggcgcgatctcagctcagtgcaacctctgcctcccagatttgagtgattctggtgtctcagcctgcctagtagctgagattgcaggcacctgccaccatgcctttctaatttttgtattttttagtagagatggggtttcaccatgttggtcaggctggtctcgacctcctgacctcaagtgattcactcgcctcagcctcccaaattgctgggattataggcatgagccaccatacctggcctatttatttattttttaagagacacggtctcactttgttgcccaggctagaatacagtttgtttgtttgtttatttatttttattttttgagacggcgtcttgctctgccgcccaggcagtggtgtgatctcggctcactgcagcctcagccttctaggttccaccgattctcctgcttctgcctcctaggtagctgagattacaggcacacgccaccatgcctggctaatttttgtatttttagtagagatggggtttcaacatgttggccaggctggtcttgaactcctgacctcaggtgatccacccaccttggcctcccaaagtgctgggattacaggtgtgagccaccgcgcctggcctatttatttattttttaagagacagggtctcactttgtcgcccaggctagagtacagtggtgttttcatggctccctgcagcctcgatctcccgggttcatgtgatcctcccacctcagcctcccaagtagctgggactacaggtgcatgccaccacccctggctgatttttgtatctttagtagagatggagtttccccatgttaccgaggctggtcttaaacgcgtagactcaagcaatccgctcacctcaacctcccaaagttctgggattagaggcctgagccactgcacctggattgcctttgcattttaaagttacaagactattggatacttggaagtgatattaatattactggtttttgttgattagtaagcacatgcacttctttaattcccaaagcagaactggaggctgatgtcagccataaagaaaccaaaaggaaactcgtagaagcagaaaattctaagtcaaaaagaaagaaaccaaatgagtattcaaaaaatctggagaagaccaataggaagtcagaagaacttagcaaaagaaacaactcttctgggataaagctagattcttccaaaggtatattttctaaaacatcccaaaagaaatagattgctttgaggacatgcaaagtggaaaccaaagcagtagaagattttgatatgctttttaaaaaattttaattcaattgtattttaattttagattttctttttcttttttgagacacagtttctctcttgtcacccaggctggagtgcaatggcacgatcttcgctcactgcaacgtccctccacctcctgggttcaggtgattctcctgcttcagcctcccgggtagctgggattacaggcacccacctgcacgcccagataatttttttttttttttgagatggagtcttgcacggtcgcccgggctggagcccaccatcatgcccagctaactttttgtatttttagtagagacggaattggccaggctggtctcgaactcctgaccgcattattcacccacctcggcctcccaaagtgctgggattacaggtgtgagccaccgtgcctggccacgcccaggtaatttttatatttttagtagagacagagttttaccatgttggccaggctggtctcaaactcctgacctcaggtgatccaccccccacccccctccccgcccttggcctcccaaagtgcagattttgatattctaatagatgatgacagtctgcaccagaaatattaacatcttccattcctggtaaattcgagtttttccttctagtcctagaactctttttgttttttaacttttcattctttctccttctctctcttttttttttcttttgctcattgcaactttcaaacaataaatatgtgtttgaaataaatagaacctcacggattatgggcttacaaatgaccatattaacagataggtgttcagtctttgatttttctgtgcttccataaatacatgtgcttttatttttttattttttattttttgagacagcatctctctccgtcgcttgcctgatctcagctcactgcaacctctgcctcccgggttcaagtgattctcctgcctcagcctcctcagtagctgggactacaggcgcacgccaccacgcccagctaaattttgtattttcagtagagacagggtttcactgtgtggtccgggcaggtcttgaactcctgacctcaaatgatctgcccactttggcctcccaaagtgctgggattacaggcatgagccactgcacccggccaatatatgtgctttaaaaaaaatctggtattgtgctcgctttggcagcacatatactaaaattggaatgatacagagaaaattagcatggccccttgtgcaaagatgacaattttttttttttttttggtatttttagtagagatggggtttcgccatgttggccaggctggcctcaaactgacctcaagtgaagggatgacaattttaaaattaaaaagtaaaaaaaaaagtaacacagtgtccgggcatagtggctcataactgtaatcccagcactttgggaggccgaggtgggtggatcacctgcagtcaggagtttgagaccagcctgccaacatggcaaaaccctgtctctactaaaaatacaaaaattaaccaggtgtggtggtgcgtgcctgtaatcccagctacttgggaggccgaggcaggagaatcgcttgaacctgggaggcggaggctgcagtgagccaagatctcgccactgcactccagcccaggagacagagcaagactccgtctagggggcaaaaaaaaaggtaacaaagttgaaaaaaaaatatggtcttatcccatacatactattttacaccatgttttacatatctctgacatgttctcattcagtttatttatttactttttttgagacagttttgctctttttgcttaggctgcagtgccatggcatgatcttggctcattgttgcaacctctgcctcccggattcaagcgattctcctgcctcagcctcccgagtaactgggattataggcatgtgccaccacgcccggctaattctgtatttttagtagagactgggtttctccatgttggtcaggctggttttgaactcccaacctcaggttatccacccgccttggcctcccaaagtgctgggattacaggcatgagccaccgtgcccagccccattcagtatatatagcttttccaaagtatgctattgatttattcatttatatagctttatacaggatgaatatccctaatccaaaaatctgaaatttgaaatgctccaaaatccaaaacattttgagtgctgacatggtgccctaagtggaaaattccatacctggggccaggcaccatggctcatccctataatcccagcactttgagaggccgaggtgggagcattgcttgagcctaggagtttgaggccaggctgagcaacacagggagaccacacctttaccaaaaaaaaaagaaaaaaaaattggctaggcatggtggcacatgcctgtagtctcagctccacaggaggctgatgtgagaggatcacttgaggttaaggctgcagtgagccatgattgcaccactactccaggctgggtaacagagcaagaccctgtctcaagaaaaaaagaaaattccacatctaacctctggtcatagtcaaaatgcccaggctggactgtggtagcatgatctggactcactgcagcctccacctcctgagttcaagcgattcttctgcctcagcctcctgagtagctgggattacaggagcccaccaccatgctcggctactttatgtattttttttttttttgagacagagtctcactctgttgcccatgctggagtgcagtggcgcgatctcggctcactgcaagctccgcctcctgggttcgtaccatcctcctgcctcagcttcctgagtagctgggactacaggtacatgctgccacgcctggctaattttttgtatttttagtagagatggggtttcaccgtgttagccaggatggtcttgatctcctgaccttgtgatccaccctcctcagcctccgaaaatgctgggattacaggcgtgagccaccgcgtccggcttttttttttttttttttgagacaaagtctcgctctgtcacccaggttggagtgtagtggcacaatctcggctcactgcaacctccacctcccaggttcaagctattctcctgcctcagcctctttagtagctgggactacaggcgtgtgccaccacgcctggctaatttttatatttttagtagtgacggggtttcaccgtgttggccaggctggtctcgaactcctgacctcaagtgatcctcccacctcggcctcccaaagtgctgggattacagatgtgaaccaccgagcccggcctactttttgtatttttagtagagatggggtttcaccatgttggccaggctggtctcgaactcctgatctcaagtgatctgcccgcctcggcctcccaaagtgctgggattacaggcatgagccactgcacccatcccgattattggttttatgccacaaattatttctcatcattcatgtttcttcagtggttattaaaaatttaaatattgctgtttgtggtggctcacatctgtagtcccacctactcaggaggctgaggtgggagcttgagtctggaagttcaggaatgcagggagctgtgtttgtgcttgtgaatagccactgcagtccagcctgggcagcatagcaagacctcatctcttaaaaaaagaaaaaaactatttatttttaattttcaactcaaggggcacatatgcaggtttgttacatggatacattccatgatgctgagatttggacttcaattgaacctgtcacccaaatagtgaacatactgcccaatagatagtttttcaacccttgtcctcacttcttccctcctcccttttgtagtccccagtgtcttttttgttgttgttaagagacagggtcacactatgttgcccaggccaatcccgatctcttgggttcaagtgatctacctgccttggccttccaaagtgctgggattataagtgtgagccaccacatgtggcctccagtgtcttttgttcccatctttatgtccatgtgtacccagtgtttaggttcagcttataaaggagaacatgcattatttggttttctgtttctgcatttattcacttaggataatagcctccagctgcaaccatgttgctgcaaaggatatgatttttttcttttttatggctgcatactatcccatggtgtatatatgtcctacaaattctttatccaatccaccatttttgggcacttaggttgattccatttttgctttttttttttttgagatggactgtcactctgttgctcaggctggagtgcagtggcacaatcctggctcactgcaacctccgtctcccaggttcagtctctttgctgttctaaatataaacatgtgagtacatgtgtctttttggtagaacagtttattttcctttgggtatatacccagtaatgtgattgctgggccagatggtaatcctaaaaaaaaaaaaaccaatgtttaagtgtgcactttaatttttttttttttttttgagacggagtctcgctctgtcgcccaggctagagtgcagtggcgcgatctccgctcattgcaagctccgcctcccgggttcacaccattctcctgcctcagcctcccgagtagctgggactacaggcccccgccaccacgcccggctaattttttgtacttttagtagagacggggtttcaccgtgttagccaggatggtatcgatctcctgacctcgtgatccgcccacctcagcctcccaaagtgctgggattacaggcgtgaaccaccgcgcctggctaacactttaatattttaataagattatggtggttatttttttttagggggaagggtttggtgtgaagaattttaaatgtaatgttgttttaaaagtacctctggcattttgtaaatataaatatttctgcaaatacctactgtgacattgtaacaataatgtaaatgactaataattcatatatgtttatgtcaaggaatgaataccttaattttttttttttttgctttagattctggaactgaagacatgctttggacagaaaagtatcaacctcagactgccagtgaacttataggaaatgagttagctataaaaaagttacataggttggtaaaatgtgtaaggaattgagaaatagtttacaaacttagttttactgtttttgtttcgaaattgtagttacaaagtaatatatctcatgataaaatcttcaaaaaactggtagaagtttaagtgaaaagtagccctcttttcttacatttctacttctcagagataatcattgaaaattttttgtaaaagcttccagaaaaatatttttatgcatatgttagttccttcctttctaacaaatgggatcacattactactaattcaggtccccagtccttcatcttcaattctcacatccaaaaaattctgaataatgaaagtttattgactttattacatgaaatttgttacacctttacacttagtagaatttacaaatttttttttttttttttttttttttttttcaagacagagtctcactctgttgcctaggctggagtgtaatggcacgatcttggctcactacagtcgctgcctcccaggttcaacagattctcctgcctcagcctcctgagtagctgggactacaggggtgcaccgccatgccaggctaatttttgtatttttggtagagacagtttcgccatgttggccaggctggtctcaaactcctgacctcaggtggtccacccgccttggcctcctaaagtgctgggattacaggtgtgagccactgcacttggccagaattcatatattttttaataaaaatattaagtgatggcccagtgcagtggctcacacctgtaatcccagcactttgggaagctgaggcgggcagatcacttgaggctgggagttcgagaccagcctggccaacatggtgaaaccccatctctactaaaaatacaaaaattagctgggtgtggtgatgcacgcctgtaatcctggctactggagaggctgaggcatgagaatcgcctgaacccgggaggtgaggattgcagcgagccgaggtcgtgccagtgcactccagcctgggcaacagagtaagactctgtcccaaaacaaagcaaaaaaacaaaccaaaccaacttaaatgattatgggtgtactgcctagaccccattaggggtattatgtaatatgcagtatatgtaccaaataaccttttaagtatctgaaaaattaattctaaaacaatctggtccaaaggatttcatataaggatttacggacccataattacagttaatagcgtgaacttggtactactgttctaagtacttgtattgttccttctttcttttttttttttttacttgtactgttcttaattcattttatccttagaatggtactgtgagcagtgggtacagtggctcaagcctgtaatcccagtgctttcgtaagctgaggcagaaggactgcttgtggccaggagtttgagagcagcctgggtgaaatagggagaccccatctctacaaaaaataaaaaaaatagctgggaatgatggcgcccacttggattctgagccactcaggagcctgaggtgggagggtcacatgagtccaaggattcgaggctgcagtgagctatgatcgcacccctacactccagtgacaaagcaagactgtctcaaaaaaagaaaaatactatgagcataaatactgttgtcctcatctcatagatgaagaaaccaaggcctagagaggctgagttatttgtccaaagtcacacagctagaaagtgatggaactgggatttaaactcaggcattctagctctagactagaacttaatctttctgttgtacattgtatattaggcatctttcatggaattacacaacataccgcagttctttttttttattttgaaacagggtcttgctctgttgcccaggctggagtgcagtggttgaatcttggctcactgcaaccttcgcctctcaggctcaagccatcctcccacctgagcctcccaagtcgctgggactacaggtgtgcaccaacatgcctggctaatgttttttgtagagacaggtttcgctgtgttgcccaggctggttgcaaattcctgggctgaagcaattcacctgcctccgccttccaaagtgctgggattacaggcctgagccactgtgcctgccctgccacctcagttctttttaattgctgtataccagtttctaagtgagtgtactataatgtatttttcccaatggtgtatttttatgtttttcctgttagaggctaatatgaacaatgctacagtgaatattcttacacatatagtcttgtatattttggcagaaactacttcatttaaaaatgttcatgtccatgtaaaactattttactctttagttgattcacaagcactgtggagtgtttagaaactaacaatatgccatataaagctgtactagtaaaaataacaagaaagccttcatcagttgaatggccagtggcagagaaactaacaatatgccataacttcccccgataatcattttaacataaagtctaaggcatagctatattctgtgaattatttttattatgttttcttgtggcagttggttgaaagactggaaaagaagagctgaattggaagaaaggcagaatctgaagggaaaaagagatgagaaacatgaaggtattttgtgtgtctttttttttttttttaccatttcactgaacatttttagagttacattaactaaaactttctataaaatttcttttttttttaatttttttttttttttggagacagagtcttgctctgtttcccatagtggagtgcagtggcgcaatctcggctcactgctacctccgcctcccgggtcaagtgattctcatgcctcagcctcctgagtagctgggattacaggcgcctgccgccacgcccgactaatttttgtatttttagtagagatggggtttcaccatcttggccaggctggtcttgaactcctgacctcgtgatccacccaccttggcctcccaaagtgctgggattaagcagtggcatgagccactgcacctggcctataaaatttcttaattggtattttatatttgattttctactttttttttttttttttcactctgtcacccaggctggagtgcaatggtgtgatctcggctaactgcaacctccacctcctgggttcaagtgattctcccatctcagcctaccgagtacctgggactacaggcatgtgtcaccacacctggctaatttttgtatttttagtagagatggggtttggccaggctggtctcgaactcctgaccttgtgatctgcccgcctcagcttcccaaagtgctgggattacaggcatgtgccactgcgtccggcctgtataaagtaatttttcagcatctattgcaagaagtttgtgggatttgatcactgggtttcataaggtagaattgcttcctcagcaattgtcattttatatgcatttgaataatttttcagatttctcgggtggcatagactttaaaggcagttcagatgatgaagaagagagtcgtctttgcaatactgtccttataacagggccaacaggagtgggaaaaactgctgcagtgtatgcttgtgcccaggagcttggatttaaggttagtaacagctatgatgagagaatgttaatgtaataattacccttggattaaaaggaaacataaaccattctcccttcgttttttcttatattcttcttttagatatttgaagtgaatgcctcttcccagcgcagtggtagacaaattctatctcagttgaaggaagctactcagtcccatcaagtagacaaacaaggtgtaaactcacaaaaaccctgtttttttaatagctactacataggcaagtcaccaagtaagtaaactattttccttaagccataatgttttgaaaaaaataaaatctaagaaagtaatgttaattatcagcattttgccatttattttttatcttctacacgtacacgtttcctgcccacccctgccagattattttaaaacaaatctgaagaccatcatatcatttcacccataccttcttcaatatttatctctatctgataaggacttttaaaaaagcataactataatatcgtaatcagacccaacagagttaacaaccagcctaagcagcatagcgagaccttgtctctacaaataataaaaaaaaaaagtagctaggtgtggtggtgtatgcctgtagtcccagctactctggaagttgatgtgggaggttcacttgagcctagaaggttgaggctgcagtgagctgtgattgggccactgcactccagcctgggtgacagagtgagatcccatctccaaaaaaaaagatctattaactatatttcttcatataatctcatacacagtctaatgtcaattttctgttgtttcaaatgatttgttcaaatctggatccaaacaaggttcatatcttacatttgattcagttctcttaactttcttttaatctcgctaacaattcactcacctttcttttcatgtcattaatttgttgaagaatctgagtcatttgtcatgaaattcttcacattctggatttgtctgctgattatatcctcatggtgtcagttagtatagtcctcttccctatatttcttgtaaactggcagttagatctatgggccttattagattcaggttctgttctgggtctggcatacatatacaggtggcctgtgtacttcctatgacatcatagcagattatcccttgtagattacaaaatgataattttataattctcttttttgcatttattagaattttaaaaggaagcactattcctcatcaactctttggatgctttggaatacagtttataggcaccagaaatgcttcattcattcctttatttattagtacttagagtgatggtgtcctagcaaccttgacagttgaccagtgagtttttgtgtagtttaattttttaagtattattatgaactcatggatttttatatatataatatgtttcacctctttgtgtttattatttctttgttgctttggagattttctcactggttttaagtaatttgattatgatgtgccttggtgtacttctcttcatgtttcttgtgcttgggatttgttgagtttcttgcatatatgagtttatagttgggaagatcaaagttgataaaatttcaaccagtatttcttaaaatattttttctgtcctccccttttcctttggcaactccagttattattataggtattttagaccacttgaaattgtctcctggcacactgatgctttgttcaatttttcagtctttttcctctttttgtttcagtttggttagttgttattactattcaagtttacacatcttttctgtagtatctagtatgctgtcactgctataagtatagttttcatttctagaagtttgatttgggtcctttttatatcttctgtgtttctacttaccatgtgcccagtctttcctgtaggtttttgaacatatggaatacagttataacaactgttttaatggtcttggttattaattctatcatctgtgtaatttttgtttttttgaaacggagtctcgcacttgtcgcccaggctggagtgcagtggcacaatcttggctcgctgcaacctccacctcccaggttcaagcaattctcctgcctcagcctcccgagtagctgggattataggcaaccgccaccacgcccagctaatgtttttgtatttttaatagagacagggtttgaccatattggccaggctggtctcaaactcctgacctcaggtgatccaccccccatggcctcccaaagtgctgagattacaggcatcagccaccacgcctggcccatctgtgtcatttctgagttgttttttcaattgattgattattccctctttcattatggattgtatttttctgattctttggatgcctgataattctgattgcatgtcagactttgtagagtttgccttcttgggtgctggatatttatgtattcctgactgttcttttttttctaaatttatcaatcctgcactttttgtacctataactgttcgttaactttcttctgtgatgtggttaagttagttgggaaaagtttatcttcaggtcttgtgtatgtgtttgtttttgagacagtctcaatctgttgccaaggctggagtggagtggcacgattatggttccctgccacctcgaagtgggcttgggcaatcccccaaccttagccttttgagtagctaggactacagaccaccgcactcagctaattaaaagaaatttttttttgtagagggggtcttgctgtgttgtcaggctagtctcaaactcctggcctccagcagtcttcctgccttggcctcccgtagtgctaggattacaagtgtgagccgtcaccacgcccagctttttcaggtcttttaaactgtagtaggcaaaaaagtagcagcatttagtctagggctaattttgccccactccttaggcaaaacctttctgagtgcttcaatattccattagttatgtttgccagtctacctgatgggaagacgaatcattcacagctctctgtgagcctcagagattgtttcctctgatctttcactgatgagtactcaattttagacttgagagggactctgcaaatttccagagctttgcccagctgtttcttctgtattcttccccacatctctgtctgcttggcctcctcaggtttctttttctttttttttttcttttttctttttttttttctttttttgagacggagtctcacactgttgcctgggctagagtgcagtggtgcgatcttggtgcactgcaagctctgcctcccaggttcaagtgatcttcctgcctcagcctcttaagtagctgggattacaggcgctcgccatcacgcacagctaatttttttgtatttttagtagagacagggtttcactatgttggccaggctggtctcaaattcctgaccttgtgatctgcccgcctcggtctcccagagtgctgggattacaggcatgagctactgcacccagccaacctcctcaggtttctagtgcagtctcaactcagaaaacatggattgactttcccctcactatggaaattttctcagggcaataggctgggcaatcctagtgttcaccttatttgtttttatatctcagagattactgtccattgttgcatcatgacaaaagtcttgaaaagtgttatttcatatattatgtccagttttcttgttcttatttatgatgggaggataaatccagtgccagttctataccttgactagaagcagaatcccatcttattttcttttggtgctcatatttttccatctttgactagcaaggaactattttaattggtttgtgtccttttgacattaccccagcaatagttgatattttacttgctttctggcatgtcaggatgtcccagacctacagttagctgtttctgcaagaaggtagttcttttggtgtgaaatttctttttcttttttttttttttttgagacggagtcttgctctgtcacgaggctggagtgcagtggtgtgatcttggctcactgcaacctccgtctcccaggttcaagtgattctcatgcctcagcctcctgagtagctgagactacaggtgtgcgccaccatgcctggctaatatttgtgtttttagtagagacacggtttcaccatgttggctaggctggtctcgaactcctaacctcaggtgatccatctgccttggattcttgaagtgctgggattacaggcgtgagccactgtgcctggccaatttttttagaaagaatatattgatatagtttagccagctactcacagagtatcttaaaataaaaattgcctttttttttttttttttgaaaagacggggtcttcctctgttgccaaggttggattgcagtgatgcaatcatagctcattgcaaacttgaactcctgggctcagatgatcctcctgctttagcctcccagagtgctgggattgcaggtatgtgccactgcacttggctaagcatgtatttttaaaaccagtctttgggccgggtacagtgggtcatgcctgtaatcccagcactatgggaggctgaggcaggtggatcacaaggtcaggagttcaagaccagcctggccaacatggtgaaatgccatctctactaaaaatagaaaaattagccaggtgtggtggtgcacacctgtaatcccagctacttgggagactgaggcaggagaattgcttgaacttgggaggtggaggttacagtgagctgagattgtgccactgcactccagcctgggcgacagtgtgagactccgtctcagaaaaaataaataaataaaaccagtctttggactggtattcatacatgatcaagcagtccttggtctatatcaaaataagaaaaataaggacaaaggccaggcacggtggctcatgcctgtaatcccagcactttgggaggctgaggtgggcggatcacgaggtcaggagattgagaccatcctggccaatatgttgaaatcccgtctctactaaaaatacaaaaattagctgggcatggtggcgtgtgcttgtaatcccagctactcgggaggctgaggcaggagaattacttgaacccggaaggcagaggttgcagtgagctgagattgtgtcactgcactccagcctggtgacagagtgagactccatctcaaaagaaacaaaaaaaaaaaaaaaaagaggaaaaaatggtgttttttataaattgatatctgttcaactatttatttatttatttatttatttatttatttatttatttgagatggagtcttggtctgtcgcccaggcagcagtgcagtggagcgatctcagctcactgcaacctccacctcccaggttcaagtgattctcctgcctcagcctcccgagtagctgggattacaggcacctgccaccatccccagctaatttttgtatttttagtagagacacggtttcaccatgttggccaggctggtctcaaacttctgaccttgtgatctgcctgccttggccccccaaagtgctgagattacaggcgtgagccactgtgccctgccaaatatttttatattttaagatattgcatctcttacctgtggtgttgaaatgttctatatttttgaaatgatggtcatgtctgtgacagcttttttaacctcgagattttcagtaagcttattgaacacctctaatatacaagggctatgataagatctatggagatagagggtagaaaaaaagaataggacacagatatggaactgtgatcatgagatggtatgtgaggaagatcctgttctgaggccatacagtaattaggatttgtaaggactaaatccaggtacctagaggggaagagaggatgtattatgtggaaaaatgccatggggcttttggagaatagaggtgaactatttattttttaacttcgtatctatcttccaaagcatctctaaaaatacattttattggcttgcaatattaatttactgcaggtctaaattaaagttgaacaacaaagttctgtaatgtgctcagtgtatactgttattttccctccaccctcttctttctttaagcaggtgtagaaaaaaatgaacagaggtactgtgaacagtatttgttgtaagaatgtgtatttctggctgggtacaggggcccacgcttgtaatcctagcactttaggaggctgaggcaggcggatcgcttgagctcaggagtttgagaccagcctggacaacatggcaaaacccatctctactaaaaatacaaacgattagccaggcgtggtggtgtgctcctgtagtcccagctacttggggggctgggcaggaggatcacttgagcctgggaggtggaaactgcagtgagctgagatcataccacttcactccagcctgggtgacaaagtgagaccctgactcaaaaaaaaaaaaaaatgtgtgtttctttggagtagagtgtcttttctaaatgactggcttggccgtgtgcggtggctcatgcctgtaatccgagcactttgggaggccgaggcgggtagatcacgaggtcaggagatcgagaccatcctggctaacacggtgaaaccccgtctctactaaatatacaaaaaattagctgggcgtggtggcgagtgcctgtagtcccagctactcgggaggctgaggcaggagaatggcgtgaacccaggaggtggagcttgtagtgagccgagatcatgccactgcactccagcctgggcgacggagcgagaccctgtctcaaaaaaataaaataaaataaaataaaataaataaatgactggcttaaccttctgtactggtagaataaataaatatagtaatatttggatgtacatagtatttttaagaatgaaagaaaatttctgtgtctttgatttttaactgttaagagtagaaatacagaatgtggctaactgtcttgctacctgtatgatttttagaatatttatctttaagtgcaatttgtttttgggcagaaaaaataagctcccctaagaaagttgttacatcaccaagaaaagttcctccaccatcaccaaaaagtagtggaccaaagcgagcacttcctcccaaaaccttggcaaattattttaaagtatctcccaaacctaaaaataatgaagaaataggaatgcttctggaaaataataaaggtaagacattaaattgacaaattttatattttttaataataatgacccttatacctaaaaatgtgagcacattttacgagttcctgttgctatttattaaatctcagctacactgaaggttctacatgtagaagtgttaatattttgtttccttttttttttttttttttttttttttttgagacagagtcttgctctattgccaggccaagctggagtgcagtggcacaattttggctcactgcaacctcttcctcctgggttcaagcaattcttctgcctcagcctcccgagtagctgggattactggtgcacaccaccactcccagctaatttttgtatttttagtagagacggggttttgccatattgttcagactggttttgaactcctgacctcaagtgatccacccaccttagcatcccaaagtgctgggattacagatatgagccaccacgcccagcttgtttcagtttttgtttgtttgagacagtctcactctttcatccaggctggaatgcagtggcgcaatcttggctcactgcaacctccgcctcctgggttcaagtgatgctcctgcctcagcctcccgtgtagctgagattacaggtgtgtgccaccacacccagctaatttttgtatttttagtagagttgggatttcgccatgttggtctcgaaaccctgacctcaggtgatccacttgcctcggcctcccaaagtgctgggattacaggcatgagccaccgcgcccgtcctgtttcagttttgataatggatttcagtttgagcttattctgtggacatatccaatgtcttagcaaaagttgattttacctaaaatattaatattgtatttatgcaggaataaaaaattcttttgaacagaaacaaattactcagactaaatctacaaatgcaactaattcaaatgtcaaagacgttggagctgaagaacccagcagaaaaaatgcaacatctcttattctttttgaggaggtaggcttatagaagtatacatttgtgagagctcatgataaagacttactttaaagaatactgtatgttttcttataaagaattgtaaaatagctaaggaggtcaggaatacgtgtatctatttgaaattaaagcaaattaaactgtccactctagaataatttttcaggaagatgattaatgtaattcacggctgctaattattgttaaatgattgtataaattattctgatccatatctgtctagttataggtggctgcgtttgtttttaacatttgatagttgataattttaaaattcattatagtgtatgacataaactttcaacatgagctgaattcacacttcataaattcataaattttgtctctaacagacatagaatatttactatgtatacataactgatattagtaagtgtattaatatattaatattctaataaactgtaggttgatgtaatttttgatgaagatgctgggtttttgaatgcaatcaaaacattcatggcaacaactaaacgacctgtaatccttactacaagtggtaggtaacaatgattttacttcagttaaacagttactcaaatctgtagttcatctgcagactggagtaattataattaactcacaaatagcaattacttttttaaaattgatactactttgggttactatgttgggtattagatatttaggaattggagaacaatctctagaatgcaaataagaaatctagtaatggtattttggtagggaaaatactagattcttctcctggtgtccttatcatacctataatcagatcactaaatctgatttagtggtcaggattttttatggaacccaacctttctgctgttccttaatcctgaacttagccactcttttgcccctgataacactttcttatgaattattgtatatttagctatcatcagcctaatagaattgatccatcttctaaagaattatcacagaatgtttcattttaaaaactcattcaatttctttttcaaaaaattggaaatactataataattttctaatatttttccaattataaatattcatgaggctagtctctacttacaaattaatgcccatttggtagtgattgtactcttaaaatattgagaaaaatcttattaatcagaagttaggtggtgttttttttttttttttttttttttttttttggagacagagtctcactctgttgcccaggctggagtgcaatggtaccatcttggctcactgcaacctctgcctcctgagttcaagtgattctcctgtctcagcctcctgagtagctgggactacaggcacacaccaccacgcccagctaatttttgtatttttagtagagacagggtttcaccatattggtcaggctggtctcgaactcctgacctcatgtgatccacctgcctcggcctcccaaagtgctgggatcataggcatgaggcactgtgcccagctggtagttttattagaagatcatagttggccaggtgtggtggctcatgcctttaattccagcactttgggaggctaaggtgggcacttgaacctgggagttttgagatcagcctgggcactatagtgagacccccatctctacaaaaaaacttaaaaattatctgggcatggcagcttgagcttataatcctagctgcttgggaagctgaggcagaggatcacttgagcccaggagtttgaggctgcagtgagctatgactgcaccacagcactaggcagtggtggggaggcgggtgctgaatattttcatagaaaagtataacttgaaaaagttatttattggtcttagtgtttaagaattttttttttttgtgtgtgtgtgtgtgtgtagacccaacatttagtttaatgtttgatggctgctttgaagaaatcaagttcagtactccttccctggtaagttttaaattttgatagccacaaattacatatcaccatcatgtaaaagtagtttattattaaatacagctataatttttttttttttttgagacggagtcttgctctgtcgcccaggctggagtgcagtggcgcgatcttggctcactgcaagctccgcttcccgggttcacgccattctcctgcctcagcctccgaagtagctgggactacaggcgcctgccaccacgcccggctaattttttgtatttttagtagagacggagtttcaccattttagccaggatggtcttgatttcctgaccttgtgatctgcccgcctcggcctcccaaagtgctgggattacaggcgtgagccactgcgcccggtccaatacagctataatttagccaggtgtggtatcacgcctgtactcccagctacttgggaggctgaggcaggaagatcacttgagcccaggaggtggaggttacagtgagctgaaattgtgccactgtactctagcctggtcaatcaatcaatcaataaggccaggcacagttgctcatgcctgtaatcccagcactttgggaggctgaggagggcagattgcttgagctctggagttcgagactagcttgggcaacatggcaaaaccctgtctctacacaaaaatacaaaaaattagccaggtgtggtggcacatgcctgtagtcctacctactcaggaggctgaggtgggacaattgcttgagcccaggaggtcgaggccatggctgcagtgagctgtgattgtaccactgcattccagcctgggtgacagagcaagattctgtctcaaaaaaaataaatacctggccgggcgtagtggctcacgcctgtaatcccagcactttgggaggccaggtagggtgggtcacctgaggtcgggagtttgagaccagcctgaccaacatggtaaaaccccatctctattaaaaatacaaaattagctgggcgtggtggcgcatgcctgtaatcccagctacttgggaggctgtggcaggagaatcgcttgaatttgggagatggaggttgtggtgagcctagatcgtgctattgcactccagcctgggcaacaagagtgaaactacatctcaaaaaaaaaaaaaaagaaaaaagagctataatttaaatgtggtttctaaggaatatgttaaaatttttaagttttaggaaacttctgattatttctcttttttttgctttaaaaatgtgttttcttaaatttaaaataatttttactaggcttcaatgttcactaggttttttgcctagtaaaagtgcttttctgaggtaaaatttaaatggagttaaaatgcccttacatgaataacttaatgaatatattttgtacatataacatatgtaaaaatcagtgtcatcattatgcagatcagaatatagagcatttccattacctcctaaagttctcatggaccctttctagtaagaatccccttttccaccagaaatagccaccttttttttttcttacgatgatgaacaaggcacttttttaacctttaaaaagatagtgtttttgtgtatatgtctttttttcttattttttcctttttcttttttttcattcttctaaaaaaaaaaagtttttaaaattaacattgagttgctgggcatggtggctcatacttgtaatcccagcactttgggaggctgaggttagaggattgcttgaggccaacagttccaggctgcagtgagataattgtggtcaggtcaattttactgtatgggttattttatttttttaggtgaggtctcactctgttacccaagctggagtgtagtggcacaattgtcctgttgcccaggctggagtacggtggcacgatcttggttcactacaacctccaactcctgggttcaagcaattctcccacctcagcctccctagtaattgggattggagacgcacaccaccacgcctggcttattttttttgtatttttagtagagacgggatttcgccatgttggccaggctggctttgaactcttgacctcaagtaatccacccaccttggcctcttaaagagctgggattacaggcgtgagccaccgcgcccgaccctgttcttacttttaaattgtgtttcttagctggaggcagtggctcacacctgtaatcccagcactttgggaggcagaggcaggcggatcacttgagtccaggagtttgagaccagcctgggaaatgtggtgaaaccctgtctctacaaaaaattaaaaaaattagctggatgtggtagcgcacacctgtagtcccagctacttgggagattgaggtgggaggatcacttgagtatgggaggcagaggttgcagtgagccaagatcataccactgcactccagcttggtgacagagcaagaccctgtcccccccccaaaaaaataattgtttcttttaaataacacataattgaatatttttaaaaatttgtctaggccgggcgcagtggctcacgcctgtaatcccagcactttgggaggctgaggtgggcggatcacctgaggtcaggagtttgagatgagcctcaacattgagaaaccccgtgtctactaaaaatacaaaattagctgggcgtggtggtgcatgcctgtaatcccagctactcgggaggctgaggcaggagaattgctcgaacctgggaggcagaggttgtggtgagccaagatcgcgccattgcactccagcctgggcaacaagagcgaaactccatctgaaaaaaaaaaaaattgtctaaacaggctgggggctgtggcttatgcctataatcctagcacttttggaggccaaggtgggtggatcccttgagcccagaagttcaagaccagcctgggcaacattggcgaaatcctgtctctacaaaaagcacaaaaattagctggatgtaaaaagaaaaaaaattaactgggtgcagtggcatgtgcctgtagtcccagctacttgggaggctaaggcaagaggattgcttgagcctgggaggcagaggttgcaggaagccaagattgtgccacagcactccagcttgggcaacagagtgagactctggaagaaaaagaaaaaaaaaacaatttgtctagacaattcttcattcttccttttctgcagtcttttggattaaccaagtatattatttcatttcaccttcactgttggctttcagctatatgctaatatggtctccactacccaaatgaagctattgagcttttaaaatgtggctagtctacagttaataaaagatcacattttgtatgataataattgtatgaaatgtccagaataggcacatttatagagacagaaagtggattcatagctgcctaaggctagaggagctaggtagaaatagggagtgactgctgattggtctggggtttcttttggggatgatgaaaatgctctgtaattagatagtggtaatgggtgcaaaactctataaatatactaaaaccattgaattttacatgttaagtgggtgaattgtatagtatatgaattatatctaaatacggcttattatctatttttaaaatgtggctagaccccatctctactttgtgctaaagtgtaatataaacaccagattttttttttttttttttgagatacggtctcactctatctcctaggctggagtgtagtggctcagtctcagctcactgcaacctctacctcctgggctcaagcagtcctcccctctcagcctcctgagtagctaggaccataggcatgtgccaccacgcccagctaattaaaaaaatttttttgtagagatgaggtctcactatattgcccagactggtcctgaattcctgagctcaagtaatactcctgcctcagcctcccgaagtgctggtattacatgcgtgagccacagtgcctggctaacaccagattttgaggactcagtgcaaaaaataggaatgtaacacatctcactaatttttatattggttacattttgcaatatttggatatattgttgtaaaagaaatgtagtaaaattaattattattattttttgagatggagtctcgctctgttgcccaggctggagtgcactggcgcaatcactggctcactgcaagctccacctcccaggttcatgctattctcctgcctcagcctcccgagtagctgggactacaggcgcctgccaccatgcccggctaatattttttgtattttttagtagagatggggtttcaccatgttagccagaatggtttcgatctcctgacctcgtgatccgcccgtctcggcctcccaaagtgctgggattagaggtgtgagcccccgcatctggccctaaaattaattttacttgtttctttaattttttaatgtgactcctagacaatttaaattacatatatggcttggtttttaaaatttttgtattaaaaaatttgcttttggtaaagaacacgtaacagtgtacagttgaatagtgttaagtatattcacattgctcttgcaaaactgaaattctacgcttgttaaatgaaactccctgtttcctcctgtccagtagttgctggcaactaccattctactttgtttatatgaatttgactatgctagatataaatggaatcatactgatttggcttgttgtgaccggcttttttttttttgagatggagtctccctctgttgccaggctggagtgcagtggcacgatcttagtcatgcaacctctgcctttggtttcaagcaattctcctgcctcagcctcccaaagtgctgggattacaggcatgagccatcgcgccaggctgtgactggcttatttcacttagcataacatcctcaaggttcatctaagtcgtagtatgtatatagcttacagtgttttacttgcattatatttcttttcttttcttttttttttttttttttttttgagatgtagtcttgctctgtcacctgggctggagtgcagtggcacgatctcagctcactgcaacctctgcctcccggtttcaagcaattctcttgcctcagcctcccgagtagctgggactacaggcacgtgccaccatgccctgctaatttttgtatttttagtagatatggggtttcaccatgttggccaggcttgtctcgaactcctgacctcaagtgatctgcccgcctcggcctcccaaaatgctgggattacagacgtgagccaccgcacctgcccctttccttatatttctttttcttttttttttttttttgagacagagtcttgctgtgtcgcccaggctggagtgcagtggtgcaatctcggctcactgcaagctccgcctcctgggttcacgccattctcctgcctcagcctcccgagtagctgggactacaggcgcccaccaccacgcctggctaattttttgtatttttagtagagacggggtttcactgtgttagccaggatggtctggatctcctgaccttgtgatccacccgcctttgcctcccagagtgctgggattacaggcgtgagccaccgtgcccagctgcctttgccttatatttctaatggacagtactgctgtagattctagatgttcttttcctttgtcgttgctaaattctcttattagttatagtagttattttgttggtttcttaggtttttctttgctttttttctattttttaaatttttattagaaacagggtctctctgtcacctaggttggagggcagtggtgtgatcataactcactgtaacttcaaactcctagcttcaggtgatcccccaaccttggcctcccaaagtgctgggattacaagcatgagccaccacaactgtcagtttcttaggtttttctgtgtactcaatcatgttatctgcgaacagagatagttttctttcctttgttttttctgccttttatttctttttgttgccttatttcattgggtaggaccttcaatatgttaagtagaagtggtaacaatggatatccttagcttgtacttgatcttagatggaaagtgtttactattttactgttgaatacaaagttagctataggcttttcataccttctttttatcagattaaggaaatttcttttattccaactttcttttttttttttttttttttttttggttgagatggagttcgctcttgtcgcccaggctggagtgcagtggggcaatttcggctcactgcaacctccacctcccgggtttgagtgattctcctgtctcagcctcccgagtagctgggattataggcaagtgccaccatgcctggctaattttttgtatttttagtagagatggggttttgccatgttggtcaggctggtcttgaactcccgcctcgccctctcaaagtgctgggattacatgcgtgagccttggcccccaggctattccaattttcttagaatttttatcaagagtaggtgttggattttatcaacagcttcttttgcatgtgttgaaatcatatttttctacttttatctatctctatggtgaattatactgactgattttctaatgataaaccccccttggtcatgatgtattatccactttatatattgatggattagatttgtgattaatttattaaggatttatatgtttattttcttgaggaatactactttgtaacttttttcttttttttttttaagaattgtctttgttagctttaagtattaaggttaagctgccctcaaaaagagttgagaaatgtttccttctcttttttctaagagtttgtatagggttgatattctttattttttggtatttgatatacttcatcagtgaatttatgagttttctttgtgggaaaatctttgataaattgaattattttatttatttatttatttatttatttatttatttatttattttcgagacagagtcttgctccatcgccgaggctggagtgcaatggtgtgatcttggttcactgtaacctccacctcccaggttcaagcgattctcctgcttcagcctcccgagtagctgggattagagatggggtatcaccatgttgggcaggctggtctcaaactcctgacctcaggtgatccccttgcctcagcctctctcaatttcttggccaggcacagtgggtcatgcctataatcctagcactttggaaggctaaggcaggaagactgcttgatgccaggagtttgagaccagcctgggcaatatagtgagaccctgatctctaccaaaaaaaaaaaaattaattagctttatgcactaattagtgcaatttctaacctggtttttaaaaaattgtgtatttttcagtgttatagtattcatatttataattttgttgtaagatattctatcaagctatactgttacttaatcctaaggggttttatcaaggtttataaaactgccttcagtgttcaggttggagaatctcctataaaagtttccttgctgtcttgcacaatatacagttaataaaagaaatacatgtaaatgcttttaatttaatggtatattcccttatatttttaaagcagtttcatcctcaagaagagcatttaagataatgtgaattttagcaaaatttgtctcacttttagatactatttgtatgtattattgctgtatctatttgaactcagcagttaaccacatttctctctctgttttgaagctaaatgttgccagctacctacaaatgatttgcttaactgagaattttagaactgatgtaaaagactttgtaaccttgttaactgcaaatacttgtgatatcagaaaaagtatcctttacttacaattctggattagaagtggaggtggagttttagaagaacgaccattaaccctttatcgtaagttgatttgttattaaagaaatttctattatgggaccctatttaaaaatctgtgctatggctgggtgcagtggctcatgcctgtaatcccagcactttgggggagtgaggtgggaggatctcttgaggccaggaggtccagatcagtctgctgaacatagtgagacccctgtctctacaagaaaatttatgggaggccaaggtgggaggatcacttgaagccaggagttcaaaaccagcctgcgcaagaaagcgagacccctgtctctacaaaaaaaatttgcaaaaattagctgcgcagggtggcatgtgcctgtaatactggctacccgggaggctgaggtaggaggatcacatgatccccgaagagtttgaggctgcagtgagctatgattatgccactgcactccggcccagacaatagagcaataccctatctctaaaaaaagaaaaaattatttatttatattttttgagatggagtctcgcactgttgcctgggctagagtgcagtggtgcgatctcggctcattgcaacctctgtctcccaggttcaagcaattctcctgcctcagcctcccgagtagctgggattacaggcccccaccatcacgcccagctaattttttttgtctttttagtagagatggggtttcattatgttggctaggctggtctcgaactcctgacctcatgatccacttgcctcggcctcccaaagtactgggattagaggcgtgagccaccgtacttggcccaaaaaaaaattttttttaattaaaaaaactctgtgctatgctagaatagttgaaagattataaaaattttaagcaacttgttatattaatcttcaaaataaatatgcacatgtcaactttgttcataaaacattttggcctggcacagtgtctcacaactgtaatctcagcactttgggaggccaaggggcatggattccttgagctcaggagtttgagaccagcctgggcaacatggcgaaaccccatctctacaaaaaattggctgggcatggtggtgcgtgtctgtggtcctagctacttgggaggcagagatatgaggatcactagaatctgggagatcgaggctgcagtgagccaagatcacgccactgcactccagcctgggtgacagagtgagactctgactaaaaaaaaatttttgcagtcaatgtgagtaaatagaattaaactggatctagaaagttggatttttttcctggctatgctactctttacaattaatatataagctccaaaattcactttacctttttgagcctgttttttcacctaaaaaaggagagatctgaactaatctataagttacttattcttttgtagttgagcttttaagatgatctcattgtttaattttaaaaaaacacacacaggctgggtgcagtggctcacgcctgtaatcccagcactttggaaggccgaggcggttagatcatgaggtcaggagatcaagaccttcctggccaacatggtgaaaccccatctctactaaaaatacagacattagccgggtgtggcggcacatgcctgtagctactcgggaggctgaggcaggagaattgcttgaacccaggaggcggaggctgcagtgagccaagatcgcaccactgcattccaacctgggcgacagagtgagactctgtctcaaaaaaaaaaaaaaaaattaaaaaacacacacacaaattaaaaaacaaacacaaaaaacctcccaccctgttccccctttcctcttcaaaagtttttcttttctttcttttttttttttttttgaggtagggtctcgctatattgcccaggctggagtatagtgactcttcatgggcaggatcataatgcacagccctgaactcctgggctcaagcgatactcctgtcctagcctcctgagaaggccactgtgttcagcttcctccccagaaatttgactcttaaattttcaaactgttacttatacatgtattaacatatataagtacttataacatagtacttataaacaaatgatactataattattatttaacaactttttcacttactaaaaacattaatttttctatatgagtatatatatatataggtatatagtattcttatgtaactataacgtacaatcacttttagcttcaggagtctttaaattctgtctttcctaaatactttattatttcagaaatgcttttatttcttattttttttcagtcatcattgttacctaattcaagtgagtaccttctccatgccaggtcttgtgtttacatggttaagacatggttccttgcctgaagaagttttagtttggtttccatgctccatagtcacggttttgtagttacagatcctattctggtaaatacacaaatatttcaaggaaaccaaggtgaaattatgtaatatttatccttatcagttttttcttctaatgagtttaacattttaacgtattctttttcttttttcttttcttttctttctttttttttttttttttttttgagacagtgtctcattctgttgcccaggctggagtgcagtggcagtgcagcatggctcactccagcttaatctcctggactcgagccgtcttccgccctgagcctcctgagtagctggaaccacaggcgtgcaccaccacagctaacttttttaattttttgtagagacggggatctcactatgttgcccagcctggtattgaactcctgggctcaagtgatccgcccctcttgggctcccaaagtgctgggattataggcatgagccacctcacccagcttcatattattctttttcaaagtagatatgcctatatattctattcagtgtaagcccatagctttaaccatttctcaaaagtaaatataatacataacacatggaaaatatcctggtgtaacaaattagttaataactttttgatataccactagatataaattgttacagcaagaaactttagaagacacaaaataacaaaataagtacagcataatttctcttcttttctttttttttttttttttttttgagatggaatctggctctgtcacccaggctggagtgcagtggcacgatctcggtttgctgcaacctctgcctcctgggttcaagggattctcctgcctcagcctcccaagtaattgggtctacaggcgtgtaccaccacacccagctaattttttgcatttttagtagagacagggtttcactgagttagccaggatggtcccgatctcctgaccttgtgatccgcctgcctcagcctcccaaagtgctgggattacaggcatgagccacagcacttggctggggccagtttctcttcttaaaaatctttttttatatacatttcatccctgcccttaaaaaaaaaacagatacataaaacaatattcccctacttcttgaaagtagccacagttagacctttatgcatgtaacataaagatacatacttatttagcaaaattaaccagtattatatatgttgttatttttaagtttattgttagcacatacgatcctatcccactgtctttcacagctgcatgcttttctatagaatagaatggatgtaccgtaatttaaccgttacttacagacatttacattatcttcaatttgtcattaaaatacagtgaatatctttatacatatatccttgaaaatgtctgtaatattgatggagagaattctagaagtatgactgctgggtcacaaacggtgtatatactttacattttgatagttgttgtcagactgccctctgatgataattgtaccaacttatgctcccatgaatagtatatgatggtttttttatgtgtactgctgacagaactacattataattcttttaattttgccaatttaaaaagtgaaacatgtacagtatcttattttaaaattacatttccatgcttagtggtgaaattgcatatctttttattaggtctttgaaattattattattatttgagacggagcctcactcagtcgcccaggccagagtacagtggcgtgatcttagttcactgcagcctctgcctcccgggttcaagtgattctcctgcctcagcctcccaagtagctgggattacaggcacgcaccactatgcccagctaattttttatatttttagtagagatggggttttgccatattggccaggctggtctcgaactcctgacctcaggtgatccacccgcctcggcctcccaaagtgctgggattacaggtgtgagccactgcacccggctgaaattactgtttcttttttcttccccctttgagttggagtctcgctctgttgccgaggctggagtgcagtggcgtgatctcggctcactgcaacctccgcctcccaggttcaagctattctcctgcttcagcctccctaatagcgggggctacaggcatgcgtcaccacgcctggctaatttttgtattttgaatagagacaaggtttcaccatgttgcccaggatggtctcgaacttgcccaggatggtctcgaactcctgaactcaagtgatccacctgcctcagcctcccaaagtgctgggattacaggcgtgagccacctcacctggcctgaaattaatattaggtatttatttttcttctgtgacttgcctgctcacagtccttgcactttttctgttggatggctttgaaagtcccccaccatcacctcacttaatttatctcttggtagaaataatgcttatggccaggcgcagtggctcacgcatgtaatcccagcactttgggaggtcgaggggggtggatcactcgaggtcaagagttcgagatcagcctggccaacatggtgaaaccctgtctctactaaaaatacaaaaagtagccgggtgtggtagcgcgtgcctgtaatcccggctactcgggaggctgaggcaggaaaatcgcttgaacccaggaggtggaggtttcagtgagctgaaattgcaccactgcaattcagcctgggtgatagagtgatactctgtctttaaaaaaaaaaaaaaaaaaagaataatgcttatattgtactcttaatgaattaaacacatatgtagagaactaaatgggggtatttgtccagaagatgtcaaaggatctcaggctttaaataattgtttgatacaatttgtttaatacatatatagagctaagattttcttttattttgtaggtggaaatagcagaaatgtacaactagtttgctctgaacatggccttgataacaaaatttaccctaaaaatactaaaaagaaacgtgtagaccttccaaaatgtgacagtggctgtgctgagaccttgtttggccttaagaacattttttccccatctgaagacttattttcatttttaaaggtattttcaatgtctgttttgcaatgttgaatttatattccttttcatattcccaacattagcctcctatcttttgaatcttaagtttaacttaaatgtgcctataatttgtataagccttaggtctctgattttaacacatcctaccactttgacaaatggtgcataggcattgctctgaatgcatattataggatttagaatagcatttagaaaatttttcagatagactatttcagaaaagtggttttaaataaatgagcttctaataatattggagtatatactaaatacatagagaatttaattctccaaattaatcgtctaaatttaatttttagacatagtactattttgatatattaaatatagataaataaaattatgaggggtagtgactcagtactttgaatttagaatagggataacactatattcatacaggtagaaaagtattcaaactatgtactgctgtaacatttctttactcaaaattgtttttcagcacaaaatcacaatgaaggaagaatggcataaattcatccagcttcttacagaattccaaatgcggaatgtagattttttatatagtaatcttgagtttattctaccattaccagttgataccattccagaaactaaaaacttttgtggcccatcagtaactgtggatgccagtgcagcaacaaaaagtatgaattgtcttgctaggaaacactctgaaagagaacagccattgaaaaagtcccagaaaaagaaacaaaagaaaacattggtaatattagatgatagtgatctatttgacactgacttggactttcctgatcaatctattagcctgtcctctgtatcatcttcctcaaatgcagaagaaagcaaaaccggagacgaagaaagcaaagccagagacaaaggaaacaatccagagacaaagaaatctattccttgtcctcctaaaacaactgcaggaaaaaaatgttctgcccttgtttctcattgtttaaattctctctctgagttcatggataacatgtccttcttagatgcacttttaactgatgtaagggaacaaaacaaatacggtagaaatgactttagttggacaaatggaaaggttacaagtggactttgtgatgagtttagtcttgagagtaatgatggatggacttctcaaagctctggagaattaaaggcagctgcagaagctctcagctttactaaatgttcttctgctatttcaaaagcattggaaaccttgaattcttgcaagaaattaggaagagatccaaccaacgatcttactttttatgtttcacaaaagcgcaataatgtatactttagtcagtcagcagctaatttagagtaagtcttacttcctttactttttattttttggtaataaatcgtaaaggggaaatcaatagagttttttcttaatttaaaaatgctgtactattgatcatggtaagcccttaacattaataatgtagcttctaatgagatagctaaagagaccagcttgatcgctgggaagagaaataatgagtgattggggtggatttaggtaatgcttgaatgacccaggaaggagtttggtcttgctgtatagttattgagattttttcagtatgggagtgattgatgtgttgacaggaaattaatctggaaatgtcatctggtctagaccagaggcaaggaaactaaactggttgtgattgggattactgcatttttcttgggcattaaaaattaaaaacaatgcattacttttacagcaatgcttggaagaggatatcagtcattaaaagtgtattttcgagtcgatctcttctctatgtgggtaatagacaagctagtataattgaatacctgccaacccttcgaaacatctgtaagactgagaagctaaaagaacaaggaaaaagtaaaagaaggtaaaggctttattaaaaacaacattttagatagctttttcaagattaatacatattttcataagatgaaaatgttaatattaaattgtatttttctttgtaattttgacagattcctgcactattttgaaggaattcatcttgacattccaaaagagactgtgaatactttggcagctgacttcccttaatgttccatactaacaatgctttgtatagattatcatgtggtccttaagatacatttttatattatgtggatcttcatggaaaagtatatttctcgatgtacattttaaacaaacaatttgtatatttttttattggcgggtaaatatttaaaatatttgagttacaaattttatatatgattgtaattttttttctgaattttttgtattatctgatttagctttgttggagtattttttgtatgtgagtgaactgtttctggaaggtagagttcattaagatgaactccctatttcaagtgtttatattatatattagcttaatattcagatacattatcttggctgctaacattagtgtcactaaagttggtatacaatctcccactgctaaatttgactggctttacaaaaacaaaaacattatctggtgaattatatttttaacctaaaagttaaggatcctcatattgtacagttttttttgtgtgctttttttttttttttttgagacggaatcttgctctgtcacccaggctggagtgcagtggcctggtatcggctcagtgcaacttttgcctcccgggttcaagcgattatcctgcctcagcctcctgaatagctgggattacaggcatgtgccaccttgcccagctaatttttgtatttttagaagagacagggttttaccatgttggttaggctggtctcttaactcctgacctcaagtgatccatctgcctcggcctcccaaagtgctgggatcacaggcgtgagccacctcacctggcctatattgtacagttttgaacagtatagatgcatacctgtttacaaatgtgtatgaagatagatatttttacctcttatttgttcaatttactttttcttgtattaattagtatattgatctaattaaaggttaaagctaaaggctttatgaaatgtttaaaaaa

SEQ ID NO: 709 - DNA, 4288 bp, Homo sapiens
ggcggcggagcggtgcgtgcggccggagccggagcggatcctggagccggagcggagcggagcggagcggagccggggcggagcgggccgagcgggccgagccagcagccgagctgggggcgcgggcgggcggcatgtaccgggcccgggcggcgcgggcggggccggagcccggcagcccggggcgctttgggatcctcagcaccgggcagctccgggacctgcttcaggatgagcccaagctggaccggatcgtgcggctcagcaggaaggtagcgcggggggctcgagcggggggcgcgggggacgggcagcggcctgcgggacctgccgctcgagggaagggccgcgcgggccgggccgcggggccgcccgtgggcgcggagcctggcacgtacgagtgggccccgcggagccacccccgggggagggggcgcttggagctggcctggggcgggtggggcgccggggacccgaggggggcgcctgtgcacccccaggatggccgcgaggcgtgtcctacagcggatgctccggggaggtgtgttccggggggctgtgttgtggggggccctggctcgcacacccacgttctgtaagggccagaaagaggaggcgccttccactgggagaactaggggcctgtctgacacctggaggggccgttgggggttcacgcattctgggggcgcaagagggggctttgtgcctggcgttggggaggggtgctggaagctgccgtgtgtattgcataggccaccgtaagagaaagttgtatatttcacgggagataggcccgggctggttgtctgtggggggcagaaagggcaagtgtgtgttgaaagcaggcaggcgaggaggggcttgtgcatcccacaagggacagatggaggggagtgcgttctccaggggcagggaggggaggttgggccctgctagagacaaggaaaaagccttctccagggccggggctgctgtaagcccggagcagggaggaaaagggggtgtgtattccttggggtgtgaggattccactggaggcagaggaaggggtgggaagggaagagagggtgacccgagggggtgctgtgaggggacggggtgcagacacccctctggagaggatgagcagggggtgggagtgttttcggtgcaaacacctgaggaggaaacagacaaaggcctggagtgagagggaagctgtccatgcatggaaaatggggcagaggagggaggggcactcctccgggacctgagcagacatattaattgaaaaattaaaaattaactaacatttgtagaggcctttatagttttcctcacttaagtctctcaacaaccccataaggtggatgttttttaactcgatttgtaaaagaggaaactgaggccagagagggagctcagggcagagccagttctggtcccggcctgtcatcgtcccttcacctgttgggttcaccaccctgaaggggtgcctgacaggtgcctttggcctggccctcaggcacggtcgcccagtagggtggacggggcagtagggtggacagggcagatcccctgagcgggcctcttagctcctctctgcccgcagttccagggcctgcagctggagcgtgaggcctgcctggcctccaactacgcgctggccaaggagaacctggccctgcggccccgcctggagatgggccgggctgccctggccatcaaataccaggagcttcgtgaggtggccgagaactgcgcggacaagctgcagcgactgggtgagggcacgtctgggagaaccccctggggctggtgggggcagttggccatccggtgggttggccttgggaagtgccaggctctgatggatgggagttgggcggacctgctcctggcttgctgggcagtagagttgaggaagtgagaggaagtggggagggttgggtgggagaaaggggacccaatacgcagggtccccctgagatgctgagggggacaaagcctcccctgtctcttttgtactaggacgaggagcagaaacttggtaggggccggatccacaaagcggtcacatgggcacggtacagatgaggaaactgaggctctagaccaggggaaagggaaatatagaatcacatggggtcagcgggagagtgcaagcccggggccctggcctgtctgtcactctgtccctctgtggccctcagaggaaagcatgcatcgctggagtccccactgcgcgctgggctggctgcaggctgagctagaagaggcggagcaggaggcagaggtgaggggaggggtggctggggctgggggccaggagggagacccattctctgccaccccctggctcattcttacacctcaggctggggagcccctcctctgggaagtccaccctgaatgcctggcgcatgccagagcctagcattgctgtccaccagcactggacagccagcagggctcactttcctacctgtgaatttttttcgggctcccctgtgactgggctagggcagcgtggatctggggctacagaggagctggggcagactttgtgctgggttgggagtgcagcgatcagtgagctgaaggtggtgggctcccgaaggacatgttaagtctatacttcacatatgtccctgcctctgctcctgcctcatctctgatccagcaggtctggtgatggcatccttattttagaagttagggctgggcacagtggctcacgcctgtaatcccagcactttgggagaccgaggcgggcggatcgcctgaggtcaggagttcgagaccagcctgaccaacatggtgaaaccccgtctctacaaaatacaaaaaaaaattagccgggcgtggtggtgcatgtctgtcatctcagctacttgggaggctgaggcaggagaattgcttgaacccgggaggtggaggttgcagtgagccgagattgcgccactgcactccagcctggaccacagtgagactctgtctcaggaaaaaaaaaaaaaagtgggaggacatttgtccacagttcacttagcaagtaatcggaggcaggcccaggctggaacgcaggtcccctgtcccccagctgaggggtgatcaccatggggagggcctcagggtgggaaggagtgaggaccagtccccagtctgtggtcgtgcctctcccaagccttcccttccctcccggcccaggagcagatggagcagctgctgctcggggagcaaagcctggaggccttcctgcctgccttccagcgtggccgcgccctggcccacctgaggcggacgcaggcagagaagctgcaggagctgctgcggcgtcgggagcgttctgcccagccggcccccacctcggctgctgatccccccaaatccttcccggctgcagctgtcctgcccactggggccgcccgggggccaccagcagtgccccggagcctgccccccttggactcccgcccagtgcccccactgaagggctcccccgggtgccccctcggcccggcccccctgctgagccctcggccctcgcagccagagcccccccaccggtaggatccacggtgcggccccccagttggggggcctagacaaacttgatgcgtggctcctcctcctcccccactgcctgggtggggggaggggcaggcccctccccctggcctcaggcaggccctggccctggaggctgagctggggaggagggtcccctggaagaggcccgagagggggctgggggtgggtgggcagggctttatgcctctggcgctgaagacaccctgccttttttgtttccgtgccccggggcctctagggtgatggaccagccccgttaaagaacttgactcaactacaggggcctgggaagatgcctgggtcccctaggggccttgccaaggggacctgtcgcaccccaccactccactgggctcgcacaacgccaaggccgccaggagtgttttacatcatgtcctgagcctacctttcccccaaattctggggcccacagcctaggagccaggtgatcaggcctcggctgtggggccagggacaccatggccctggggctactacgtgtccacacatgctccagaccctggggcaaggtaggccaggggcttctgacctgtgcaggtgagagtgggccatacccaggaaagaccattctgtatttttctgtccctgtctccttagaatggaagctttttgagggcaggtccttgtctttgtacgttctgtccccagccccgcctcttaggggccgtcaataaatgtgatgatgaggatgacg

SEQ ID NO: 710 - DNA, 37876 bp, Homo sapiens
aaggtcctccgcgcgcgactacgctcataaaaggaaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtaggtggcgacgggccgtggcctgagacctccggcgaaacgcgggagcgaagggctgagtcctccctccgcgccgcggctcccgacctccctgaggcggcgctctaggggcggtgcgcacgcgctctgggcgggaggggggcggggctcgtgggggtgggggcgggagaggagggcggggccggggctcggggagggcgggccctgcgcccggccgctcgaggtctgcgcttgcgtgcttccatccccggcgagggtgggaaacagcgacacgctgggctcggcacggacgcagcttccaggtggggtactcggacccgggtcacgaagatgcggacagaggatgggccccgaactccagcacttattttatgatttgcacaaaaattttgtatatatatatagttcttaacaagatacactaacagctcgtcgtttgcccaggaggctcaacctcccgcctcggcctcccaaagtgtggggagtataggcgtgagcccccgcgcccggccaaaaaatgcccgtcttaagaacaacaaaacagcctccttcaccctcgctatcctccagttacctcctcctcggctccggtttgcagccaaaggccttagtctaccctcactaatgccttttctcctccaagtcttgaacccttgagcctctagtcaggctttggtctccaccactccactaaaaaggcttcttgtcaaagccaccagtgatctctaggtggccaaatgcattgttaagttaggtctcagtcctgttcagcatttgatgctgtggatcactgcccctccttgaaacactgttttcatttggcttgctgaacgttctcttcctttgcctctgctctctctggcttctcctctgctgattctaacctaggcatcatctcacatttttgtttttattagagacacgttctctgttgctcagactggagaacagtggtgttattacagctcactgcagcctcaaactcttgggcttaagcagtcctcctaaccaaagcctccccaaatgctggaattacaggcatgagccaccgcaatcccagtttcacattttaaatgtaaatactggccaggcgcggtggctcatgcgtgtaatcctagcactttgggaggccgaggtgggcagactgcctgagctcaggggtttgagaccagcccgagcaacgtggtgaaatccagtctcttctaaaaaaaaaaaaaaaaattaaaaaattagccgggcgtggtggtgcacgcctgtaatcccagctacttgggaggctgaggcacaataatcacttaaacccaggaggtggatgctgcagtgagccaagatcgtgccactgcactctagcctgggtgacagagcaagaccctgtctcaaaaaagagttctagaggtggaagaaaatccacatataagtggacctgcacaattaaaacctgcattgtttgagggtcaactgtatagctattttaaaagagatttattgtgatggattgggtgacactattatagaggctgagaagtcccgagatttgccatctgcaagctggaagcccaggaaagcaaaccctcaggaaactcacagacacactctaaagtgtttcaccagctatctgggaatcccctagcccaatcagtttgacacataaagttaaccatcacatttccctagctttgtttttcagttgcctcaatcatcattttactggtgatactttgagtgttgtcataatagcctaatggtgggttggcagcttccacttttgtgatctcttttactattgaatatgctgaagtcgtgacacaacttggaattcagaggaagagcataggttttagaacttgcagccttgcagccccagctcaactacctatttttcctgagttacctagcataacctatctgaatttcagtttcttcactatacttactattctgttatctattttataggattgctgtaaggtttaaatgagaaacactggcataagttgcaatacagaggcatgaaggaaaaaaattgtcttcttaatgtctctttaaccaattgatgaatatagattctatttatttatttatttatttttgagatggagtctcgctctgtcacccaggccggagtatagtggtgcaatgtcaactcactgcaacctctgcctcccgggttcaagtgattctcctgcctcagcctcctgagtagctgggattacaagcatgcaccaccatgcctggctaattttttgtttgtttgtttgtttgttttgagacggagtttcactctttgttgcccaggctggattgcaatggcgcaatcatggctcactgcaacctccgccttccggtttcaagcgattctcctgcctcagccttccaagtagctgtgattacaggcatgtgccaccacacccgattaattttgtatttttagtagagacagggtttcaccatgttggccaggctggtcttgaactcctgatcttagttgatctgccggccttggcctcccaaagtgctgggattacaggtgtgagccattgcgcccaacctacttatgttttttttagaaacaaggtcttactctgtcacccaggctggagcctagtggtgccattatagctcattattcccaaattcctgggctcaagtgatcctcctgccatagcctcctgagtagctaggactacacatgtgcaccaccctgcccagctaattattttattttgtttttgtagagacagggcctccgtgtgttgcccaggatggtcctgaactcctgacttcaagtgatcctcccatttcggcctcccaaaatgctgggattacggtcatgagccactgcacccagtttgcagattctcattgctagtgactgggttgagagtgtgggatgtgagtgtggggtattaggttcctctttccctttgacccagaacaaagctcttactgttttaagccctgtgggattaatcttagagtggcttaagtgtaggatatttggatttgtttatttgaggccttttatgctattatagtaaaagggccagcaattttaggctgggtattagtggttaacatatgcttctaccctgcagcctttgtccctcagaattggctatctcttcagaccgtgcttaatgaaagttcttattagtcaagctactcagttgcagataacaaaaagctactctgactagcctaagctgaaaggggtgtttgttgactctgtgatattgtaaaatatatatctggtttgtatcccagtttggagcttcctggagggtggcgtgcccagggtgggtatggaagctcttcgctccttcccacatgctttgccctgtgcacctcttccttcatctgtatccattgtgacatcctttataataagccagtaaacctaagtgtttccctgagtgctgagagctgctcctgcaaattaatggaacccaaggagggagtcatggaaaccctgatttatagtcagttggtcagaagcacaaataaagcaactgggggcttgtgactggcattgagaattggggggacatgctcgtgggactgagccctcaacctgtggggtttgacactctgtctgggtggatagtgttggaaataaactgaattagaggacatccagcgtgtatccactgcagactcaatggattgattggtgttggggagaaatctccacacatttggccacggaaatcttatgtgttgattatcctatattgtgacagcagaggagaaagttttgttttttcctcacagactgtagctgaagagtcctggagtaaatcagtttcagatgggactctatccagaagcctaaattatgtcaccagtattttctgtttttctttctctgttttttttttttttttttttttttttcagagacggggtcttgctgtgtttcccaggctggtcttgaactccaggcctcaagagatcctcctgcctcagcctcctgaaagctgggactacaggagtccaccaccacacctgggtacttttttttttttttgaaacggagtctcgctgtgtcgccaggctggagtgcagtggtgcagtctcgactcactgcgacctccacctcccgggttcaagtgattctcctgcctcagcctcccaagtagctgggactacaggcatgcaccaccatgcccagctaatttttttttttttttgtatttttagtagagatggggtttcaccatgttggccaggctggtcttgacctcttgacctcatgatccacccgccttggccttccaaagtgctgggattacaggtgtgagccaccacgcctggctgcacacctgggtactttttatttttggtagagatagagcctcgctatgttgacaagtctggtctcaaactcctgggctcaagcaatcctctgtacttggcctcccaaggtgttgggattacaggcatgagccactgcgacccgcctgtttattggttttgttaaatgccttgtcatgaggcattaaaaagcccatgatggaaagaagatagccccagagaagggattccaaattcttcacaaattcttcaacagatgagtggattaaaaacgacatctatccatagaatggaatgttatttaaccataaaaaggaatgaagttactgatacatgctgtgacattgatgacctttggaaacatgctaagtgaaagaagcaagtcacataaggtcacagtacaattctatttatatgaaatgtctagaataggcaaatctacaaatatgaattagaataatggctgccagtgactgagaggagaagggggtggggaatgactgctaatgagtataaggttttaaggagagttggtgaaaatgttctaaaattagatagtggtgatatttgcacaaccttgtgactaacataacactgaattgcacactttaaaaaagtgaattggggtgggtgcggtggctcacatttttaatcccagcacattttgggaggctgaagcaggaagattgcttgagcccagtagtttgagaccagcctgagcaatatgatgagacctcatctcaacagaaaattataaaattagctgggcgtggtggtgcacacctgtagtcccagccacttgggaggctggggcaggaggattgactgagccaaagaagtcaaggctgcagtgagctgtaattacaccacttcactccagcctgggcaatgagagtgagaccctgtctcaaataagtagatagagagatagagaattgtatggcatgcgaattatcttcattaagctgtttttgttgttgttgttgttttgagacggaatctcactctgtcacccagactggagtgcagtggtgcgattttggctcactttaacctccgcctcccggattcaagcgattcttgtgcctcagcttctcaagtagctgggattacaggtgtgtgccaccacacccagctaatctttgtacttttttagtagagacagtgttggccaggctggtctcgaattcctggcctcaagtgatctgcccaccttggcctccaaaagtgctgggattacaggtgtgagccaccgcacccggcccattaagctgttattttaaaaagtctgcctaaacctctgaactagacaaacatggggcatattccaagcaacttagccaagtttaaaagatcagtacagatttcagctgatgcttgcctcagggaagctagatttggagtttgagttcagctgtgattaactgcatgttaacagaaacaaaacaccaaactctcaagaacataacagaatccagagtctacaacacatcatctacaatgtccaggatataatccaaaattcttagacacaagaaatggcctgggcatggtgtcttatgcctgtaaacccagcacagcactttgggaggctgaggcaggcagatcacttgaggacaggagtttgagaccagcctggccaacatagcagaaccccttctctactaaaagtacaaaaaaattagctaggcgtggtggtacacaggaggctcaggaggctaaggcacaagaattgtttgaacccaggaagtggaggttgagctgagatcgtgccaccactccagcctgggcaacagagcaagactctgactcaaaaaaaaaaaccacgaaaattttaaaatatatttttacaaaacaggaaaatatgatctgtgttcacaaaaaaaggcaatgaatgggcccggcacagtggctcacgcctgtaatcccagcactttgggaggctgaggtgggtggatcacgaggtcaggagttcgagaccagcctgaccaacatggtgaaaccccatctctactaaaaatactaaaattagctggacgtggtggcgcacacctgtaatcccagctactcaggaagctgaggcaggagaattgcttcaacctgggaggaagaggttgcagtgagccgaggttacaccattgcactccagcctgggcaacagagcgagactctgtctcaagaaaaaaaaaaaaaagaacgaaaattttaaaatatatttttacaaaacaggaaaatatgatctgtgtttacaaaaaaaggcaatgaacgggcccggcgcagtggctcacgccggtaatcccagcactttgggaggccaaggcaggcggatcacgaggtcagcagatcgagaccatcctggctaacatggtgaaaccccgtctctgctaaaaatacaaaaaattagctgggcgtggtggcgggtgcctgtagtcccagctacttgggaggctgaggcaggagaatggcgtgaacctgggaggcggagcttgcagtgagctgagatcgcaccactgcactccagcctgggtgacagagcaagactctgtctcaaaaaaaaaaaaaaaaggcaatcaacgaagatcaaccccaagaggacccagatgttggtatcaactgacaagaattctaaaagagaatcaaaataattagttaaaataaatttttttaaaaatttaaagcagttattaaaacttcgtcaggccaggtgtggtggctcacacctataatcccaacaatttgggaggctgagtcgggaggatcgcctgagcccaggagttaaagaccagcctgggcaacatagtgagaccccatctctacaaaaagtttaaaaattagctggacaggcacagtggctcacgcctgtaatcccagtactttttgggaggctgaggcaggcagatcacctgaggtcaagagttggagaccagcctggccaacatggttaaaccctgtctctactaaaaatacaaaaattagctgggtgcggtagctggcacctgcaatcccagctacctgggaggctgatgcaggagaattgcttgaaacttggaggtggagattgcagtgagccaagatcgcaccactgcactccagcctgggcaacagagcaagactccgtctctaaaaacaaaaaacaaaaaaacacaaaaggtgcaggggaaagaaagaaagaaaagatgtggccttctaagtcagtgggaacacgagcatgctaggagtcaaaaagtttagggtactgggcgttacctcagcattcctaagaatgcttgaaaccttgctggaattgctgagcctctcagggtttgggacagttttgtttacatgatagaattgtgataagattagctggcaccctcggactctgataaaaccagccacttggcctggaagtgcagtgtcccctcatctggccttccaattcattatggttccaaccccagggcctcattcccacttgctttgcaccagcaggcttggcatttgttctcagaaggtcacagaaacctttgcttctacttagaacatgtttcctggggaagtttagacttatgactgaccagatccagagatagcagcactttgatgtaaaatcataggaagagcttgttctctcagacaagccactacccagtaggcaaagctcaaacgagagcccttaaatggtgtggtctttggccaggccatcatcgtggggttattcctaggtttggcaagcgtcagcatttcttttgcttgtgcgattggctcttttgctcagtgtaacagcagacccctggcctccagatgagaagggccactagcgttcactaagtgcatgctctgggccggccactgcctaggacctttcttagatagttgatcatcaagtaggtgctcttgttttaattttattgagacccagaaaggttaaataattcatccagggtgagtgtgaggctttatgagaactttacagttgttctctcccttccccctccttggactattcctggaacatgaaggtccagttcctttccctgatggctgtatggcaggtggcgtacttcatttctttgtgggaaattatacttgtattgatgctgggcatgctgctcgcctcttcagtgttttcccaagtaaggtctgacaaatggggatccaagccctcctgtatttcaggctttattttgggtaccaagatgcaaagacaatccattaagacagttcttggccgctcatggtgactcatgcctgtcatcccagcactttaaggaggctgaggcgggaggattgcctgcgcccaggagtttgagatcatcctgggcaacaaggcaagacctcatctctacaaaaatatttaaaaattagctgggtgtgatggtacatgcctatagtctcagctacttgggaggctgaggtgggaggatcacttgagcctgggaggtgcaggctacagggagccgagattgggccactgcactccagcttgggtgacagagtgagaccctgtctcaaaaaaaaaaaaaaaaaaaaaaaagacttagttcttctacttttaaggggcttgaagtctgagtagaagactcttccacacatagaaagcagtcttaaaagggtgtgtgtgctctgattgtggttatataacatttacagaaggtggatacagaatgaaaatcacttgaggttgttgggatttgctttaaaacatcctttaatgttgcatttttctttcaccttaattaggggaaaaagggagataattggaaacaggggtgaccagagtgctctggggaggcagaggttctgtaataactgttggtagccaaggaggccacaaagaagagaggatgtttgcgtggtaagagtgtgttgccattcgccagatacgtgccagaggcaagggacatcaaggcagtgggcacagttagatggtccactttgaaagttcgtggctgatgggatccagggatagcaagagcttattgtgaaattacaaaatgaggtggttctgccaggctaggcactacccagtaggcacagtgatcttccagaccacgtggtcagctctctccctgaaagtttcaacctctgtgtgttgtgtgtctatctgtgtgtctttgtcagcaaaagcttttatgagatacacaccattttttcttgttatatgtacatgggatatctttaaaggaatacccaagaaacaactagttgcctgtagcgataggagatttcgttgtatttcaaaaataatctgaatttttttactacgtgcatatattgtttactcagttttgtgtgtgtgtgtgtttttctagagaaacagactttttttttttttttttttttttgagacagagtcttgctctgtcacccaggctggagtgcagtggcgtaatctcggctcactgcaacctccacctcctgggttcaagcgattctcctgcctcagcctcctgagtagctgggactgcaggtgttcctgagtagctgggactacaggcgcacaccaccacacctggctaatttttgtatttttagtagagacagggttttgccatgttggccaggctggtcttgaactcctgacctcaggtgatctgcccgcctcggcctcccaaagtgctgggattagaggcttaagccactgtgcctggccaagagaaacagactttatgaacaaccacatgagacagtgagacaggtgatgaggacctaaactaaaacaatgacaagtgtggtgggagagagggggctgcattcccagcttgggaagccagctgtgcagcaatgctgttaaccagcatctagaaggcagagcagtgcgggactggaagtgtgagcatctgcgggtgcatctcagtgggattattcagggggcagttggaagtctgaattgggagccttgagaggtcagggttggtgacactgatttggaagtttagcctgaagctgatgagaatgcttagggagtgcttagagaatgagaagaggatcccggagcgatcttccaccgggttagagaaggaggcggcaacaaaccagaatggtggttagagacactggggagcgtggaggcctggtgtgttagcgttctccagagggacagaactctgtgtgtgtatatatatatgtgtgtgtatatatatatgtatatatatacgtatatatatatatacgtatatatatacacgtatatatatacacacatatatgtgtatatatatacatatatgcatatatatacgtatatatgtgtatatatacgtatatatatgcatatatatgtatatatatgtgtatatatatgtatatatatacatatatatgtatatatatacatatatatgtatatatgtatatatatgtatatatgtatatatatgtatatatatatatacacacacacacacacacacaaacacacacacacacatatatatgagtttattagggagaattgcctcacgattacaaggtgaaatcccatgataggccatcagcaagctgaggaaagagagaagctggtagcataattcagtccaagtctgccagccttaaaaccagggaagccagcagtgcagctgtcagtctgaggcctaaggcctgagagcccctgagaggtgtaagtctcagagtctaaaggccaaagaacctggagtctgatgtccaagggcaaggggagaggaggccaagtgtccggcgtgacacagaacagagccagcacgcggactcagcaagctgctggtcccccttcttccgcctgctttgtgccagccatgctggcagccaactggacggtgcccacccatatggaggatgggtcttcctctcctagtccactgacaaatgtcagcctcttctggcaacaccctcacagacacacccaggaacagcgcttcaccagccgtctaggcatccctcaatccagaccagttgttacctaggattaaccatcacacctggaaatctagagagtggagctttgaggtgcagtatgtaagcaggtgtgcagtgcagcagaaaggtccaggagctgccaggagctccctgggagctgagggtgggctgaggcgtgaatgggagaagtgacgatggtaggtatggtagttttttgttttttattttgagacggagtctcgctctgtcacccaggctggagtgcaatggcgcgattttggctcactgtaacctcctcctcctgggttcatgcagttctcctgcctcagcctctagagtagctgggactacaggcacccgccaccacacctggctaatttttgtatttttagtagagatggggtttcactatgttggtctcaaactcctgacctcgtgatccacccgcctcggcctcccaaagtgctgggattacagacgtgagccaccacgcccagccaggtatggtagttttatggtgaaggaaaggatagtgattcagtcagcatttattgagaacccagtgtgccaggctctctgctaggtatggagagtaaagtgatccctatcctcaaagactggacaaactaggggaggagacaaatatatacaaagaagatttgaatgtgatttggtaggtacagtgctagaaagagggtcttgggggccgggcacggtggctcacgcctgtaatcccagcactttgggaggctgaggtgggcagatcacgaggttaggagatcgagaccatcctggctaacacggtgaaaccccgtctctactaaaaatacaaaaaaattagccaggcgtggtggcgggcgcctgtagtcccagctactcaggaggctgaggtgggagaatggcatgaacccgggaggcagagcttgcagtgagccaagatcgcgccactgcactccagcctgggcaacagatcaagactctgtctcaaaaaaaaaaagaaaaagaaaaagaaagagggtcttaggggaacagaaaggcaacttaaccctgcctaggagactgggagtttcagtttgtgatcagtggaggaggtgacttggtgctaagctagatcttaaagattaagtaattaactgagaggattaggagtgatctggatgtcccagatagagggaacagtgtgaacatagggcaggcatggagataagaaattatgtggggctgggcgtggcggctcacatctgtaatcccaacacttttcagagccaaggtgggcaaatcactttgggctcaggagttcaagaccagcctgggcaacatggtgaaacctcatctctacaaaaattacctgggcgtggtggtacacacctgtagtcccagctactcaggaggctgagcctggagagagaattgcttgagcctgggaagcagaggttgcagtgagccaagattgcaccactgcatactagcctgggcaacagagtgagaccccatctcagcctcccaagtagctgggattacaggcgtgcaccaccacacccagatactttttttgtatttttagtagagaccaggtttcaccatgttggccaggctggtctcaaactcctgacctcaggtgatctatctgccttggcctcccaaactgctgcaattacaggggtgagccaccgtaccccaccagttaattggcttttaaagtacattcaattataaaatcattaccataatccaattttagaatattttctggacacactgattttcttttcattttcttgacttttaaaaatattatttttttaaggctttaacttcagtatgattttttaaatattatttttattatggaaaatttctagccatagagaagtagaagtgtgtaagaaatatccatgttgagcatagtaatttggggtcttttctggatagagatgttcaaccagtgagtgagtatcttagttcatttgggttgctgtaacaaaataccttaggctggatatttgtaaacaacagaaacatattgctcatagttttgaaggtgccatctttgaagcacagagcaagccctcaccagatgccgaatctgctggcaccatgatcatggacttcctagcctctagagcaatgcatttctgttgtttatacattccctagtctaaaatattttgttaaagcagccaaatggattaagacaaattggtaccagaagtggggtgctgctataacaaatacctgaagatatggaagcagctttggaactgggtagtgggtagagactgagttttgacgttcatactagaaaaggtttacattgtcatgaacaaatcattaagcacaggtgtggtaagggcacaggaggagagctgtagagaaagcctcagtcttcttagagatgccctaagagggcatgaacagaatgttggtggaaatatggatggtaaaggccattctgatgagatctcagatggaaatgaggaacatgttagtggaaactgggggaaaggtgatctttgttataaagtggcaaagaacttggctgatttgggtttgtgcctgttgacctaaaggaacaagcctaggcaaaattaatgtagagtttatttgggccaaggttgaggactgcagcctgggacacacttgtaagttgccttggggagtgctctgtttggcctttgttacaagcagatttttaaaggcaaaagggaatgaggagtgggctcacacaaagttttttgacaggggccaggtgtgttgactcacgcctgtaaccccagcactttgggaggctgaggtgggtggatcacctgagatcaggagtttgagaccaggctgaccaacatggtgaaaccccatctctactaaaaatacaaaaattagccaggcatggtggtcggcgcctataatcccagctgctcaggaggctgacgtaggagaattgcttgaatccgggaggtggaggttgcagtgagccaagatcatgccattgcactctagcctgggcagcaagagcaaaactccatctcaaaaaaaaaaaaaaaaaaaaaaaagttgtttgacaggaattctcgttgatttacagagataacatgaattagtgactggctatacattgttgaactataggatatgagaaattacagaaaatgccagtgtatgacattgtatagctactttgcatgagttagtttagagctcacatagcaagtggcttcatgaggtgattgattatttagcttaagtgtggagtgagacatgactgctgttgcatctcattgcttctctgggcttgataattaaggggtggttggggggggctcacattcttcagattaaaggtttcttggccaggagcagtggctcacgcctgtaatgccagcactttgggaggccgagggggatggatcacgaggtcaagagatcgagaccatcctggccaacatggtgaaaccctgtctgtactaaaaatacaaaaattagcggggcatggtggtttgtgcctgcaatctcagctacttgggaggctgaggcaggagaatcgcttgaacccgggaggcagaggttgtggtgagctgagattgtgccactgcactccagcctgatgacagagtaagactccatctcaaaaaaagaaaaaaaaaaaatacaaaattagacgggcgtggtggcgtgtgcctgtaatcccagctacttgggaggctgaggcaggagaatcgcttgaacctgggaggcgaagtttgcagtgagccgagatcacaccattacactccagcctgggcaacaagagcgaaactctgtctcaaaataaataaataaagtaaaagaaagaaagaaataaaaataaaagcttcttttctttcttatgtcctagtgttttgtgggagaacttaagagtgatgaaatagaatatttggtggatgaagtcactgaacaaagtggtgagggggtggcatggcttctcttgacggcttatagtaaaatgtgagaagagagaaacaaactaaatacagaatttaaagccaaaaggaaagcagaacttaagcatttggaagattctcagcatggccacgttgtaaagaatgaaaaagtaggctgggcacaatggcttacgcctgtaatcctagcactttaggaggttgaggcaggtggatcacttgagctcaggagttcaagaccagcctgggcaacatggtgcaaccctgtctctacaaaaaattagccgggcatggtggcatgtgcctgtggtcccagcttctcaagaggctgaggtgggaggatcacttgaacctgggagattgaggctgcagtgagctgaaattgcaccagtgcactccagcctgggtgacagagcgagagcctgtctcaaaaagaaaaaaaaagaataaatgtatttggagagaatatgaaaggtgtggccaagccatcctttgataaggagactagtatggatgtggaagccaggtactaatcaagacaatggaaggatgaccccgaaggcatgtgggggctgtcacccccatcacaggcccagaaggcccagggtgttgggggcagaaccatttcaaggctctgttcctagcattctggggcagtgctccttggcagcccgaggtagtttggcagcatccacatggcgctgtctttgctggtgcacagaatacacaagctgtaggggcatggctacccccacctagattgtaaaggatgccctgaagagccttgggcccaggcagagaactgacacagggtaaggcccctgcagaaagtccccattagggcattgcctagcagagctatgggggtagggttgcctctgagaccccagactggtagagccaccagtgtgcaactccagcctgggagagccacaggcatgcaactccaacaagtgagggctgttgcatgggctgtgcccagcaaacctgtacaggcagggctgcccagagcccagcaacatgtccctgccagtgtgtccagaaggtaggaggacatagagttgaagaaggttgttcagaaaccttgagattgaatggggtttgctctgttgggttttggacttacctgggacctattacccctttcttctttgttgtttctctcttttagaatgtctgtcctatgcctgtcccaccgttgtattttacaagcacataacacgtttgatttcacaggctcacagatggtggggaatttgccccaggatgaattgtactttgagtctcacccatacctgattgattgattgatttttttaaattttatttatttatttatttatttatttatttatttatttatttatttagcgagagagtgagcctcactctgtcacccaggctggagtgcactggtgggatctcggctcactgcaacctctgcctcccaggtttaagtgattctcctgcctcagcttcctgagtagctgaattacaggtgcctgccatcatgcccagctaatttttgtatttttagtagagacagggtttcaccatgttggccaggctggtcttgaactcctgacctcaagtgattcgcccaccttggtttcccagagtgtgggattacaggcatgatacaccacacccagccacccatatctgatttagatgatagatgagactctggactttagacttttgagttgatgctagaatgagtttctatttggggccattggggtggactgaatgtattttgcaagtaaaaaggacatgacttttgggggttcaggagccaaatgctgtggtctgagtgtttgtgttcccctaaaattcatatgttgaaacttgatccccaacatggtggggcctttgggaagtgattaggctgtgaggattccactctcaagaatggggttagcgcccttatgaaagaggcctgagggacttgtgttgccccttctgccatgttgagaatgcagtgagaaggcaccatctttgaagcggagagcgatgccgaatctactggggcctggatcttgtactttccggccttcagaactgtgagcaataaatttctgttgttggccaggcatggtggctcacgcctgtaatctcagcacattgggaagccgaggcaggtggatcacctgaggtcaggagttcgagaccagcctggccaacaaagcaaaaccccgtctctactaaaaatacaaaattagctgggcgtggtggcagacacctgtaatcccagctacttgggaggttgaggcaggagaatcgcttgaaccagggaggtggaagtttcagtgagccaagatcacgccactgcactccagcctggcgacagaactagactccgccttaaaaaaaaaaaaaaaaaagattctgaatctttgggaagccctctgggctggggatcgatttgggagtcagtaccatgtggttcatagttgacgcggtagcttgcagaagccaaggaaagcctacgctttcaaaaaaagtttggaagagtcaatgtaaggaaatccaaagtggacctaactgtggagatgggggtcagggaaggagagagctggggtgtgaagtagtgaaaattagaaaagtgcctgctaagtccctgacgctactaatgagtggtgattgattgatgaaagcagagatttccgttcttgcctgagagcttctagtctgttggggaagaaaagatacaccaatagcagctggctagaaggccagtttcttctttttttatttttatttttattttttgagacggagtctcgcactgttgcccggactggagtgcagtggcacaatctcggctcactgcaagctctgcctcccgggttcacgccattctgcctcagcctcccgagtagctgggaccacaggcacccaccaccacgcccggctaatttttagtatttttagtggagatggggtttcactgtgttagccaggattgtctcaatctcctgaccttgtgatccacctgcctcagcctccctaagtgctgggattacaggcgtgagccactgcgcccggcccttttgtatttttcttgagacggagctcttgttgcccaggctggagtgcagtggcacgatctcggctcactgcaacatccgcctgctgggttcaagcagctctcctgcctcagcctccgagtagctgggattacaggcaccggccaccacgcctggctaacttttgtattttcagtagatacagggtttcaccatgttggccaggctggtctcaaactcctgacctcaggtaatccgcctgcctcggcttcccaaagtgctggtattacaggcgtgagccactgcgcccggtagaaggccagtttctaaaggcgtgttgcagagtccatgtcagttctaggaagaatcaagcaagagaaaagtgtgcttctttaggactggtcaggcaagcgcagccttgagccagaagggaaagggctttgcaggtaggagtgggcaggcagcaagatcgtgtgtctgagacagtgtagagggaacaggccagaaggaatgtcagctgagccggggaggtgtcgctgggtatgatccagtgctagagcctgtctctcgctgcgcctgcctcctctcacacagccccctcttctgtccctggcttctcagcatgaaactccccccagccacgtgttcacattcctccgtgtcactttcctccattcagcaccccccataccccttcttgctcgctggcctcccagctgtactcccagacagagtaacctacatttgcttcctgcatttgcctccccctcctgtgtgttggcttctgtctcttccacggaaaatgttttccccaaggtcctcagtgacttcctcagctttgggagacccctctgagtcctcttctgtggcatttggtgctgtttatcatcccttctgtgactttcttttgacggatgtacagattgggagatggcactacacagctgggaagtgggggtgaggacctgggggggtgtaagagatagccaggctccagcccagaggaggagctggaggtgggtggccggcgaactgccaggagggaggccctgaagccagaggagaagggagtagcatcatgtcaagatcagtaggccacatcggaagcagcagagagggccctcacgcttcccctgcaggggctgttgactctcttgatgagagactgatgaggacagagctagagaagtgggttggaaagtgaagtggggacaaggaagcagcaccggatccctgcacaatttagggaagaagttttgccgtgaagaggaacagaggtgggggcctctaaaggggtttggaagctcttttgtgttttttcaggatgaactctcctcaatcatgcttgttcactggtagaggagaaaggattcgctgacagtcggaggggagatggagttcagaacacaaatgaagactgtttttccctctttagggtgaaggcagaggtgacaggcattgctatacagagcttgtagttttgatggtgggcataaagtctctggcttcccttccgagtgaagtaggaacctcagatatcagctaataggacccaggcctgggtctgagggcagtatcaaggatattgaggagagaggaggtttgaagtgtgctaagggaaggctaaccagatgacttggccacgtggttgcagcacctctcgctgtttgtgacagtgctgtgtaaagtaaaaccccctgtccagtggtggggctgttaatagggctcaggtgcgggcatgtgcaaggcgggccattggttttgttacgggtggaaggtatctgagttaccagcagcaaatctgtacgggtttgcagcaatctcacttcttgcctgttaagaattcgacttgggcacaaggcaggaaaagaccgaggcaagtttcagagcaggagtggaagttcattaagaagctttggaacaggaaagaaaggagaagtacacttgaaggagacccacgtgggtgctgaggtccagtgcggtgtttaaccttgatcctaggacattctaggaccaaggctggcccttttcccatgattcttccctcacggcgagctgcccgcatgcacagtgtgctccttacccttgggaggtgggcacatacacagtgtgtaggaagttgtacggatgcccatctgaggctttcttcactgttctggtgatgtgccctgggaggccatgctctgccatttggtctcttaatgtgcatgctcaggaaggtgcgtctccttggtgtctgcattcaattaacacttcagtgcatcaagtgtggaccgtcaggaaatggcctctccctggcacctagtgggtgggggagagccctctcctgccctgctcctgcctgtccaactccctataacagtttcagccaggattcctgctttagcaggagagaataaccctttctatgccaagccacaccttccctgatctggccactgagcttgcatcttctgtccacaccttcactttctttgttatggctcactggggttctttcctttttcctcacttagcagatagtctctagcctcatcagttcccaagactttagcaacagcctgcatgctgatcatgctcagatttatccacttccaatctgtgatctaaactccacttttattcttttgtgtggttttaactaatgcaactagggagactaaagcaacttcatcctgtattctaattcaccgtgttcacttctgattaattccagttctggaaaggactccaagatttccagtttgtctattgttccttgtgtaagagtacatacttaccataaatcctgccatggggtcacaccatcttgatgttatcatacttcagttgtccagtgcatcccttctgaaccaccctttccctatggtatacaagccctgggggtactggcaccaggatccaccatctggcttcaccaccacctgagacacagatgtagcttctgttcctaggtctctaaatgtttctaaggggatatgttcttctctatatgacaatgcattgtgtaaagctgtggtggtaaaaacagtgtcgtacatgtgggacaacacagatcaatatcacaagcagctaaaagaaaaagaaattggtcttcataaaaattaaaaacatgtgcttccaaggacacaactcaagacaactggctggacacggtggctcacacctataagcccagcactttgggaggccaaggcgggtggatcacttgaggttgagagtttgagaccagcctggtcaacatggtgaaaccctgtctctactaaaagaaatacaaaaattagctgggctttgtggtgcgtgccttgtaatcccagctactcaggaggctgaggcaggaaaattgcttgaagccgggaggcagaggttgcagtgagctgagattgagtcactgcactccagcttgggtggcagagtgagactccgtctcaaaacaaacaagcaaacaaaaaagacaaataaccaaactttaaaatggtaatatatacagatggccaacagcatatgaaaagatactcaatgccattaaccgttagggacacacaaatcaaaaccacaatgagactctacttcagactcactaggatggctgtaatcaaaaagagagaggccaggcatggtggctcacacgtgtaatcccagcattttgggaggccaaggcaggaggattggttgagctcaggaattcgacaccagcctgggcaacatagtgtgaccctgcctctgccaaaaataaaaatgacagagagagacaatagcatgtgttggcgcaaatgcagagtgggaatgcacattgcaggtgggaatgtaaaatggtcacccagttggaaacagcatgcagctcctcagaaggttaaacagagtttatgtttaatacacttattaagataaacatagtgtaaatacgttaaaaaaaacacattattaattctcatagatatgtacccagaaatgaaaacatgtcatgaatacaaagaaggaaacaacagacactgggcggggagggtaggaggagggagaagcgggaaagataaccatcgggtactgggcataatacctgggtgatgaaattatctgtacaacagacccccatgacacatatttacctatgcaacaaaccttcacatgtatccccaaaacctaaaattaaaattaaaaaagaagggccgggcgcagtggctcacacctgtaatcccagcactttgggaggtcaaggcaggtggatcacctaaggtcaggagtttgagaccagcctggccaacgtggtgaaaccccatctctactaaaaatacaaaaagtagccagcgtggtgatgggtgcctgtaatcccagctacttgggaggctgaggcaggagaattgcttgaacgagagaggcagagattgcagtgagccgagatcacaccactgcactccaagttgggcaacaaggctagaatctgtcccaaaaaagaaaaacaaagaaaacgtgcccacacaaaaacctgtacacaacgctcatagcagcattattcataatagccaaaaaaatagacgtaacccaatgtccatcagttcatgaactgacatgtaaaatatgatatagcaaaacaatggagttattcagcaataaaagcacaggcctggcatggtggctcacgcctgtaatcccagcactttgggaggctgaggcaggtggatcacccgaggtcaggcgtatcacccaaggtcagacattcgagaccggcctggctaacatgtcgaaaccccgtctctactaagaatacagaaattagccgggcgtggtggtgggcgcctatagtcccagctacttgggaggcaggagaaacacttgaacccgggaggcggaggttgcagtgagccaacatcgtgccattgcactccagcctcggtgacacagcgagactctgtctcattaaaaaagaaaaaaaaaagtgcagactacataaatctaaagagacagaaagtaaattaatatttgcctgggggtggggtggccatgtaccatgtatttaaagtgtgcaattcattggtttttagtatattcagagttgtgcaaccatcagcacaattttagaacattttcaacacctggccaaaaaaaaaaaacaaaaaaacccatactcattaatagtcgctgtcctttctctcccaacccttccccacccagctttctatggattcggctattctggatatttcacgtaaatggaaacacaattatgtggtcttctgtgattgcagcttctttcacttagcataatgttttcaaggttcatccatgtcatagcgtgtctcagtacttcatttctttttactgtcaagtaatattccactgtatggataatatcacactttatgcattcgtgtagtttctctacctccttcccaactcttgtctcttttttattgtaggtgtgaagtggtgtcttcagtagttttgacttgcatttcccaatggctaatgatacggagcatcttgtcatgtgcttggtgatcatttatatgtcttctttggagaactgtctattcagatcatttttgtatatgggctgagatagggaaccagattcattcttttacatgtggatattcagttgtcccagtaccatttgttgaaaagattattctttccccactaatttgtcttgacacccttgttgaaaattagtcgaccatttctggtttctcagttctattccattgaactagatgtctttgcttacaacatcttgattactgtagctttctttttttaaagttaaaaaatttataaagtagaagtggggctcaggctcgtctggtggcctaggctcgtctggacccctggctgcaagtgatcctcccgcctcagcctcccaaagtgctgggattacaggcgtgagcctctggggcctggccacaattgagttttgtttattgatctcgtatcctgcaactttgctatgagttctaaccttgtcttagtcctaatagttgtttaatggattccttagggttttctatatacaaggtcatgtcatctgcaaatagaaatagttgtacttcttcctttccaatgtggatgccttttatttcatcttattgcctcattgccctggcgagagcctccagaacaatgttgactagaaatgacaagggcccatgctcatcttgttcctgacttaggggaaagcttttaatctttcgcctttaagtctgatgttcgttgtgggtttttcatagatgcccttcatcaggttgaggaggttaccctctattcctagtttgtatgttattatacttttaaatagcagcagcagagcatgtaagaagatatgaataaatacatggcgagaggttcgcagttgattaagtggggggaagagtttactccattcatcgtgaatctgatctctgtgagtaggaggatgtgttagttgaacaactttaaaaaaaaaaaaaaaaaagagggcgaggtgggtggatcacgaggtcaggagtttgagaccagcctggccaagatggtgaaaccccgtctctactaaaaatacaaaaaattagccaggcaaggtggcgggtgcctgtaatcccagctactctggaggctgaggcaggtgaatcgcttgaacccaggatgccgaggttgcagtgagcagagatcgcaccgctgcactctagcctgggcgacagagcaagactctatctcaaaaaataaataaataaaaaataaaaatagagacagggtcttgctgtattgtccaggctgatctcgagctcctggactcaaaccatcctcctaccttcgcctcccaaagtgctgggattacaggtgttagtcactgcccccagcttgaacaaactttgtaagatgcaggctattgtgcaaaattttagcactgtaaaaaatatccccttattttatcaaatatacctttatcttgaggcatatgtctattttcacctacttgtaacttacactcttgattacttttggttgtctttttactcttgttctaattatctttttttttttttttttttgagacggagtctcactctgtcgccaggctggagtgcagtggcgtgatctcggcgcactgcaacctccatctcccgggttcaagcaattctcctgcctcagcttcctgagtagctgggactacaggtgcccaccaccatgcccagctaatttttgtatttttagtagagacaaggtttcaccatgttggccaggatggtcttgatctcttgacctcatgatctgccctcctcggcctcccaaagtgctgggattacaggcatgagccaccacgcccggccctaattatcttttattgtacagaagcattttattttcatcagagtacattcatcttgattgagatattttacagtagtttctctccccatgctggctgggcgtggtggctcacgcctgtaatcccagcactgtgggagactgaagcaagcagatcacctgaggtcaggagtttgagaccagcctggccaacatggtgaaaccccatctctactaaaaatacaaaaattagctggacatggtggcacacacctgtaatctcagctactcaggaggctgaggcaggagaattgcttgaacctgggaggcagagattgcagtgagccaagatcacaccactgcactccagcctaggtgacagggcaagactcccgtctcaaaaaaaaaaaaattatcttcccactatagtaagaaagtaacagcgttttatgacttggaaagtgtcttcatataaaatcttatttgaatctcccaaaatatagcagagatgatccccattttacagattaaaatatggataccagaaatgtttgaatcatttgtcaggatattggcagcagagcaggggctaagggcatgctatctttttaaggcacttcatattaatttttgtatttatatacaaaaattatacactccttgactccttgacttcgtcgaacatatgacattcaaacatatcaatagggtggaggagaatccaaggatagcttgccactgtattcatttcttatggctgccataacaagttactgcaagctgggtggcttaagacaagagaaatttattccatcacagttctaggggccataattccaaaatcaagatgtcagcttggttccaaagacaagggattgttgcttcttggaggcttagacggggccgttactccgcgcatctctcccggctggatgggtggctgccggcagtccttggcatcccctggcttgcagctgtccaagtccagtcgctgcttctgtctgcacctggctgtgtgtctggattaagggcacaccctattccactatgacttcatcttagtgacatcttaaatacttctccaaagaccctaattccaaacaaggtgacattacaggtaccatggttaggactacaatgtatctttttattattactatcttttaaagggatagggtgtcacactgtcatgtaggctggagtgcaatggcacgatcgtagctcatgcagcctcaaccccctagggcctagcgatccactcaccttagcttctcgaatagctgggactacagatgtgtgccactatgccgggctaagtttttaatttttttgtaaagacggggtctccgtgttgcccaggctggtcttgaactcctggcctcaagcaatcctcccgccttggcctcccaaagtgctgggattacagcatgagcctccaggcctaatgtatcttttgagggggcacagttcagcccacagcagccactaacagagttctcttctgtcctcgctcccccaccaggtgcccctgtagacaatggccctcgtgtctgccgattcccgcattgcagaacttctcacagagctccatcagctgatcaaacaaacccaggtaaaaagtcaccaccctccattcccagatgggaacatgggctttgatgctgagccgtgaagtgggggtggcatttgtgttcagagagattggactcgcaggaaccaaaatgacgtaataaaagtgaaaggaggggaatttggtgtatggctaccattcctgttggattttctaccatgtacaggatttcatgattcattttgtttgacagctatcctgagatagaattcacatgccatacaacgcacccatttaaagtgtataatccagtggtttttcgcagctcacaaaattgtgcaaccattagcacgatcaatttcagaacatttttaacacccaacaaaaatgccccatatcttttccttccaccctattaatccaggcaaacaaaaacactcttttttttttggagacggagtctcactgtgtcacctaggctggagtgcggtggcgcgatctcagctcactgcaacctctgcctcctgggttcaagcgattcttctgcctcagtctccctagtagctgggattacaggcacacaccaccatgtccggctaattgtttttgtatttttagtagagacggggttttgccatgttggctgtctctactaaaaatacaaaaattagctaggcttggtggcggatgcctataatcccagctactggggaggctgaggcaggagaatcacttgaactcgggaggcagaggttgcagtgagccgagatggcgccactgcactccagcctgggtgacaaagcaagactccatctcaaaaaaaaaaaaagccatttttcccctatttgatatcttttctttcacagatacaagggagatgcgtattggtgcctgtagctcactgcaggctatcgggcatgctctgccacattttgcccacgatactcagggtttatagctacacaaggatcagtttgctggcagttgtgcaccgcacagccaggaaggagtagatcccagaaattccttcccaaatggtattccttttagacgtaacctggagagtaagagtcagaagatgccggcactcattgctaagtgaaagatgccagtctgaaaggttacgtgctgtgtattccaactgtaaacgaaaagcaaaactagagagtgaaaggatgagcggtagccagggccttgggagagataggatgaaagggatggataggtggagcacagaggattttagggggtggaactcttctgcagggtaccatgatggggggcacgcaacatgatgcgttgtccaaacccatagaacggcagaacacacagagtaaaccatcatggggatggatgtagttaattatctaacagtattggctcatcagttgttacaaacgcaccactctaatgcaagatgttaacaataggggagactgcgcagggcagagcaggtatacatacaggaactctgtgccatcagctcagcttttctgtaaaccaaaactgctctaagaagagtttatcaataaaatacattgtaaaataaaggaaaaaagggctgggcgtggtaactcatgcctgtaatcccagcatgttgggaggctgaggcgggtggatcacctgaggtcaggagtttgagaccagtctggccaaatggcgaaactccatctctactaaaaattagccgggcgtggtggtacatgcttgtaatcccagctactagggaggctgaggcaggagaatcgcttgaacctgggaagtggaggttgcagtgagccaagatcgcaccactgcactccagcctgggcgacaagagcgaaactccgtctcaaaaaaataaataaaggaaaaaaaagatacaggcagattacgcattccattcagtcatccacagttagaacagtttatcatcatcccatacaaccagggtgtccctcagacagctgctgccgagttcccagactcccatctcacccgtcagcttccaaaagcaggcgtggtcctgacagacacagggcttcgccctttcaggcacccagtgtaactgacctaagagatggcattctctctctctcagcctctcttgaggtatgagtacaatattggatttccctcattgcataacccatttaatttgttctgttaactcggctactgtttctcctctccatttgtgattggttttcacccaaacttttccacctttgtaagggatgttagctttggccactgtacctggtccagattgcagcggcagcagtactagtctagcaagtatccccccccaaccccaatccattcccatttatatagggtggggttacacaggtatggactattggctgtcttgagcactaggcagctagctagctgtgttcactgttaacctcattttgcaggttgaggtaaaggcgcaacccacccatcaggcacttaaaaattctcacataaaggctaaaaagcatagtcataatttctttcttaggatctgtctcagtttccagcatctgcagttgcagctctgctcccaggatgactgatatgggaggaattgcaccagcattcttccccaccccttcttctccacatcaattgatcatacctgtatgtgtctatttctggactctgaattctgttctgttgatctatatgccagtaccacaccatcgtgattaccgtagcttcgtaataaattttgaaattgggaagtatgagttctccaactttttttttctttttccaagattggggataatctgggtcccgtgaatttccatatgaattttaggatgaacttgtcaatttctgcaaagaagtcaattagaattttgatggggattgcgttgactgtatagattgatttgtctctttgataaaggactatcattaaagatatcacttatgatttaactttaatgccttcttttttttttttttttaacagtctcactctgtcacccaggctggagtgcagtgacatgatctcagctcactgcaacctcagcctcccgagtagctaggactatacgcacatgctacaatgcccggctaatttttgtatttttagtagaggtggggtttcatcatgttggccaggctggtcttgaactcctgatctcaagtgatctgcccactttggccttccaaagtgctgggattacaggcttaagccactgcaccaggccctttaaggccttttataatgcttttgcattagtcaaaggagaaaatcatcttgaactcctgaatttggatttagaaaatgagggccatagccgggcgcccttgcctgtaattccagcactttgggaaaccgaggcaggtggatcacgaggtcaggagttcaagaccagcctggccaagatggcgaaaccctgtctctactaaaaatacaaaaaattaggccgggcgcattggcttacgcctgtaatcccagcactttgggaggccgaggcaggcggatcacgaggtcaggagatcgagaccatcctggctaagacggtgaaactccgtctcttctaaaactacaaaaaattaaccaggcgtggtggcgggcgcctgtagtcccagctactcgggaggctgaggcaggagaaaggcgtgaacccgggaggcggagcttgcagtgagccgagatcgtgccactacactccagcctgggcgacagagtgagactccatctcaaaaaaaaaaaaaaaaaaagaaaatgagggccgtattttggggatggggactctggcctggctggcagggtaccacagcagcacaaagggccaccgtcatgtcctgctgctcttttccttacaggaagagcgttcgcggagcgaacacaacttagtgaacatccagaagacccatgagcggatgcagacagagaacaagagtgagtagctgggctcaggagagaaaggggatgagatggggctagggtgagtatggccaagactgtgaccgaggtggtcattgtattcaaaatagatttgcatgtatctgcatattccaaaatgcagcaggagggacagctttccgttaatctgggtgacctgaagaactaaaatccctctactctgaggattcgaaaggcagtgaaatgaggctgtatctagggaagcttgcccttagagcacacaagcgccccagttagctggtgttttctagaaaggagcttccttcccaggcggcccctgcatctgccctgaggccctcaggtggtgagatcctggggctggggctttcttactctgggtaactctgagaattgtgttttcctgggtcctgacaaatattttctgtgagtgtcatgatggagaaaaggtaagacagtactctcgcagatgtagggatggcatttgtaccatatggaaatgcggactcatggagcctgggggcatccgcctcaggagcactcctgagccagcagagctctgactgcagctacggcctctctgtgcctccacgagtgtgattccggtgcatggaagcagtgccatgctactgtgcctgccctggccctgcctccttatccctgtgtttcctctgcagtttctccctattaccggacaaagctgcgtggcctctacacaaccgccaaggccgatgcagaggctgagtgcaagtgagtaccgtgcacccacttcatcgccgctccctcctttcctgggggctgggctgcaggtccatttggaccaagtccccagcctgccttcctcccatggataagctgattgctactcccagcctctcgcttgggtcccgcattccctggcccactgccaggcccactcttccagttacctctgctgctaatgcctttacagaaggtggcaaggcgtgagtcaacactgccgtttactggctctatgaccttggcagagtcattaaaatagggatatcaggggctgggtagctcagatctgtaatcacaacattacagaggtgattgggaggccgaggttagaggatcacttgaacgcaggtgtttgagaccagcctgggcaacaaagtgagactttgtctctacaaaaagtttttaattagctgagcgtggtggcatgtgtctgtaagcttggctgggaagtcatactcagatgacctgaaggttttatggttctgagatggagaagtttcacttccagaaaactcctgcttttaaaataatcttaaggccgggcaggcacagtggctcatgcctgcaatcgcaaggtgggtggatcacctgaggttgggggtttgagaccagcctggctagcatagcgaaaccctatatctactaaaaatacaaaaattagccaggtgtggtggcgcacgctacttgggaggctgaggcaggaggcggaggttgcagtgagctaagatcgtgccactgcactccagcctgggcaacagagcaaggctctgcctcaaaaaaaaaaaaaaaactaaaataaaaaaatgatctggaaacactgtttccttgaatctctgcaggagattcaggaacttgaacattacattcctctactttgagaacacactggttctgaagtctgactgtgcccagaggctctgtttatttggggtggagctccaacattggtattaactatctgacatttcctcactagtaggattcatgctttacacttttggcacagaagaggtgtctctggtgggtcatattagacggcacaggatgctgtctgtgccattggttaaagtggtattttccacgtttctcttgtatcagattactgctattttccattgtgtgattgatcgattaagacagggtctcagtctgtcatccaggctggagtggagtggcgtaatcatggctcacttcagcctcaaactcctggcctcaagtgatcctcctgcctcagcctcctgagtagctgggacaataggcacctgccaccactccacctaatttttgtattttttgtagagaggggttttgccatgttgcccaggctggtcttgaactcctcagctcaagcgatccacccaccttggcctcccaaagtgctgggattacaggtgtgagcctctgcacctggcctccattgcataattaataagtgtcttgggagatacttttgagactgtaactatcctgttcatatcaaacacactagttttagcatccatttatgatttgtgcgtgaaacaattgagattttttaaacttcccccaggagattctgatgcccaccaaggtttgaaagccacttcagtaacatgtcacagaagacagtttaggacaggctgtataaaactgtatcctccacacaggcctggcaacagtgatgagactctcagagttccctttggccccgtggctctttctccttctctgctttctggggtcccggtgctcacagcctgaggtggcactggctgggccatccctgcattgtacgcagcaggcaagctgttccttgtccctgcgttggtttggctgcccttggcctacctccatcttctggccctggcctggtgaggtccatgagtcacatgccctggggcacccccggacacctcccgagatgctgcatcacacccagttcctgtgcatctccttcctgccgcacaaaggtctttagaactccgggtcatttcagaaaggcttgccagaggaatggactggggtttgccatggtatcagaggaaaataaaatgacccaaagtggagtttgtgctgctgactactgtggaaatacgtattttttttgaaatggagtttcgctctgtcacccaggctggagtgcagtgacacaatctcggctcactgcaagctctgcccccaaggttcaagcgattctcttgcctcagcctcccaagtagctgggattatagacgcccgccaccacgccgggctaatttttgtatttttagtagagaaggagtttctctatgttggccaggctggtgtcgatctcctgacctcaagtgatcctcctgcctcagcctcctaaagtgctgagattacaggcgtgagccaccacacccatccctgctgtggaaatactctttgggaagattccctgagctttaggatgaaggagcctcactccagccaagttctgtgtttgcttctgctgggttctttgggttcctgccaccctggaatccccataaactaacttcacagaggcttcctggggcttcaaggccatgcaggggtctgtctttgggttcagcctttcagaaaggatgaggtccttccacccagttctgctctgggccagcacctctccccagagtctcccctccttttgtgtgaccctcgggcagacctgaggccccctctcctcatttcaggaggttcctgcagcctttctgcagggtttgccgaaggcagtttgcctgtgtcctttcctctctgggatcctgtgttctcttagtttttggcatgctgctttctaccaccttgttttttatgttcttaagactaaaagacacatactgaagatttccagttttctttttttttttgaaatggagtttcgttctttttgcccaggttggagtgcaatgacgcgatctcggttcactgcaacctctgcctcccaggttcaagcgattctcttgcctcagcctcccaagtaggtgggattacagttaaagacgctcgccaccacacctggctaagttttgtatttttaatacagacggggtttcaccatattggtcaggctggtcttgaactcctgacctcaggtgatccacactcctcggcctcccaaagtgctgggattacaggcgtgaaccaccacacccgggcagatttctagtttcaccatgaggttggtctgaataacccagcccaccttgaccagaacaggaacctgcacacacctgtcattccacctgcgcaggaggctactgtgagaacctctggagtccgggaccagcctgggcaatgtagcttgacccaaaacagaaaaaatggaagagaagtctatgctatgtacgttaaccaaaccctctttctcccttctccccgccctcagcatccttcggaaagctctggacaagatcgcggaaatcaagtctctgttggaagagaggcggattggtgagtgggagagaacatgctgggaggtcctttgctaggacaagaggagaggccctgcgggcagcagtcaccctcctgtgggggcctgtggccaccacctgctggcatcctcccatggaggctctggcagactggctctaccactgagaagggacaggaggtcattcccagtgcccagaggcaggggtttcccagttctccctcagcagccagagatcatcccgccctggcccctcatctcctgccccttctggggcctgggccagtcgccccctcctctgccatggcccatgcccatctgttgccctggctggtttctgcagagccacacgctgtgtgtcgtaaagccagccttccagaccccctcagcctgcattaggctctcctacctgtctgccctcccaacaatcccatggtgggcagaatcttggcatgtcagtgtccccacacagccatgctggttctgtgtgaagtcaagtggggtgtccagctgtgcctgaggaggttgaaggtgcacatttaattttttttttggtttttttaactttctgttgaattacaatgtatattaatagaagaaaagtacacataagtgcagagttcaatgaaatagtcactaactgaacacacttctgtaaccagcattcagatcagcaaacacagcctgaacagcaccttggaacccgctttctttcttctggttcctccccctggatccccgctgtgctgccatctcacccaactgtagttaaacccagcagcccctataggtgctgacacatggccgatggggtcacagtcctgctgggccctcgggctcactcgggaactgggggctcccaggtgctccttcaacagctcagtgcagcatgctcgggggtcaaggccggcacctatccctggggcctcaggcctcccttccttcccacagcggccaagattgccggtctctacaatgactcggagccaccccggaagaccatgcgcagaggggtgctgatgaccctgctgcagcagtcggccatgaccctgcccctgtggatcgggaagcctggtgacaagtgagggcagcagctgcgagggaggggctggtgcccaggggctgggactgaccctttgttccactcacaggcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtgagtgacaccaaccctggggctgctctctggtcaccgaacttgcctgggctacgggagaaaagctctgcagagggtgctccccagaggctggttgtgcagggagcaccaggtcctcccccatcctcactccccaacaggtactgcgcccctggctgcatccagccttttcctccttttgtctgcaggtatgaggtagatgacatcgatgaagaaggcaaagagtgagtgtccaggccagggcagggcatggagcctgggggcagcctaacagctgagaaggagcatccccacccggccacaggttgatataagcccctcttcccccaggagacacaccctgagccggcgccgtgtcatcccgctgccccagtggaaggccaacccggagacggaccctgaggccttgttccagaaggagcagctcgtgctggccctgtatccccagactacctgcttctaccgcgccctgatccatgcgcccccacagcgggtaaagcagcctccaggggagaggccatgggtgatgtcaggaacaggctgatcagacagacgaggggtcctctccccactccttccctttgtcctcatctcacaggctccaagctgacaggacccaccagctgccctccctcttccactccagccccaaaggccaccatccctttgccagccctggcagccttggcaagccccgagtcagtggcttccagccccaggagaaccagctccgagatgggaagctcctgccctgagccctgggctcctaccgccttgtgctcttggtgacatgggacacaagccacctgaggccaggatccctgcctgccaccctctgggttgccctcagtcctctcaacaaagagtccttgaaaggcagcagaccctccagctatgaccccactaggaagggagtcagcacccctactcctccctgcctattccctgccttgggtctccagccactgagaaaagagctctgtagcagcagggactgggccaagacttcttgaccccagagtgaaggatgttaggagtggctgagagtccacggcccagagcctcctgtggtctaggctgggggaagggggtgcctgtcctggcctgggggtctctgagcagcccctcctgtctgcctgccccacagccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctcta

SEQ ID NO: 711 - DNA, 191491 bp, Homo sapiens
gcgggccggggcggagggttcggctgcgcggcggggctgaggcggccgcggggcccgagcgcaggtaagggcgcccgcgaaccgggccaggggaagtgagggcgcggccggcgtcccggagaggggactgggacagctcggattcggctgcggaccgagttgggggtcggagtcggctgaggaggggggctgggtctggggacccgggctgcaactggaggctggggttggaattggggacggggctgcgcttagggggtcgaagttagctggggaggggctggggttggggattgggactgcacttggggctcagggctagctggggagggggcgggagttgcaggtcgaggttagctggggacggggcagggggtgcagatcgaggttagctggggaaggattgggtctgggcattgggactccacttagaaatcagggccagctggggaggaggctggagttgcaggtccaggttagctggggagggggctggaggtgggattggaggtctgagttagctgaggagggggctgggggtgagactggaggtctgagttatctggggaggggactggagttgcaggtcgaggttagctggggagggagcttggagcgggattggaggtctgagttggctggggaggggtctggaattgcaggtccaggttagctaggaaggggctggtggtggaattggaggtcttgagtttgctggggagggggctagagtcgcaggtcgaggttagctgccgagggggcttggagtgggattggaggtccaagctagctggggagggggctggaattgtaggtcgaggttagctggggagggggctggaagtggaattggaaatctgagttagctggggaggacgctggggatggtgttgggggttgaggttaattggagcggggaacaggggttgagtcaagggtgcagcttctttgaagagggagctgggagtggggttgaggtttgcagggagctggagagggggctggggatggagtttgaagtggggttcattggagagggggctgcagagggaattagatgttgaggttgtctggggagaggactgaggaatggggttggtgaagatgggggggtgtgattgacggcccaggggttagggttagctgaaaaggggcagaaggacaaagctggggtgagccagggagtggctggagcatacaggtgggggtcaggcttgttccagaaagggtctgggggctatcaggggaaatggggagcttgtgagtgtgtggggtggaagggggttcagggagaaggaagttggggtgagttagtgagaagggaggtgggggtaaggtcccaggctggagacacctgggggcaggtgttttgctagacattgactaatcaggaggaaaacggggtgtggggaggtgtctcaggtaggatccagttaaaaggaatttggagaggactcacccctctacttttgggggagatgttaattgtttgctctagaactgggcacggggcagaaccccctggggaacagtgagttgaaggagacgggagttcggaatactttttgaggtttatttctaggatatagggtgccaaggagaacgcttcaggaaggagaaaggctcctgtcggtgactgaatttttcaggaactaaagtgggagtttttgggacggtgctattgagcgacgtgggtggcactttatttttcctggggagcgggggttgctaggggttgggaggtgggcggtggaagacaggcttgatgaacagaggcagcggatccccagctaagcgtcttcacacggttgctaggtgtcagcgaggcaaatgccaagttcacaaacttgttcccgtcgtgggatgctgcgatcttgccttgatggagtgtcgggggcctctgggaggtgcgcctgtgtgtgttccgacccagcctctcgctgcggatttggctgtatcatcttttggaggtgttgtttactcccctgcaaagcgggaataataaaaacagtagcatgtgcctctcagggtcgaattacgggatgtatgcatggactatttcctagcatatagtgagggtacctgaagcatggagaataatggactcaatccagtttttttctttggtgggtttggagatggaggagtgggatgactgggttgtcacagaggagaggaaaggaagtgactggaacttgactctagtcctgcaaccttaggagcacacatcagggtcacccccagaagctttaaaaaataacctgcatggctggttgtggtggctcatgcctgtaatccccgcgctttgggaggccgaggcgggtggatcacctgaggtcaggagtttgagaccagcctggccaatatagcgaaaacctgtctctactaaaaatatcaaaaattagctgggcatagtggcgtttgcctgtaatcccagctacttgggaggctgaagcaggagaatcgcttgaacccaggaggtggaggttgcagtgagccaagatcacgccattgcactccagcctgggcaacagagagagactctgcctcaaaaaaataaaggaaaaaaaaaaaaaggactgcaacaacaacaaaaatatgtcttattattattgttattattattattatgttgagacagagtctcaaatatggagcctgtttccatattattaaaagtgagtaaaaaactgaaaagaaagaagactttgcccacacctggtggcaggagagtctcaaagctcgttaagtaacagatgcacctgttcaagagaaggctgcctgggtcattctgattaggggcaccccgtaaggaaccacatcgagctgtgattatacgcttgaaattttgagtttacaacttcagttcatggggtgcgtctgggtctctctatcccagcgctgcggacatttgggatctgattgtcctctggggtggggccttctgggcactgcagggtgccgagcagcatccctgacctccacccactccacaccaggagctccccgcattgtgacaaccacagatgtctccggatatcacccagcgtcctgtagggacagagatactccagtgtggaacccttgttatagacaaaactgatttattttctcctttaacgacctcatctcccctttgatgtgcaggaagtggggtcattcagaattgaggattgcttttaagtcatttagtgctgtcattcggagaggggagaagtaaggtctcactgcttttagaaaacattagaaatgcctacttatggctgggtgcggtggctcacgcctgtaatctcagcactttgggaggccgaagtgggtggatcacttgaggtcaggaattcaagaccatcctggccaacatggtgaaaccccatctgtactaaaaatacaaaaactaactgggcgtggtagcacacgcctgtaatcccagctacttggggggctgaggcaggagaatcacctgaacccaggaggcagaggttgcagtgagctgagattgcaccactgcactccagcctgggccacagagtgagactctgtctcaaaaaaaaaaaaaaaaaaaggctactcctttctaggtgggccttttatgtggcttttgaacacttagtactgatttagaagatggcctgaagttgtcagttgcaagcattggaagatgacaatgtttgcaatgtgctttcttggttttaacctggaacgtgaagcttccaacgaagctcaaattctgcaggtgcgtctcgatcttacagaggagctttatttagaaaacatcctttgaccgataccgttattttctgttcttgtttcatgcttcgtaaaccctggggccccactgtttgaaggcaaagagaactaaacacaaattaccctcacgtgtagacaattcagcttcgtgtttactgaatggaggcatttttcttgttcaccgatagtagtggaaaacactcctttcttcattcaaggtgttattcggattttttcagttccatctggaagcagcgatggtctttaaaatcgtatccagagtcatttgtatttttgaagatgcttcatggtttcttacaggaaggtcgtgcctggtctctataggcttgggagctggtgctttctttttttcttttctttcttttttttttcttttttgaaacacagtctttctctgtcaccaaggctggagtgcaatggtgcaatcttggctcactgcaacctccgcctccagggctcaagcaattcttctgcctcatcctctcgagtagctgggattatgggcgtacaccactgcacccggctaatttttatatttttagtagagacggggtttcaccatattgcccaggctggtctcaaactcctgacctcaggtgatccacctacctcggcctcccaaagtgttgggattacaggcgtgagccaccgcgcccggcctgtccttttttttttgagacatggtctcattccgttgcccgggctggagtacagtggtgcgatctcggctcactgcaacctctgcctcctgggttcaagccattctcctgcctcagcctcccgagtagctgggactacaggcacccaccaccacacccagctaatttttgtatttttagtagagacggagtttcaccatgttagccaggctggtctggaactcctgacctctggtgatccacctgcctcgacctcccaaagtgctgggattataagcatgagcccccgcacccggcctgtcttttgtttttgagatgtggtctcgttcattgcccaggctggagtgcagtggcgccatcttgtctcattgcaacctccgcctcccgggttcaagcgattctcctgccccagcctcccgagtagcttccattacaggcatgtgccaccacgcccggctaatttttgtatttttagtagagacgggcggggggggggacggggccctcaccatgttggccaggctggcctcgaactcctgaccttaggtcatccacccacctcagcctcccaaagtgctggggtgacaggcgtgagccaccgcgcccggccgctgtgtcctttcacggctgatttctgcaattctgcgtccttgttgatgtcgggcgcctctccccgctcgttgacatttcttgacttcacttgtcactgctttttatacatgcactctttggcctggcctctgtctcttaagggttagagaaaagtgttcatggtttacgtcacccaggagaccctaccgatgagtgtgagagctaaggagatgggctgacccatcctcagtcacacagcggcccccgaggggtcactcctgtcctcctcctcccccatcctgcggcgtgagtgggccacgctctctctgtgtggttgctcccccacatcggctcctgacacggatgggcggtggggttcgtgggcagctccgagacgcttccacgaacagttacttgaacctcgcaaaaggaaaagtcttactgctttttatgacaaaaattgaggtataatttacacttcataacattcagaccttttaaggatgcaattccatcttttaaataagtttatcagctgtgcaaacatccctataagcccctttcagaacattcctgtgatcccagcattttgggaggccgaagcaggtggatcagttgaggtcaggagttcgagaccagtctggccaacatggcgaaaccctgtcgctagtaaaaatacaaaaattagccgggcgcctgtaatcccagctactcaggaggctgaggcaggagaatcgcttgaacctgggaggcggaggttgcggtgagcactgcactccagcctgggcaacagagcgagactctgtctcaaaaaacaaacaaacaaaaaaacattccatcacctagtaaaatcttttgtccccatgagggggactctccaccccctcccccagccctggcacccacgcctctccctcctgtctctggactggcctgtcctagacatttcaaagaaatgggtcacacactgtgtggccttttgtgtctggtgtctctcactgcgtgtgacatgctcaaggtgcatccgtgctgtggcctgcgtcagagcctcgacccttttcagggctgagtcgtgttccggtgcgtggacaggccgggctgtgctcatccatccattcagcaacacacgctcggccgcttttgcctttgggcaatggagcacagtgctgggatgtaaatggctttttcctgggcacaggcagtccactgcactgaagcttgggatgtttgtttagtggttctttctttctctttctttctttctttccttccttccttccttcttccttcgtctttcctttctttcttcccttcctttcctttctttctttcttttctttcttttctttctttctttctttctttctttctttctttctttctttctttctttctttctctctctctctttttctttctctccttctctttctttcttttttctttttctttctctctctcctctctctcctctcttccctctctcccctctctcccctctctctcctctctctctttctctcttttctttttttttgacggagtcttgctctgtctcccgggctggagtgcagtggtgcaatctcggctcactgcaacctccacctcccaggttccagtgattctcctgcctcagcctcccgagtagctgggattacaggcatgcaccaccacacccagataatttttatgtttagtagaaacagggtttcaccatgttgcccaggctggtctcgaactcctgacctcaggtgatctgcccgcctcggcctcccaaagtgctgggattacaggcgtgagcccccatgcccggccccttctgtctgctttctttcccatctcagtgctccctcttgagccgagagcctcatcatccctggcgggagactccgaggtgacgaatcagcctctggtttctccagctccagcaggaccttcctagtaagcttcctgggcactgatcagacggtcacttccctgcctcctatcaagtcagcacccacatgatggcaccccagttcctcatggggtcttcagggtcctgcatggcctggccctgccctctgacccttcaagtaccccacccccacttggctccatccacctccccggtgcccctgggtttcctggacgctgctgttgctgtctcctttgtctgaaacgctccttccttccttcctctatccgacaaaggcccgttgtgtgcctattttaagcctcagaactggtgccaggccctgggagcaccacgtgaatgaggcatctgtgtgctggtgtgggggccgtggagatggcagtctgggtcagaggggcctgagcccagggtggcacagaggtgggggcctcgggcctgtgtgttctaggagctgaataggtgcaggggtgataagaagtcgtccaggggggtagagagggggctgcggaaggtccagacaggaggccacgaggaagctttgagtagaatacaagtttgccagggaacggattggtggagactggcccatcttggtgggtacacagagggcgctaggtctccccatgccactcaccacacattttctcagcctggctcactgcagcctcaaactccgggctcaagcaatcctcccacctcagcctcccagagtagctgggactacagatgcacgccaccatgcccagctaattaaaacttttttttgtaaacgtggaggtccccctgtattgcctaggctggtctcgaactcctgagctcgagttcaaccctaccctgtgatggcctgagtagggtcattttctggggcagggctgtcctgggcactgcaggtcctgaggtgccgagcagcgtccctggcctccacccactccacgccaggagcacctccagttgtgacaaccacagatgtccccagacatagcccagtgtccctcagggagcagatcacacctgggctaggggagtccacggactccaagagactccgcgtcccatgatcctctgccctgctgaggtcccaggaggctgcacacattgaaatccacaccctgagtggggagggagagaggaggtgagccccagaagctgggggtccccctgatttacactgtctgccccattgggagtttattctggtgtctagtgtgatcaggaagcagacttgatttttttcccaaataatgtaggggctccctcttagtactgcagataggggggaccggattgttctctggggtggggccgtcctgggcactgcagggtgctgagcagcgtctctgggctccacccactccacgccaggagcatctctgagttgtgacagccaccgatgtccccagacattgtccacagtcatctggggttgagaaccactgctctataccaggctatggtagaacagatcctttcaactaaaacttttttttttcccctaaaaactatggttgaactagttaagtgctattccctgcccccccccaaaaaaaagcaacaaaaaaatctccccaaaatgtagattcctccaaaaatagtgtcaccaattccagatagccttgacatttctgacccaaatcccctgtgcttacccagccttacaatctcaaatgtagcccaaccccagagagagaaaggaagataattttatcctcaaacaaccaagatttcttaggcatagagacattgccgtttcaaggtcagagtcatttattttacagacatttattaacgttcacaacacaatattaagtgtctgatattgtgtcgagtgatgggtttacaaaatgaagacagggacctcgacctctgagagcctccaagaggaggcggcatttgattagagacttgggggggttgtgggtagaatgtgggcgttcattctttaacccttgacgcatttatctggtgctgtctctgtctcatgtccagccatgccctaaatcagagcttgtccctgggggtgattctggccttcaggggacactgagcaacgtctggggacatttgtggctgtcacaaccggggctgctcctggcatggagtgggtggatgccatggacactgctcagcgccctgcagtgcccaggatggccgcaccccagagaatagtccagagctccgatgtccacagtgcccaggggagagaccctggtttgcagaaatggctacctttttggagtttctgtacagttactctttggaagatggtaaagtagaaaaagactacctttgatgtatgttaattagttgaaagtctgcttttcttttctttctttttttctttctttctttttttttttttttgaggcagagtctcgctctgtcacccaggctggagtacagtggtgtgatcttggctcactgcaacctccacctccctggctcaagcaatcctcccacctcgacctcctgagtagctgggaatacaggcagagatcactatgcccagctaattttttttttttgtaaagataggatattgctatgttgcctagactggtctcaaactcctgggctcaagcgatcctcctgcctcagcctccagagtagctgggactacaggcacatgtcaccatatccggctaattttttgtagagatggagtctcactatgttgcccaggctggtcttgaacccctgagctcaagtgatccacccacttcagactcccaaagtgttgggattacagacatgaaccactgtgcctggctgaacatctacttttctttttaatgagataggggcttactccgttacccaggctggagtgcagtggcacaatcgcagctcactgcagccttgaactcccaggttcaagtgatcctcctgcctcagcctcccagatggccaagaccacaagcatgtaccaccacacctggctaatttttgtatcttttgtagagaccgggtcttgctgtgttgtccaggctggtcttgaactcctgggctcaagtgattcgcccaccgcagccggcccacattctagaattacaggtgtgagccaccacgtcggacttcattgttcatttgacctttgttgacaagcccaagactgctgcccctggccttcttttttttttttttcgagatggagtctcactctgtcgcccaggctggagtgcagtggcgcgatctcggctcactgcaagctccacctcccgggttcacgccattctcctgcctcagcctcccgagtagctgggactacagacgcccgccaccacacccggctgattttttgtatttttagtagagatggggtttcaccgtgttagccaggatggtctcgatctcctgacctcatgatctgcctacctcggcctcccaaagtgctgggattacaggcgtgagccaccgcgcccggcctcccctggccttcttaaaaaactccctaacttgatggacaacaaagccaggaggaatcaaagaaaagaggtgaatccagccaagttcaaatgcagatgtcctggcagagtctgctgggcacagagacggctgtggcttcaatgtggtcggaaagtaaggcctggacttcgctggccttggcagtacccagttgtaggaggagcctggggctgccgccgtcatgaatgaccacagaccgggtggtaaaataacagaaatgtattgtctcatggttctggagaccaggagtctgaagtcacggtgtgagcagggctgcgctccttctagaggctccagggaaggaggcgtactgcctcccccaccccctgggggctccaggagtccttggcttatggcctcattgatccaatttctgcctctgtcatcacaaaaggccttctccccgggtgtccgtggaaatttccctcctctttttttttttttttttgagatgcaatcttgctctgctgcccaggctggagtgcggtggcatgatctcagctcactgcaacctccgcctcccgggttcaagcaattctcctgcctcagcctcccgagtagctgggattacaggcgtgtgccaccacgcccagctaattttggtatttttagtagaaacggggtttcaccatgttggccaggctggtctcgaactcctgacctcaggtgatccttccacctcggcttcccaaagtgctgggattacaggcgtgagccaccacgcccggctcttttccttttattattatttttttaatttttattttttttgagacagagtcttgctctgttgcccaggccggagtgtagtgatgcaatcttggttcactgcaacctccgcctcccaggctcaagtgattctcccacctcagcctcctgagtagctgggactataagcatgtaacaccacgactggctaatttttccatttttagtagagatggggtctcgccatgttgcccaggttggtctcaaactcctgagctcaagcaatcctctggtcccgtcctcccaaagtgctgggattacggatatgcgttactgagccaggccgaaaccatttctaatgattttatgattcttttattgcattaaagtacaaagatacagttgggtttttaaatagactttatttttttagagctattttaggtttacagcaaaatcgagcggtaagaacagaaagttcccatacacctccctgcaacccacaggcacagcctcccccattaccagcaccccgtaccacagtggtacattcgttataatcacaatggatgaacccacgttgacacatcattgtcacccagagtccccagtctctattggagtttactcttggtgttgaagattctacgggtttggagaagggtgtaaggatacgtgtccaccattgtggtatcctatagtttcactgccctggccgggcgcggtggctcgcacctgtaatcccagcagtttgggagtctgaggtgggtggataacttgaggtcagaagttcgagaccagcctggccaacatggtgaaaccccgtctttattaacaatacaaagcttagttgggcgtggtggtgcgtgcctgtaaccccagatactcaggaggctgaggtgggagtattgcttgaatctgggaggtggaggctgcagtgagccaagattgtgccactgcactccagcctgggcgacagagcaagaccctgtctcaagaagaaaaaaaaaaagacctgagccaacaggttgaaatagaaaaactcacatggatttgtaatcagagaatcttagaaaggcagctgaggaaggggcttggagcacgtccagtccaggagtcagtaaccaccgcccttgggccacctctggcccacagcctggttttatatatggcccctgggctaagaatgattatcccatttttatttttattttattttattttttgagacagaatctcgttctgtcacctaggttggagtgcagtggtgtgatctcggctcactgcaaactctgcctcccggttcaggccattctcctgcctcagcctcccgggtagctgggattacaagcgcctgacaccacactcggctaatttttgtatttttagtagagatggggtttcaccatgttggccaggctggtctcgaactcctgacctcaagtgatcctttcgcttcggcctcccaaagtgctgggattacagacgtgagccaccgtgcccggcctccatttttaaatggttggaaaaaaaagtcaaaggaagccctgcttctacccgccgccaaaagaagcaaaaaacaaaagtcaaagaaaaggccatgacacatgacaattatatggcattcagattttagtgtccagaaataatgttttattggcacactgctctgtgtattctgctaccatggtgtagttaagtcgttgccgtagagagtggctccaccgcaaggctgaaaacactgggtatctggactcttaccgaaaaagcgtgttggccctcgagtccatctcgcacgctttatgcatgggaaaactgaggtctggaggtttcacgagttagtggtcatgctgggacttgatcttggaactttgtactttagcatttgtcatgtcatttcagcctctgtgttgtcagagctctaacagttaacttcagagaattgcatcgaatatggtttttttttttttttttttttttttttgagttggagtctcactctgtagcccaggctggagtgcaatggcgccatctcagctcactgcagcctccgcctcccaggttcaagtgatcctcctgccttagcctcctgagtagctgggattacaggcgtccaccaccacacccggctattttttgtatttttagtagagacggggtttcaccatgatggccaggctggtctcgaacttctgacctcaggtgatccacccgccttggcctcccaaagtgctgggaggcccaccgagcccggcccaaatgtggtcttgttaggagcgtttattcctgtagcctccataatgagaagggcttaatgatttgggaacaattttatataattattttttttcccctataacacggtgccatgcatagtatgattggcatttttttccccctttttttttgcattatttttatttttgtttatttttttcttatttatttatttattgtatgtatttattatgttggggcaaacataattgtggtctttgccattaaaagtaatattttttaaatttacatttacatttttttttgagacagagtcttactctgtcgcccaggctaagtgcagtggagtgatcatggctcactgtagcctccaactcctgggctcaagcgatcctcccacctcagcctcctgagtagctgggaccacaggcacgcaaccccgtgcctggctaatttttgttttattgtagagatgaggtctcgctattttgcctaggctggtctcgaactcctgaacacaagtgatcctgccaccccggactcccaaagtgttaggaggacagacgggagccactgtgcccggctaacaatgggttcatttctctcaactccacactttattcaaatgtcattaatcttcccctaatgtcctttcctgccccaggacccatctagaatcccacgtgacatttagccggctcgtctccgggggttcttccaggttgggaccatgtcttagatgttcgttacctctcgtgacctggacggtcttagggggaccggctgggtattgtgcagacttacttctgatctaggtttgtcagatatttctctcgtgatcagaccggggttacgggtttcgggaaagaacacgtaggggtgaggtgccctgttgctctctccctgctggggatccttgagaccctggtgacttcctactggtgctgttaacctggttctcccagcccaggtggccttagcccacctaccagctactctgaggtcattcttgctgagggaactccccacttccccagagcactgacaccgactccatccttcgtacggcaaactttgcttttcatctttgcatcatgatttcttttttcttttgttgagacggagtctcgctctgtcgcccaggctggagtgcagtggcgcgatcttggctcactgcaagctccacctcctgggtttacaccattctcctgcctcagcctcccgagtaactgggactacaggcacccgccaccatgcccggctaattttttgttatttttagtagggacggggtttcaccgtgttagccaggatagtctcgatctcctgaccttgtgatctgcccagctcggcctcccaaagtgctgggattacaggcgtgagccaccgcgcccggctattttatctggaggcagagttttgttcttgttgcccaggttggagtacagtggcacgatctcagctcactcaggttcaactgattctcctgcctcagcctcccaaatagttgggattacaggtgcgtgccaccttgcccggctaattttttgtatttttagtagagatggggtttcgccgtgttggccaggctggtctcgaactcctgaccatgtgatctgcctgcctcggcctcccaaagtgctggaattacaggcgtgagccaccgcgcccggcatcatgatttaaacttcttggccaggctggtggcttactcctgtcatgccagcacttttttttgtttgtttgttttttgagatggagtttcactcttgttgcccaggctggagtgcaatggtgcgatctcggctcaccgcaacctctgcctcccgggctcaagcgattctcctacctcaacctcccaactagctgggattacaggcatgggccaccatgcctggctaattttgtatttttagtagaggcagggtttctccatgttggccaggctggtctcgaactcctgacctcaggtgatccacccgcctcggcctcccaaagtgctggcattacaggtgtgagccaccatgcccagcctaaccccagcactttgggaggccaagatgagaggattgcttgagcccaggagcttgagaccagcctggacaacatagtaagacaccatctctacaaaaaagagaaaaaaattaactgagtatagtggcgcatgcctgtaatcccagctactcgggagtccgaggcaggagggtcgcttgagcccaggaagttgaggctgcagtgagccaagatcatgcccctgcactccagtgtgggtgacagagccagaccttgtctcaaaaaaaaaaaaaagaaaaaaagtggccaggcgcggtggctcacgcctgtaatcccagcactttgggaggccgaggcgggcggatcacgaggtcaggagatcgagaccatcctggctaacacggtgaaaccccgtctctactaaaaaatacaaaaagttagctggatgtggtggcgggcgcctgtagtcccagctactcaggaggctgaggcaggggaatggtgtgaacctgggaggcagagcttgcagtgagccgagatcgtgccactgtactccaccctgggcgagagagcgagactctgtctcaaaaaaaaaaaaaaaagaaagaaaaaaagtaagtaaagtctcttttgaccccaccctacaaaggctccgctccttgggatcgtttcagggtgttggaaactcgtcgtcttccccatcttggcggcaaacactgaagagagctcaggagagacatctcccttctgattggagacatatgcgtcctgccggtcccgaatgtgttgcggggattggccgggatcccagtgctggagactgaagcaagcaggcaccgggccggggtgttgagcgcagctttgcctgagatgcaacatttttaaaaaggaggggggaggccgggtacggtggctcacgcctataatcccagcactttgggaggccgaggtgggtggatcacctgaggccagtagttggagaccagcctggccaatgtggtgaaaccccgtctctactaaaaatacaagaattagccaggcgtggtggcgggtgcctgtaatcccagctactcgggaggctgaggcaggagaatcgcttgaacgcgggtggcggaggttgcagtgagctgagatcgcaccactgcactccagcctgggcgacagcgtgagactctgtctcaaaaaaaaaaaaaaatgctgagacagagaccacacacggctgggaaactgcctgacagctggcactttctgccccctggcctctgggaccaagatgacacccctgggtccacattctcgctctgatgaagtgtctggtaaaggcagaggattgttggaaagcaggatatcggtgggggctgaggtggggttggagtgtccttggaaagtgaaactgggccgggacaggagagctctggcgagaaagagctcaggcctcctctcgcggggacagtgaatggggccctttgttttgccaaggcccttttcttagtggcctcttttcactgggcaaacaacggcagggtgtcgctgggtgttcaaggccgtcccctgcccaccaggccctcgtctcgggaggaggacaccgggcggtcacggacgttactgggcatccgacgtttgacacacagtggacggggcctcgtgacttcccaccctgtcccccgtctctgactctcagctgcttcccctctctcactttcttttgttttgcttcccttactttactttgagacagggtctccctctgtcacccaggctggagtgcagtggtgcgatcacagctccctgcagcctctgcctcctgggttccagccatcctcctgtctcaacctcccaagtagctgggaccacaggtgcatgccaccacgcccggctgatttttaaatttttttgtagagatggggtcttgctatattggccaggctggtctccaacccctaggctcaagctatccttcagcctcggcctcccaaagtgctgagattacaggtgtgacccactgcacccagccttctcttcatttttcattgtggtaaattacatgtaacataaaatttccccgtttaaccattttttgggtacatttaaccaaccactgtcccctccagaactttctcatcttcccaaactgaaactgtgtcctcatgaagcacagactccccagccccctccccagcccctggcactcccatcctactttattttcttttttctttcttttttttttttagacagagtctcgctcttgtcacccaggctggagtgcagtcgtgcgatcttggctcactgcaacctctgcctcctgggttcaagcgattctcctgcgtcagcctcctgagtagctgggattacaggcgtgtgccgccacgcctgtctaatttttgtatttttagtagagacaaggtttctccatgttggccaggctggtgttgaactcctgacctcaggtgatccacccgcctcggcctcccagagtgttgggattacaggcgtgagccactgcgcccgtccaatttttgtatttttagtagagacgaggtttttccatgttggccaggctggtcgtgaactcctgacctcaggtgatccacccgcctcggcctcccaaagtgctgggattacaggcatgagccactgtgcccggcccccatcctactttccgtctctgtgaatctgagggctctgggaacctcttaggagtggatcacggaggatgtgtccttctgtgcctggcttctctcactgagactgaggtcctcaaagtgcatcctcatcgtggcctgtgtcaggattgcctgctgttgaaggctgaatcatactccggggtgtgtatggaccacgctacgttgatccgtgcatccgtccagggtcacttgtgtcgctaccactttggggcctccatcaacagcactggtgcgggccgggcacggtggctcacgcctgtcatcccagcactttgggagcctgaggcaggcggatcacgaggtcaagagatcgagaccatcctggccaacatggtgaaaccccgtctctactaaaaatacaaaaattatccgggcgtggtggcggacccctgtaatcccagctactcgcgaggctgaggcaggagaattgcttgaacccaggaggaggagcttgcagtgagccgagatcgcaccattgcactccagcctgggcgacagagtgagactccatctcaaaaaaaaaaaaaaaaaaatggccaggctggtctcgaactcctgacctcaagtgagccacctggcttcagcctctccaagtgctgcgattacaggcgtgagccaccgcgcccggccccatcatttatttttaaacccatagacttgctggtcgcacttctgtgcccggtgggatttttgtccatttgacgtcgcttttgcagctcggccccctggggctgagggcggatttgagctcctctggccgatgctgtccaccagctccctagccagcccctgcaggagctcctttcttgtttctgcacgggtacctcccggcagcaagcccgtccctgcccgagctggcccgtccctgtgcaagagccggtcagccccaggcaggtttttcacagctcagttaatttccctccctcctcctccagggtctctctcttgtttttctcctcacctggaatgccctcggttcaggctttcaccatctccgcctgctccagctcccctgtttcttctccctgtctgatgtcaccttgtgcttcagtgacaccttgaagtttccgggctcccacccgcctccccactgccagtctttatcagagcctgcatcttcttctttggcctgagcatcgtttttgtttgttggctttatctgtagaagaggctcctacctcaagagcaggtaagaagaccacacagaaggcgtggagagtatctagcaggtattccggggaaaatagtctttttaaaaaaattagagatgcgggtcttggccgggagtggtggctcacacctgtaatcccagcattttgggagccgaggcaggcacatcacctgaggtcaggagttcgagaccagcctggcctcccacccaggctggcctagggcaacatagtgagaacccatctctattttttttttttgagacggagtctttctctgtcgcccaggctggagtgcagtggcacaatctcggctcactgcaacctctgcctcccgggttcaagcgattctcgtgcctcagcgtcccgagtagctgggattacaggcatgcgccagcacgcccagctaatttttgtatttttacaaaatttaaagagatggggtttcaccacgttggccaggctggtctcgatctcctgacctcgtgatctgcccgcctcggactcccaaagtgctgggattacaggcgtgagccaccgtgtcctgccgggagtccttattcagtgagcccaggatggaatcttctagaatgcagtagactgttatttgaatgcctccctcactcctacagttgcagctgcaggtttccgattgcccctcaccccagcattgcagttacccccagagcaacccctggcagctcttctgaggctctgtcttcagatgaggaaaccaaggctcatggcgtggagtgggagacttcaccggatggggtgggagcaggggcagggatgacccctgcctccctgtagctcttctttttttttttttttttttttttttgagatggagtctcgccctgttgcccaggctggagtgcagtggtgtgatctctgcaacctccgtctcccgggttcaagtgattctcctgcctcagcctcctgagtagctgggactacaggtgcgtgccaccacgcctggccaatttttgtatttctagtagagacggggtttcgctatgttggccaggctggtctcgaactcctgacctcgtgatccgcccgccttggcctcccgaaatgctgggatgacaggtgtgagcctccgtgcccagctcgccctgtagctcttttatgagatggctctgtctgcattttgcacaaactctttcatctccgtgatggaaccagccacgtttccttgcacatttttccaggtaaaactccggcttccttctagctgtggagttgattataccaggacccctcatgttaaaaactatcagcttcaggccgggcgcggtggctcacgcctgtaatcacagcactttgggaggccaaggtgggtggatcacctgaggtgaggagttcaagaccagcctggccaacatagtgaaacccagtctctgctaaaaatacaaaattagccgggcgtggtggcgcgcgcctgtaatcccagctacttgggaggctgaggcaggagaatcccttgaacctgggaggcggaggttgcagtgagctgagattgcgccactgcactccagcctgggcaacagagcaagactccatctcaaacaaaaacaaagaaacagaaactatcagtttcacttgaaaacatgctccgcatcagtcctcagggaaatgcaaatcaaagccatggtgagataccacttcacacccagtaggatggctagaattaaaaaaaccaaaacaacaaacaatcacaagggctcacggggaggtagagacacggggatcctcatgcgtcgctgctgggaacatcatgtggtacagctgctctggaaacagcctggcagttcctgaagtggttacatacagtgtttccatatgaccctgtgagttgactcctagacgtacacctaagggaagtgaaagcgtatgtccacacaaacactgcgcaagaaggatctggcccggtgatgtggctaatgctagtgatcccagcgctttgggaggccgaggtgggaggatcacttgagtccaagagttggagaccggctgggtgaggttgctcacgcctgcaatcccagcactttgggaggccgaggcgggcggatcatgaggtcaggagatcgaagccatcctgactaatatggtgaaaccccatctctactaaaaggacaaaaaattagccgggcgtggtggcgggcgcctgtagtcccagctactcgggaggctgaggcaggagaatcgcttgaacctgggaggtggaggttgcagtgagccgagatcgtgccactgcattccagcctgggcaacagagcaagactccgtctcaaaaacaataaaataaaaaaagttggttgctacaaaaaaaataaaaataaaaattagccaggcctgctggggcacacctgtagtcccagctacttgggagggttacacaggaggatcaaagaaacaaaaactgtcggtttcacttcaaaacatgctccgcgtcagtcctcagggaaatgcaaatcagagccatggtgagataccacttcacgcccagtaagatggctagaattaaaaaaccagaacaacaaacaatcacaagggctcacggggaggtaggacatggggaccctcatgcgagctcgggagacgaaggttgcagtgagctgtgatcacaccaccgcactccagcctgagcaacagagcaagaccctgtctcaaaaaagaaacgaatgaagtcgggagttcaagaccagcctgaccaacatggagaaaccccgcctctactaaaatacaaaattagccaggcgtggtgatgcatgcctgtaatcctagctacttaggaggctgaggcaggagaatctcttgaacccaggaggcggaggttgcagtgggctgagatctcaccattgcattccagcctgggcaacaagagggaaactccatctcaaaaaaaaaaaaaaaaaaaaattgtaaattttgtgttaagtgtattttactaaaaaacccactgttagtctatgtggtcacttttcagagcttttaatttttaattttaaaatgttttaattttttaaaaaatagagacaggtggctgggcaaggtggctcatgcctgtaatcccagcactttgggagaccgaggcgggtggatcacctgaggtcaggagtttgagaccagcctggccaagatggtgaaaccacatctctactaaaaatactaaaattggccaggcatggtggcgggtgcctgttatcccagttactcggggaggctaaggcagagagaatcacttgaacctgggaggtggaggttgtggtgagccgagatcgcacaactgcactccagcctgggcaacagagcgagactctgtctcaaaaaaaaaaaaaaaaaaaaagagacaaggtcttactatgatgcccaggctgctcgaactcctgggcttaagcgatcctccctcctcggtctcccaagatgctggggttacaggcgtgagctgccgtgcctggctgacagtcttagactgtaagaagacggtcctgtttttctccctgtgggtttctcatctttctccactgtgggtcaagcctaatagagctgtggacactgactggttctgttttaagggattctggcattggattttgagtttcttcacatctgggactactgagcaggtcatgtctttgatttaggtcttgccaagcccaggtaatttaggaaggtgctacctggtgcctggagttaatacaatgagtaaggtgaagatgcagatgggaatgcaaggggttgaaaattctgtcctgctttgaggaagtgggacctgggggaataggatatgtaaaaagtgaaaggtggcgaatcatggagggttctggaatcttctggaaccttctagaaactcccagagccttctagagttttctggaatgtaggcatggtgaggcattggatttagaatgcctacttagccaccatgtgactttctttctgtgtgaattttgaagaaaacatggaacctttctgtttccttgtgtgtcagacaggataggaatcactccctagggtcattgaaaagattgggatggactacgaggctgtgacctggatgggtggtggtcctggttatcactgttattgctggaatcactgctaatattattcaatatattatgtataaatattagtattggctgggtgtggtggctcacacctgtaattccagcactttgggaggcttaggtgggaggattgcttgagccctggagttcgagaccagcctgagcaacatagtgagactctatctctacaaaatttattaaaaattagccagatatggtggtgcacacctgtggtcccagctgcttgggaggctgaggcaggaggattgcttggaagcctaggaagttgaggctgcagtgagctatgattgcaccactgcattccagcctgggcaacagcaagatcccgtctcaaaaaattagcattgtactatatgttacttatgttgttatttttcctcacggacaccatgggcgtggaccaaattcagaaaacgatgaagtctgttcttggggagatgggataggagctgtagcttggctgggctggcttaagaatcaggcttgtctggaaatcggagggaccgtcatgagaagctgttggtttccgatcgtcgaaggctgcatgacggaggatgggttggctggtgcaaaggtcagggaagggattctgttggcatggggtgtagacctggcgttgaaggccactcctagctctgagagctgggaccccttgagagaagtagttaccaggctggggcttggcagaatcagggttggaggtgatgatcttggaggcgctgcctgctgcccaggaccctccgagactggacaccttatctgattcttctccctgtgttgtggatggggaaactgaaaccgtatgcatttattaccccatcccaggatttggttcctccacccataataggtgactgagttcaaagagccaagtgtgacctgtgtacagtgggtgtgacccacctgcccactgtgtggcaaccatgtcatccctggaagtttgcattccgtggcttttcctctgttacttttttgactccgtgcccaagcccagcagcttctgaatccaaagccttgctatgccacaatacctactatatttcagaaaattctggaagtttccagaagcttctggaagattccagaacattctacaagtcacctttcacttcttgtatatctcgctccccccaggttttacttcctcaatgtagcatgtgccctgagatggaagtgaccacagtcacacccactctcttgtttcttgctgtgacagtgttggcgtcggccaccgccacctcctcttccactcagggccacagtggaaggtctggatgcctggtgttctgttttcctaaggctgctgaaccctaactaacatccacacagaggccactggtggtcagcacaggtggcagggttagaaaggttgggactggctttgtcctttgagtcagagggacagtcacactcatgtttgtgtgaccatatgcatgtggctatggtcagtcctatagattatggcagcggttatcactctctgtcactgtggaccttggggccagatcgttctctgaggtggggccatcctgggcactgtagggtgctgagcagcgtccctggcctccacccactctatgccagggacaccccgagttgtgacaaccaaagatgtccccagacattgcccagtgccccatggggggcagaatcacccccaggtgagacccccgggggttaggggattccacagatccccaagaaactctgtgtctcatgatcctctgtcctcctgaggttccaggaggctgcacacattgtaatccacaccctgagtggggagggagagaggaggagaatcgcaggagctggggccccccttggtttctgccatccaccccatcgggaattttttctagtgtctggtgtcaacagggagcagatacaatatttttccaaataattaaggcagagtctctcccccttggcattcagggctgggtcgttctctggggtggggttgtcctggccactgcaaggttctgatcagcatccctggcctccacccactccacgccaggagcatccctgagtcataacagtcacaaatgcccccagacaccacctagcatcccctggggaccagaaggacccctggttgagaaccacggttgtatagaaaggaattgaagcaaaaaaaaaaaaatggaattctctgctcccctgtggcatcctgttgatggattagattcagcctccatgctccaacaccgagctcagcgtctcctggaaggccctgtctccagaggacgttcccagatcctgctccctggaagaattcttgcgagcatatatgcaagtgtaattaagcggccgtttttcctctgtggtgacacagatttgggtctgcagtaaagatatggagtccctttagagctgagagccggatcacggccaggagaatgccttgctttgagattctctgggaatcgggagtcctgcctgggtggaaatcagccctggacagggagggaatgtgcagatcggagcaagtggcttgtttcttcctggcaaccccagaagctgtctgaacagcttctctctgccacacatctctttgagtcttgcacccgcccggctgaaaattacacccaactcctccagccgggtctaggaagtggtgcaagctcctgaacctccatctgcagaataactaactagctgttcctgaaaaccaccaaagaggctgggcgcgatgcctcacacctgtaatcccaggactatgggaggccgaggcgggaggatcacttgaatctgggagtttgacaccagcttgggcaacatggtgaaaccccatctctacagaaagcgaaaacaaaaattaggcaagcatgatggtgcgcgcctgtggtcccagttccttgggaggctgaggtgggaggatcgcttgagccaggcggtggaggttgcagtgagctgagactgtgccactgcactctagcctgggcggcagagatatatcgctgagggtttgacggacacttctagatggaaatcaatgtctatctggtgccttgggggctgtgcatgttcacgaggagggtgtctgaacatgccaggatgtgggtgcctaggggagggtctctgtggggtgaagtttggatatttgagggcgcccatggaaaatgacttcaacctgcatggctcaaaaccacagaaatggattttctggcagttctagaagccagaagtctgagacgaaggtgtgggcagggccgttcccggcccagaagctcccggggaggatccttcctgcctcttccagcatctggcaagtggccggcggttcttggcgcccctgggctggtgacatcgctccagtctctgcctccatcctcacacggcccccttccctgtgtgggtctgtgtccaaatttccctcgtcttataaggacatcagttattggatttagggctcatcttaatccagcacaaccacatcttaataataagtccatctgcagaaaccctgtttccaaataaggtcccattctgaggcatctggctcaacaatattttcttccaaataattaactttgagtctcttccccctggtgctgtggacattggggctggatcattctctggggaggggccatcctgggcactgcagggtgctgagcagtgtccctggcctccacccactccataccaggagctccccccaatcgtgaaaaccacagatgtcctcagacctcccccgccccattgagacccccaagtgtcgggaatatcttttctgttttcatatgtttttctttgtatcttataggatcctggggaaatatttcccccagcagtccctcataggagccaatttaggtcatcgctgtccttcagaactgtcctctgcagaggggccgcgacatctgatattctctactctttaaccagcctggtttgctaaataacgctccctgcttctttaccgtcaagcgacctctcctgctcggcactgctggcatttcctggtcttcgtggttgcagatttttggtgggtcacaccgggcttggtcacgaagctgtcccttcctggtgtccccttgagcctggaggttccataaagccagattcccattcccgagcccgtgcacttgctgctgttcctggctggttccagggtttgaccagtcgtccaccgttgcagagagagacctgttagttcttcaggggcacgacaggaatttctggcgtgcatccgtctccgagaacgtgatctgtttgggttcatttatgaacacgtccaactgttaggagtgcttggcgccgttgcggatttgtttggagaagctaaagcagtctgtaaccctgtcgcgttttccatgtgttaaaacattaccagtcccgagtgtgtgaaaatctggatttttatctattctagtctcagccagagggggaggcgttatgacagttccgttttaggaaaagtagtacggtatacattacgaaagagcattgttttctaaccgagtccgtttctggtgacgtacaatggcacagttttcaaacttgactatgtagaaaagctgcccgatggagtcggcgctgtcgagggtggaaatgcgagttacgaccatcacataaggagatctctgttttcttcaacactccctgactttgcatctcagcaggtgtcctctgtgttttaaaacagtcaccttgcaggccagacgcagtagctcacgcctgtaatcccagcactgtgggaggccaaggcgggtggatcacctgaggtcaggagttcgagaccagcctggccaacatggtaaaaactcgtctctactaaaaatgcaaaaattagccgggcatggttgtgggcgcctgtaatcccagctacttgggaggttgaggcaggaggatcgcttgagcccaggaggtggaggttgcagcgagctgagattgcaccactgcactccagcctaggcaacggaacaagactctgtctcaaaaaaaaacaaaacaaaaacaaaaaacaaaaacaccagtcacctttggagaccttgcccttttcccagcagtgtgacgattctgattcccttcaagagtggattgtactgcttttgtatatttcaaacatacaattgtgtgtatttccattatatttcagattcttttttcttgtttgttttgtttttgagatggagtctcactctgttgctcaggctagagtgcagtggggtgatctcggctcaccgcaacctctggctcccaggttcaggcaattcttttgcctcagcctctggagtagctgggattataggcaaggtgccactacacctggctagtttttatatttttagtggagatggggtttcaccacgttggccaggctggtctcaaactcctgaccttgggtgatccgcccaccttggcctcccaaagtgctgggattacaggcgtgagccacggtccctggcctcagatttcttttagggtagttttgaattttggaaacagcctatattagttagctaattctgtgtaacaaattatcacaaatgtatcctaagaaaactctgaaatatattggaaatatacacaattgtatgtttaaaatatacaaaagcagtacaaggccctctctctaaaaaaagaaagaaagaaattttctaaaaagaccagtatccatacattatcacgaactcaactccacactttatttacattttatttttctttctttctttctttctttttttttttttttagatggagtctcgctctttcacccaggctggagtgccagtggtgtgatcttggctcactgcaacctccacctcctgggttcaaatgatcctcctgcctcagcctcccaagtagctgggatttcaggtgcctgccaccctgcacggctaatttttgtatttttaatagaggcaggggttcaccatgttggccaggctggtctcgaattcctgacctcaggtgagccgcccgcctcggcctcccaaagtgctgggattacaggcgtgagccacggcgcccggtctttatttccattttcttgttttttccaggaacccacatgccattgactcccgacatctccttacactctgctgggacacttctcagactcattggttttgatgacctgctgggtttttttttgttttgttttgttttgttttgttttttttttgagatggaatctcgctctgtcacccaggctggagtgcagtggtgctatctcagctcgctgcaagctccgcctcccgggttcacggccattctcctggctcaccctcctgagtagctgggactacaggcgcccgctgccacgcccagctaattttttgtattgtttagtagagacggggtttcaccgtgttagccaggatggtctcgatctcctgaccttgtgatctgcccgcctcggcctcccaaagtgctgggattacaggcatgaaccaccgcacccggccaacctagtggttttgaggaggactcgtcaggagttttgtaaaatgtcccccaacgtgagtttccatgatgtttgctcttgaatagtctggggttcagggctctggggagaacacatcaggggcacgtgacgtccacactggtggtgttgacattggtcacctggccaaggtagaacccagtggctttaaactttgaattattgccagcatttaaaaatcaggggtcacagaccaggcgcggtggctcacacctgtaatcccagcactttgggaggtcgaggcgggcaaatcacttgaggccaggagtttgagaccaagctggccaacatggtgaaaccctatctctactaaaaatacaaaaattagccggtgtggtgacacacacttgtaatcccagctactcaggaggctgaggcaggagaattgcttcaacatgggaggcagggtttgcagcgagctgagatcgcaccactgcactccagcctggatgacagagtgagactctgtctcaaaagaaaaaaaaaaaaatcgggcgtcacacctgtaattccaacactttgggaggctgaagcaggaggattgcttgaggctgggagttctagaccaccctgggcaacacagtgagaccccatctctacaaaatatttaaaaataggccaggtgcagtggctcacgcctgcaatcccagtgctttgggaggctgaggcaggaggatgacttgaggttagcctggcccacatggcaaaaccctgtctctactgaaaatacaattagctgggtatggtggcaggtgcctgtggtcccagctactcgggaggctgaggcaggagaattgcttgaacctggcaggcagcagttgcagtgagctgagactgcgccactgggtgagagagcgagactccatctttttttttttttttttttgagacggagtctcactctgtcacccaggctggagggcagtgacgcaatctcggctcactgcaagctccacctcccgggttcatgccattctcctgcctcagcctcccgagtagctgggactacaggtgcccactgccacgcccggctaattttttgtatttttagtagagacgaggtttcactgtgttagccaggatggtctcgatctgctgacctcgtgatccacccgcctcggcctcccagagactccatcttaaaaaaaaataaaataaaataaaatgaaactaaaaatcaggagattttacaatagaacatctcccagcttctcagagtagttggaggagctgatgacattgggcttcacacccactggggcaggagcggtgcctgatgccctttgaatgggccaggtgttgtctctctggggctccgcatgctacccgtcaccttcccgcctcagggctgacctcaaattcatgacccctggacatggcctcggagctcagccaggacgaacgttcccctgcctggctcctccccagctctcgggtctcggggaggcggctgaagctgggggaagcgtgtgaggcagaaggcaggccggacaacgtcaccttgagcctcattcacctcgttcgtcagcacttggagggttggtccttttggctggtgctggccaggtcgaggctcagagccaccggtgtccagggggatccggggtggtcctcggccttcctgcaactgccagggtggtcatcagaaaggctcctgagctgctgggagttggtggaaggtgggttgtctgagatcagctggagagttttaaacatagttgggtactgatttgtggtcgtcacagttaagagaggggcagctcctggcatggactgggtggaggccaaggatgctgctcagcaccctgccgtgcccagggtgaccacagagaacgatccatccttgaattccaagggggagagaccctgctttaattatttggaaaaatatcgagtctgctccctgctcacaccagacaccagaataaactcccaaaatcagggggacccccagctcctgggattcaccccctctctccctccccactcagggtggggatatcaatatgtgcagcctcctgggacctcagcagggcagaggatcatgggacgccgtctctttgtgggaggggtggtccttggaatctgtaacccagggggtgtcaatggtggatgattctgtcccccaggggacacctggtaaagtctgggacattgtggttgtcacaacttgtggggggcggggcgagggctcctggcatggagtgggtgcaggccagggatgctgctcagtaccctgcagtgcccagcacagccccgcccgagagaacactccagccccagtgcctcagcagtgcctaggggaggagaccctggaccaaagtgaccctcagagaatagggtgctctgtgaatctccacacccgtcacacagccatgcccgaggcagctcagggtctgggaaaacaagccacatgggacgcagtggccgtcctagctcagcaagtctgaccgtctggaggctgcagggctgactttgtggagtcagggtgacctgtgtgcctgcagacaccggcgctgggagcgcaggcctcagctctgtcccccgtgacagcggggtcgaggtgacagcacggctcccgcgggggcctcagaggcaggcctgctgccagtctctgctcccccgacagtggggtgggtctatccccactggtgctccttcctctggagccaggctgaggggagggtgggtctccgtggccagaaccaggctgcaccagacagagcttatttcaccccctgaggaggctgaccctgctgtttttgttcctccaacaaaatattaacggagcactcagagagagagagagacagagagtttcaaaagaaaacagtcagaggccttgaagtaatgatgtagggctctggggctctgtcttgtgaggtgtccacacaccttttctttttctttcttttttttttttttttgagacagagtctcgctctgtcacccagtctggagtgcattggcgcgatctcagctcactgcaacctctacctcccgagttcaagtgattctcatgcctcagcctcccgagtagctgggattataggtacccgccaccacgcctggctaatttttgtatttttagtagagacggggtttcaccgtgttggccaggctggtcttaaactcctggcctcaagtgatcctcccgcctcagcctcccaaagtgctgggataacaggcatgagccgctgcacccagccatcaacagacctcttctgtaaagagccagagagtaaatattttcgacgctctgagccaggcgctctccgttgcaggcactcaactctgctgttgatgttggaaagtgccctagatagtacataaacgggcatggctgtatttcaacaaaacttattgacgaaagcaagtggtgggctggatttgacccacagtggtagtttttttgtttgtttgtgtttgtttttgtttgtttgttttgagacagagtctcactctatcacctaggctggagtgcagtggcacgatcccggctcactgcaacctctgcctcctgggttcaagcgattctcttgcctcagtctcccaagtagctgggattacaggcatgcaccaccacgcccagctaatttttgtatttttagtagagatggggtttcaccatgttggtcaggctggtctcgaactcccgacctcgtgatctgcccgccttagcctcccaaagtgctgggatggcaggtgtgagccaccgcgcccaacccacagcggtagttttctgattcttgccatgttagaccagcattgcccagcataggggtctctgttactaaagtggcagtcaacacacacgaccacccccttctttgagacttactcctagggtggtgaccttgagctgactttacctcgtttcagtgtgtttccccatctgtggaaggaggattatatgtatcccttatggggttgtcaggtggattaagctggatattgtgggaccgtggtttctcagcaggaatgatcctacttcccaggggacatttggcaatgtctggggacatttgcggttgaggggtgttcccagcatagagaggatggaggccagggatgctcctcagcaccctgcggtactcagcacagccccctaccacagccattggccccaaatgtcagcaccaggtgtgggtgacaatatctaacccgctgtgcaaagatcaggatgtcacggcatattatcagttgtcttgcttcttccttcagaccacagcatcacccttattttctagaactttccatccataaaactgcagccctcctccagcccaggagcggctgcacccttagcaggcattcattgagcgctgcctggatgccgacagccttggtagggaatacaccatgctgccgaaattggcctcgggtgttccgggggctccctccagcagcccctccatctccctggggttggggtccttggtggccgtcaccgagccagggaaacaggagacaagaccaaccgcccagccactggttcccccacccctcccattcttttcataagcgcaaatttcccctgccaatttgcatatcccgtttttagcgtctttcttttctaggttttacataatcatctcattattagatgctggcacatgaacttaatgttccctcaatcacattttacagcattttctagcgtaagtagctaattgcctgtcgtccttctcttctctctgtctcttttttttttttgataaacttttcattttagaatagtttcagatttacagaaaaactgggaatgcagtgcagacagtttcatctcctcaccacccaattttccttagtattcacatccaatggcatggtgcgtttgtcacagcgaataaaccagtattgatacatcttcattaacccaagtctgcactctgttcagatttcctcagtttcctctaatgtcctctcctgccccagggccccatccaggatcccatctctggcctgtgacagtttttcagattttcttttttgttgttgttgtttgctttttctttttttgggagacagagttgctctgtctcccaggctggagtacagtggtgcaatctcggctcactgtaatctctgcctcctggattcatatcattctcttgcctcagcctccccagtagctgggactacaggcacccaccaccatgcccggcctatttttgtatttttagtagagacggggtttcaccatgttggccaggctggtcttgaactcctgacctcagctgatctgcctgcctccgcctcccaaagtgctgggattacaggcatgagccattgcgctcggcctacttttaaattatttttgtagagatggggtctcactgtgttgtccagctggtcttgaactcctggcctgaagtgatcctcctgcctcggcctcccaaagtgctgggatgacaggtgtcagtcactgcacctggccccaaatgagatattccgaatgccctttgcagccgaggttttctggcgagcacatagaggtgaggtattcacgcacagaagatagatggtaagaaaagaaacagccgttttctgcatttcaaagaaacaaaaccttggggctgtgaaaatttttgttgtttgtttgtttgttttttgagagggagtctcactctgtggcccaggctgggttgcagtggcgtgatctctgctcactgcaacctccgcctcccgggttcaagcgattctgccgcctcagcctcccaagtatccgggattacaggcgcagcaccttgcccggctgatttttgtatttttaatagagacgggttgggtttcaccatgttagccaggctggtctcgaactcctgacctcaagtgatccacccgcctcagcctcccaaagtgctgggattacaggcgtgagccaccgcgcccggatgagtgtgtgttttgtgtgaagggatgctctgtgctaactctgccgtgtgatgttgaggatcggaggtgaatcttttttgacaggaccctcatctaatttcaggatggaagactggaacactgcctagatgagagtatttagttgctgaaatggtgctattttgtcttagactgttttgcgagggtctcaaccaatggccttgggggcaaatccaggccacctgttactataaataaagttttattggcacacgatgggccatgcccatttatttatgcatagtctatggctgctttcaaaatacaacagcagaactgtgtagctgcaacagagaacatatgttccgtaaggctgaaaatttttacatcctgccctagacagaaacactttgctgtgctctggtctagtccagaaaggaggtaatctggccaggcaaggtggctcacacttgtaatcccagcacttggggaggctgagcagggaggatcgcttgagcccaggagttcaaggccagtctgggcaacatagcaagatcctatctctatgaaaagtaaaaactaaaaaagcaggcatggtggctcacacctatgtaatcccaggacgttgggaggctgaggtgggcagatcacctgaggtcaagagtttaagaccagcctggccgacatggcgaaaccccatctctactaaaaatacagaaattagccgggcatgttggcaggtgcctgtaatcccagctactcgggaggctgaggcaggagaatcccttgaacccgggaggctgagtttgcagtgagctgagatcgtgccactgcactccagcctgggcgacaagagcaagactctgtctcaaaataaaaatgaataaataaatacaataaaaattaaaacataagccgggcacggtggcactttgggaggctgaagcaggcagatcacctgaggtcaggagttcgagaccagcctgaccaacatggtgaaaccctgtctctactaaaaatacaaaaattagctgggcgtggtggcgggcgcctctaatactggctatatgggggactgaggcaggagaatcacttgaacccgggaggcagaggcagtgagccaagttcgcaccactgcactctagcctggatgacagagcaagactccatctcaaaaaataagtaaaataaattgaaaaagaataataaaaggaggtaatccaggttctaaataataaagccagtatgtgccatgacccatggctcagacaccactttaaacattttatagatactcatttatgtaatctccaaaaccagtctcacagggtggatgctgcttcgatgtgcattctacagagtgggaaactgaggcacagcgacagtggcaagggactgaaggtcacccagccagacagcgagtcgtgaagtcagaatggagtagctcttgtccagcactccaccttggccataccagagcgtacgtccccacccaatccttcctcgggactcagtggagctattttcacattgaggggaaatagaaatccgttcgttctcattttctttcttttttttgtcccgcatggccctcttcccaaatccttgttgcccgtctcaccagacattccagttccaagaggtggggtgtggcgaggactgtccagcacggcagggtgatcctgcccccccccccccaggggacactgggccatgtctggggacatttgtggctgtcaccattgagaagtgctccgggcatgcagtggctggaggtcacggatgccgctcagcgtgctgcagtgctcaggacggctccatcccagagaatggtacagccccagtgtccaccgtgcctgggaggagagactcagcattcattatttggagaagaaatggagtctgcttcctgctcaccaggacacactcctgatggggcagacggtgtaaaccaggggaccccagctcgtgggattcacctcctctctccctccccccaactaaaggtgtggatttcaatgtgtgcagcctcctgggacctcagcaggacagaagatcaggggacagagtatcttgggggtccgtggaatttcctaattcagggggtgtcaactgagggtgattctgccccaggggacactgggtgttgtctgaggacatttgtcgttgtcacaacttgaggatggtcgtggcgtggagtgggtggaggccagggacactgctcagcaccctgcagtgtccgggacagctgcaccctagagaatgacccagctctgaatgtccacggtttccaggggagagaccttgcattaactggcaaaaaaatgagtttgctccctgctcacagtagacaccagaatagattcccgatggggcagacggtgtcagccggggccatcctcccagagtgacctagaggactgggtgaggagggtctctagagcactgagggtgcaggacacagagccaaccgtctgattgttccttccccctccttgacctcggctcacagagaccttgaaccctcagggtcaagcaggcctgcccctttgttctgtgtgccccagggtgcagtggagcctgttccaggtcacgcccggcctggccgtcatcagtctcgtggctctgaagcagccacgtcactcccccagtcccggcacctcccctgcgcctgcacctgggtgagagcccgtccaggcctctctgcccccttcctttgcaatcagcactttgctggtgacatatttagatggttgctgtggtgatgagtgaaggctgaggttgacaacttcagcgatggcacaaaggacagggctgtgtttctatatccagcctccaacgagacaagacgcccctgccacgtgctggcagaatgtcagcgtgggaagggaagggggctctgacagcccgtcctgcccactcagttcccagaggaggaagtgcagccgggcctggggggcggtggaggataggcctgtcatcaaatgtcaggtccctggctgtcctgcccttgagggacatgccttagagcattgggtctcaactgggggcaagcctgccccctgggggacactggtaatgtctggggacatttgtgggtaccgtgacttgggggtgctcctggcctggagtaggtggagaccagggatgctactcagcactgtgcagtgcccagaacggccccaccccagagaataatcaagccccagtttaatagtgtcaagatcaagccacgttgctttagtaggaaatagataaaagccagtggatttgttcagttttaaaaactggtgctggcatgcatatcttgataatttgcaaaatgccaaaatgaatcattttcttggcctggtcattcttctgatttgccctcagtgaatgtaccttatccatctgggcttttgcatctctcccaattatcaggttgatagatattggaaaaacaagaaaatgaaaaatccaattgctggcttttaggaaaaggtaatgtttgactacacacctgtctttattttgtgctgctataatggaatgccatagactggataatttataaataatagagatttgtttcttaacggttctagggactgggaagtccaatgtcgaggtgctggcatctggtgagggccttcttgctgcgtcagaggtggaagggcaaaagagcacatatatgaaagattggggaactggggaagaaagaggaggggggggagagagagagaaagggtgagagggagagagaaagagagatggcattaatgagggtagggccttcataacctaatcacctcttaaagttctcacctctcaacatggtggcattgggaattaaagtttctacaatatgctttttgggagacacattcaaactatagcaacatctgcttggaggagtcatgtggatcagcccttccttccctttgcagatgtaccagttatctatcactgtgtaacaaattaccccaacacttagcttaaacagcaagcatttactatcctgcagtttctgtgggtcagtgggatattatattacttgcattatatttattatattatttggtctttgtcctgatttttttctggtgcagaactcctaaaatccttggaatctgcaaagtcatgtctttttgtatgatgataagtcgactgatggctgacagcttctagttattttcaggaatggtctggccaccagaaagatcaaggcaggatgagagggctggaacctttagctgtaccctccagcctctggggaggggagaagggctgaaggttgaggtgatgaccagtggccagtgacgcgatcagtcatgcctatgaagtaaagcctccataaaacttcaaaaggacggggtttggagaactttgagatagctgagcacatggaggttcctgaagggtagcatgccaaggaagctttgcccttcttccctatacctcatcctatgcatcttttcgtctgtattctttgtaatatgctttatattaaaccagtaaatgtgtttccctgaattccgagagctgctgtagtaaattaaacccaaccctaacttcaagctggtcagttggaagttctggaggcccaaacttgctactggtatctgaagaggttaggggcagtcttgtggggggatttagccctcaacctgtggggtccaaggctgtctccaggtagatagcacctgaattgaattgaactgaatcgaattaggggacagctagctggtgtgtggggaaactcctctcacatttggtcacagaaatatcttgggttgatttttttttttttttttttttgagatggagtctcgctctgtcgcccagactggagtgcaatggtgcaatctctgctcactgcagcctccgccccccaggttcaagtgattctcctgcctcagcctcctgagtagctgagattacaggtgcccacaaccacgcctggctaatttttgtatttttggtagagacagggtttcaccgtgttggtcacgctggtctcaaactcctgatcttaagtgatccacctgccttggcctctgaaagtgctgggattacaggcgtgagccactgcacctggccatgttgattgctgttgatgtgagagcaagaggaaaagcaatttgagtttgagttttttccaccctcactcaggagttaggaagcagctccactgggtgattctggcagtgaatgtgctggggctgtatcatctgaaggctcgattggagctggaggagctgctttcaagagggcgccctcatgtggctgttggtggaggcctcagcttccaactggccttgacaggagggcaaaatgcccaaatgagtcgttccttccttctttccttttttccttccttccttcctttttttttttttttttttttaatggagtctcactttgtcagccaggctagagtgcagtggcacaatcttggctcactgcaacctctgcctcttggattcatgcaattcttctgcctcagcctcccgagtagctgagattacaggcataattacagtaattagccaattactggctaatttttatatttttttttagtagagatagggtttcactgtgttggccaggctggtctcaaattcctgatctcaaatgacctgccccaaccttggcctcccagagtgctgggattataggcatgagccactgtgcccagcctggagggcccatttctttctttctttctttctttctttctttctttctttctttctttctttctttctttctctttctttctttctttctttctttctttcttttctttctttctttctttctttcttttctttctttctttccttttcttttttttttttttgagacagagttttgctcttgttgcccaggctggagtgcagtggcacgatcttggctcactgcaacctccgcctcccaggttcaagtaattctcctgtctcagcctctctagtagctgggattacaggcatgcaccaccacgcccggctaattttgtatttttagtagagacagggtttctccatgttggtcaggctgacctcgaactcccaacctcaggtgatctgcccgcctcggcctcccagagtactgggattacaggtgtgagccaacgtgcccggcctggagggcccatttctgcaacacatggatttcttcacagcactgcctgcatttccccacaacatggcagctggcttcccccagaacacatgacccaagaaagaacaagcaaaagtcactgtgtctttatttatttatttgagacagggtcttcctccattgcccaggctggagtgcagtggtatgagcatggctccccacagtcttgaactcctgggctccagtgatcctcctgcctcaggcttccaagtagctgtgattacaggggcacaccatcacgactggctaatttttgtattttttgtacagatggtggtggggtgttggtggtgggggtgtctcactatgttgcccaggctggtcttgaactcctaggcccccatcctcccatctcagcctcccaacgtgctgggatcacaggcgtgagccaccacacccagcctcgtctactttctagcttgtcttcttgtacctttgagggcaggaacatggtaaacagatgaaaaatatacgtccagtttctcccttccctgtggttttggagcaggaggatgaaaaggtcttacccacagcatcaacccttcaatggaaggaattgtgtttctcccacagggaatcaggattggaaagggatgaggctcagggagaattacacagagccttgtgggtgtaacggggatgaagatgtgttatctcccacttgatgccatcttgcagaaataagctaatcatctccagaatatgctttcgttcaccaaatgggatttacacatgcatcctaggctaatctgccttccacggatggcaggttctgtgagtaatccgacagaggctaattgggacggattccatgaggactgctgtgtgatccgctcgccgccatggcccctcggtgaggaggatggctctggtgtgggttaatccaggcttaagtggccaggagattttgatcctcatggtattacattgtgatgatactcacaggggctcgggggaaagcagaaaatccatttggccaagactgaccagtcttctctctggggcttattcaggaagcttgtggaaggggatccagtcataaatgtcagtgcttacggatcatgttgtctaaagtgggtgtctctcctttcctcttccttccctcatccctccctccctccctcccttccttccttcctccatccctccctcgctcacactcattccccttcccttcctctctccctccctctcactctgttttcctctctctcccaccctttctccctcttcctctcccttcctctttccttccctccctctttccctcccctcctctctttttttttttttttttttaagatggagtctcactcctctatttcccaggctggagtgtagtggcgtgatctcagctcactgcaacctccgcctcccaggtccaagcgattctcctgcctcagcttcccaagtagctgggattacaggcaagtgccaccatgcctggctaatttttgtatttttagtagagatggagttttgccatgttggccaggctggtctcaaactcctgtcaaactcctgacctcaggtgatccccccatctcagcctctcaaagtgctgggatgacagacgtgagccaccgcgcccggccctcctctcctttatttaaaaaaaatcaaggccaggcgcagtggctcacgtctgtcatcccaggactttgggaggccaaggtgggcggatcacgaggtcaggagattgagaccatcctggctaacccggtgaaacctcgtctctactaaaaatacaaaaaattagccaggtgtggtggcgggcgcctgtagtcccagctactcgggaggctgaggcaggagaatggcatgaacccgggaggtggagcttgcagtgagccgagattgtgccactgccctccagcctgggtgacagagcgagactccatttcaaaaaaaaaaaaaaatcagaacgcttggttcgtgatacaactctcacaatttgtctcttcaagtcccccttttaatagactatttttagagcagttttaggcctaaagaagaattgagcagaaggcagagttcccacctatctcctctccccgaaaaggtacgcatttcccccaatgttaccctctctcattaatgtgctacatttgttacaactaatgagccagtggatacatgattattgactaacagctacagtttacatttggtgtggctcactctctagggacctcctaagcgtggagttacacaggatttgtccttttgcatctggctcatttcactgggcgtgatgccctcaaagttcatccactctctagcccatgtcaaaatttccttcctttttcaggctgaatcatattccgtggcataatggatgacattgtgtttatccattcatctctcggtggtcacttgggtgtctctgcctttggggtgtggtgaatcgtgctgctgtgaacacgggggtacattttggtttcgggggatgtaccacgttttgtttatacttggcttatttttataaagctcggggctaaaaagccttttccattttaaaagtgttgtaaaaaaacaaataacaaagaggaatatgcaacagtgaccctttagctcacagagcataaaatacttactttttgtccctttgcagaaaaaatttgcagaccccagatgtaagatactaacatgaggggaaactgggtgaggggcgtttgagaactgtagggtccagccctatagggtctgtgggtttttctccccgtgtgtggagacgagagatcgtagaaataaagacacaagacaaagaggtaaaagaaaagacagctgggcccgggggaccactaccaccaagacatgaagaccggtagtggccccaaatgccaggctgcactgttatttattggatacaagacaagggggcagggtaaggagtatgagccatctccaatgataggtaaggtcatgtgtccactggacatggggcccttccctgtttggcagccgaggcaaagagagagagagagagaggagacagcttacgccattatttccgcatttcagagacttttagtactttcactaattctgttactgctatctcgaaggcagagccaggcagctcgtgccctcagtctcttgcctcggtacctaggttgcctgctgcccatagggaacgttggactagatttgcaacttttctgtaaatcgaaaatttttccaaaacagaaacaaaatttttttaaaagatggtgtcttgctatgttgcccaggctggtctccagctctcctggctccaaatgatcctcctgcctcagcctctccagtagctgggattacaggcacaagcccctgtgcctggctgaaacaaaagatttttgaaaaggatccttgggggcagaattcaaaaagtcctataaagcaggacatgaaacccaaaagtcaggagttagagactggcagacgactttgagtttcagctctgagtgcctttgtactgtttctctttttaggataaatgttattatgtgtatatatatatatatatatatatatatatatatatatatttttttttttttttttttttttttaattgagacggggtcttgctttgtcacccagggtgaagtgcagtggcaccatttcagctcactgcagcttcgaactcctaggctcaagacatcctcctgcttcagcctccccagtagctggaactacaggtgtgcaccaccagacccaactaatttttgtatttttagtagagaccgggtttcaccatgttgcccaggctggtctcgaactcttgggctcaagaaatctgtcctcctagacctcccaaagggctgggattacaggcatgagccaccgcgcctgtaatgagccagttttaattttgaagacaatcattgaaaattgatctgacgctgtttcatgttttaaggcctctccgctgccccacccccagaggattccagcacatgaaatctgtaaacatttggttttacagtgttactctttgctaaaaatcattaggacttactcgtttctggcattcaaggtcctctgagatctaactctagtacacggattatatcaacccttcctaaagggccggaggtaaattcttggcgttgcaggccatgtgctctctgtcgaggcctcccagctgtgctgtaggagcccagaagcagccatggatgatatgtaagtgaacacgcacggctgtgtgccaataaaactttatgtacaaaagcaagcagtgggctgcatttgacccatgggccagagtttaccaacctctggtctagttcatctttctttctctttttttgatggagcctcactctgtcactcaggctggagtgcagtggcgtgatcttggcgcactgcaacccccgcctcctgggttcaagcttctcctgcctcagcctcctgagtagctgggactacaggcgtgcaccaccatgcccggctaatttttgtatttttagtagagacagggtttcgccatgttggccaggctggtcttgaactcctaaccttgtgatccgcctgccttggcctcccaaagtgctgggatgacaggcgtgagccaccgcacccggcctcacattttctgtatccattcatccaacgatggacatgtaggttggtttcctatctcggctattgtgaatgaggctgacagattctgatttcatttcctttggatgtatacccagaagtgggattactggatcatatggtggttctatctttaattttttgaggaacttccattccgttctccagaatggctgtgctcatttacattcccaccaacagcacacagggttcccttttctccacatccttaccaatgtttcttttttttttctttctttcttttttttttttttgttttgaatcggagtctcactctgtcacccgggctggagtgcagtggcacgatcctggctcactgcaacctctgcctcccaggttcaagtgattctcctgcctcagtctccaagcagctgagattacaggtgcccaccaccacgcctggctaatttatatatatatgtattttttttttttttttttttttcagacggagcctctctccgtcacccaggctggagtgcagtggcgcgatctcgactcactgcaagctccacctcccgggttcacgccattctcttgcctcaggctcccgagtagctgggactacaggcgcccgccaccacgcccggctaatttttttgtatttttagtagagacaaagtttcactgtgttagccaggatggtctccatctcctgaccttgtgagccgcccacctcagcctcccaaagtgctaagattacaggcatgagccaccgcacccggcctaatttttatatttttagtagagacagagtttcaccatgttggccaggctggtctcgaactcgtgatctgcctgcctcatcctcccaaagtgctgggatgacagatatgagccaccgcacccggccatctttactaatgttttttatcttttatcttttggatcatagccattctaacaggtatctcattttggttttaatttgcatttcctggctgattaatgatcttcagcgttttttcataatcctgttggctgcctgcgtgtctttatttgagaggtatctagtcagattatttaaccccctcttttttttgagatagggtctctttttgtttttgtgtgtgtgtggtttttttttttttttttgagacagagtcttgctctgtcacccagcctggagtgcagtggtgtgatctcagctcactgtagcctcgacctcccagactcagcaatcctcccatctcagcctcctgagtaactgggatcacaggtgcagaccaccacacctggctatgttttaaaattttttttgtagagatggggtcttgctatgtggtccaggctggtcttgaactcttgagctcaatcagtcctcctgcctctgcctcccaggggacactggacaatgtctggggacatctgtggttgtcacaactcgggggtgcccctggcatggagtgggtggaggccagggatgctgcttagcaccctgcagtgcccaggatggccccagcccagagaatggtccagccccaatgtccacagtgcagaggggggagaccctgcattcattatttcgaaaaaaataattgaattgcgtctctgctcacaacagacaccagaataagctcccaatggggcagacaacataaactaggggactccagttcccgggattctcctcctctctccctccccccactcagggtgtggatttcaatgtgtgcagcctcctgggacctcagcaagggggaggatcatgggacacagtctcttggggatctgtggaaccccctaactgaggaggtctttctggggatgattctgttccccaggggacatcaggcaatgtctggggacatctgtgactgtcgtgactgggggtgctcctggcatagagtgggtggaggccagggatgctgttcagctccctgcagtgcccaggatggccccaccccagagagtgacccagctctaatgtccatagtgcctgggggttgggagggggacccgtgctgtttcggatcgtgtctaggaggctgctctgggaacccggggaaggtgggaacagagcttgtcatgaagcgggaggggagggtatgcgtcagaaaagaaatgacaggtttgaaatctgcagaagctcgtctttcctctccgcctctcctccccagccggccccgcccccacctggcttcctaaataaagaccttcctctgcatggagaccgcctcactcaaactcaccccctcgtgcatatgcagagtctcaaaagacacggccccgcccccgccacagcgagggtctgaatgggaggtttggaggagagcatctgtgtcccagacccggcggtggggggcccagggtgctgggcacatcttctggaacccgggctcgccgaggcaggcgagagctgtcccctcgcctctgttggggatgcctgccaaggttagccatgggcgaggccagggacagcgcctgggtggtgccaaggggactgtgagtcacctgtggataggagggctgagtgaggaggggacacgggccctgggcctcaagggcaccatctgaagatcccataaggatgaggacaggggaggccagagggcagaaattcaaggcaacggaacagctctagatgggggatgcccctggcatggggtgggtggaggccagggacgctgctcagctccccgcagtgcccaggacagccccaccccagagaatgatccggccccaatgcccacagtgccgagggggagaccctacattcatctggaaaaaaatagacttcgatcccttctcactccagacaccaggataaactcctgatggggaagacggtataaaccaggggggccccccagctcctgggattctcctcctccctccgccccactcaggatgtggatttcaatgtgtgcagcctcctgggacctcagcagggccgaggatcatgggactcagatcgatccctcatctgccctgctgcggaatttcccagctctgtgtttgtctgttgcaaatccccaggtttgggagctgagggtctggctgtttgtgtccttgggcgctgcttggagatactgggctataaaatctatcagccttttcagaattacaagcaaaaataacaaccagcaccttaataaccctagaagatgcatgccttcgacactgtgggtgaggcctggtttttgttttcagtttctattatttattttattttattttgatttatttatttgagtcagagtcttgctctgttgcccgggctggagtgcagtggtgtgatctcggttcactgcagcctctgccttctgggctcacgtgatccctggagccaccatgcccagcaaatttttaaattttttgtagagatagggtcttgctatgttgcccaggctggttgcaaacttctggcctagggtcttgctatgttgcccaggctggttgcaaacttctggccttcagcaatcctcccacctcaacctcccaaagcactaggattacaggcatgagcccttgtgcccagcccatagtacaatatctttagctggttcacaggctacagtgacatctctcagtgtttccaacacagctgaaactatgtatcctctgacccccatctcccccttcctttccctcctctaccactaaccgctcttctgctttctgtttctatgtatttgggaggttttgattgtgtgtttgttttgagatggagtctcgctctgttccccaggctggagtgcaggtggcacgatcccagctcactgcaacctctgcctctcgggttcaagcgattctcctgcctcagcctcctgagtagctgggattacaggcatgcaccaccacgcccggctaattttatatttttagtagagacgggctttcaccatgttagccaggctggtcttgaactcccaacctcaggtgatttacccgcctcggcctcccaaagcgctgggattacaggcatgagccaccgtgcctggctgtatttggggttctttgcttgttttgtttttggactccacaatacgtgggattacgcagtgtttttctctctcagcgtctggcctatttcacttggcatcgtattctccaggttctacaagggggaattttatggcatgcgaatattttaattttttttttttgagacggagtctcgcttagccgtccaggctagagtgcagtagtgcgatcttggctcactgcaaccactgtctcccgggttcaagcgattctcccatctcagcctcccgagtagctggcattacaggcgcctgccaccagacctggctaatttttgtatttttagtacagacggggtttcactgtgttgcccaggctggtcttgaactcctgacctcaggtgatctgcctgccttggcctcccaaagtgctgggataacaggcatgagccactgcacccggcctattttaattttttaaagaaagaaattggtcaggcacggtggctcatgcgtgtcatcccagcactttgggaggccgaagcaggtggattgcctgagcccaggaattcaagaccagcctggccaatatggcataacaccatctctacaaaaactacaaaaattagctgggcgtggtgatgggcacctgtaatcccagctacttgggaggttgaggcaggagaatctcttaaacctgagaggtggaggttgcaatgagctgagatggcaccactgcactccagcctgggtgacagagtgagactgtcttaaaaaaaaaagagagagagagagagagagaaagggagagagaaaagaaagagaaagaagaaagaaggaaagagagagacaaaggaagacagaaagagagtaagagagagaaagaaaaagagaaagagagggaggaaaggaaggcaggagggagggaggaagaaaggaaggagggaaggagggagggagggatggagggaagggagggagggagggatggagggaagggagggagggagggatggagggaaggtagggagggagggagggagggatggagggaaggtagggagggagggatggagggagggagggaaggaaggaaggaaggaaggaaggaaaggaaggaaggaaggaaggaagtcggacagagatctggagaagtgcctccaggacacagtggggagggccgggaggcggtggcagcccttcgtacacgaggtcccctgaccaccaccactgtccatggcctctgtgtcccaagggggactgatctctccctgctgacattcggcacctgctacctggagtgtttcttgcctgtgtctgagacttgcctgcctgctgggtggaagggccagctgcccataggtgcccagggccctgagctgggtttaaagccgggctattggcgccttgaaatccatactaatttatgaacaggaggtcccagcggttcgtgttgccccagctcggcagtttctgaggggacctaacccccgcggagaggtctctcctccttgtctccactgctggccgcccgggtcgattgtgatttgtccacacagggaacatgaaaacacagcgtttctgtcaggctgagtgagccgctgaaggtcgctgggggacagcctggcgccagctggtgcggctcaaggcccgaggacagagcggctgggatgcggcttcacccacgctgtgctcgcctctgacccaagctgctctgaggccgagtgcagaccaaggggcatccgcagggatcgcctcactgccaagtccaaggtcttgaggacagccaggggctggggttaaagggctggggacagggaggtttgcagtgaaggcagagagtgagaactcatcttaaaaatgattcctagggctgggaatcattgttgcctgtaatcccaacaacttcgggaggccaaggctggcggatcacctgaggtcaggagttcaagaccagcctggccaacatgaggaaaccccgtctctactaaaaatacaaaaaaagctagccaggcatggtggtgggtacctgaaatcccagttactctggaggctgaggcaggagaatcgcttgaactcgggaggtggaggttgccgtgagccgagatcgtgccccactgcactccagcctgggggatagaacgagactctgtctcaaaaaaaaaaaaaaaaaagattcctatgacacgaatattcacagcagcagattcacaattgccaacaagaaggaacgagccgattgtccatccgccggtgaatggatttaaaaaacacgtccttccatactcaggaggagtaagactcagccatggaaaggagcgagtctttgacacaggtcacagcatggatgcaccttgaggacgtcacactcagtgagagacaccagacacaaaaggccacacagtgtgtgaccccatttctatgaaatgtccaggacagacccatccgcagagtcagggagggtgtgcgtgggggccggggctggggatcgggggctgatggcgagggggcttctttgtagggtgatgagaatgttctggaactacataaaggtgatggttggccagttttgcaaatatactgaaaacaatgaattatacacttcaagtgggcgagttgtatggtacaggcgttagttcacaataaggctgtttaaaaataatgattcctggctgggcgcggtggctcacgcctgtaatcccagcactttgggaggctgaggcgggtggatcatgaggtcaggggctcaagaccagcctgaccaacatggtgaaaccccgtctctactaaaaatacaaaaattagccgggggtggtggtaggtgcctgtaatcccagctactcaggaggctgaggcaggagaattgcttgaacctgggaggtggagcttgcagtgagctgagatcgcactccagcctgggtgacagagcaagactccgtctcaaaaagtaataataataataataattcctaggggtgagcgtctacactgaatgtatccgcctctctcagtttgctggttttgataagatgtgccctagttgtgtacggtgtcgctggcagggtagtgagttgaagggcgcaccagaccacttcaaattcattcagtaatttaaggttgtccaggtgaaatggctacacctgtaatcccagccctttcagaggacaaggtggtgagaggatcacttgagcccaggagttcaagaccaggctggataacatagcaaagaccctgtctctatttttaaaaaattaaaaattagcccacaaattaagcacattccttcccccttcccagaacataaaaactacaacagtgatgcccacctgtaggcccagctcctcaggaggctgaggaaggaggatcgcttgagcccaggaggtggaggctgcagtgagctgtgattacaccattgcactccagcctgggcaatagagtgaggccctgtctcaaaaaaaacaaaaaacaaaaaacaaaaaaaaaaacacatgattcagagttgaaggattatgttcatagctgccctgcaaggtggagggcaggagtctgggcctcctgcagccccgtgggcatgccgctccagccctttcatcactcatccctgctgccctgagctgctgctgtcctgagtggcaggccctggtgtagcagatcctgcaagattccagctgctgccagagcccaagggtgccagggcattcctgtggcaagggcaccacctgcaggtgacagtgaggatttcagctccctatccctaccttttattgatggtaaattaccctgagctcgtagaacggaaactagcattttaaaaagtctgcattttttttaaatgaacttttaattttagattttcagaagagttgcaaagaaatccagagatttcctgtctacctctcaccagttttcccttatgttagcatcttatgaagtcaccatgcatttggggttggtctgtttttgagacagtgccgtgctctgttgcccaggctggagtgcagtggcacaatcgcagatcactgcagcctcgacctcctgggctcaagtgatcctcctgcctcggcctcccaagtagctgggactacaggtttgcaccaccatgcccagctaatttttacattgtttttatagagatggcagatggggtcttgctatgttgcccaggctggaccatatacttgtgaccaccaagaagcccatgtgggtacatttctataagctaaatttcactctttatcccagtttcacggtttttttcttctaatgtcctttttctgttttaggatcctatcctggatcccaagtggcttttttttttttttttttttttgagacagggtctcgttctgtcacccaggctagagtgcagtggcatgatctcagctcactgcaacctccgcctcccgggttcaaacgattctcctgcctcagcctcccaagtagctgggattacgggcgcccaccaccacacctggctaatttttgtatttttagtagagacaggatttcaacatgttgacccggctggtctcgaactcgtgacctcaggtgatcctcccacctcggccccccaaagtgatgggattacaggtgtgagccaccgtgcctggccccatgtggcatttatttttattttttctcagacaggattgcactctgttgcctaggctggagtgcagtggtgcaatcctagctcacagcaaccttgatctcccaggatcaagcgatcctcccatctcagcctctcgagtagctggggtcacaggcgggcaccactacaccctcctaatttttaaattttttttgtcaagatggggtcattttgtagagatggggcgactcgctgggaggaccctggactccgcatgaggcctccttgtgactgtggtttgtcccagcaagaggacatggagcacagagcagagtttgggaagggaaaggctcgtggggtgggtcggggaggccaggcccggcttctaggcccagcttccaggccctctccccatgtgtcacgcgggacacgccacatccccagcagcgagctgggacaacagcccaaagcactgtcaccagcgaggctcccagagacccagcacccacgttcctatgggggctggttctgctgcccctgctgcctgacccatgccaggattccaggctccagagggaggcaaggatttcatataaaccacggtgtttgcaggaacagctttggccctggagcttgtcctgtcagtgatggtggcagggtccccccgagtcccccgaggtggggagttcctggtcgcagcctcaggcatgtggtgccagcctggttctgctcagagactgcccgtaccagctgagctggggctgagggacttcccaggatgcaggactttcaggctaactctggaaaagtcctgggcagacctggatacgttgggtgccttctgggcaccgtgggactaactcagccccttcttcttcctcccagggagatcgtgaggctccaaagatgtacagagatgtttttgataaactgtgaagagccgtagaaacatcaatccttgcactcagttcagttttcaaacacgtggaaaatgtattaggaataacgtcataaatctctaataataaatattttcagtgaattgtcttctgcttttttccttttctattatttttttttttgaagcagagtcttgccctgttgcccaggctggaggacagtggctcgatctcagctcactgcaccctctgcctcccgggttcaagggattctcctgcctcagcctcctaagtagctgggactacaggcacccaccaccacgttggctaatttttatatttttagtagagacgggattttgccatgttggccaggctggtctcgaacttctgacctcatgatccacctgccttggcctcccaaagtgctgggattacaggcctaagccaccgcgcctggttgccaaaatgatttctgtccttgtccaatcacaagcgcgaggccgttctccaatgctgaccccatcaacacatgcatggtgcctccagccaagccacgccaaactaactctatgtgttttttccagggagtggagcttggtttcgggatctcggtgctgcagacggcgagacctcctgcacaggtcggtgctgtaatgcatttctttgttatgatttgaggttcagttggctgttttgcaccctggatgtaagacgtggggttgccgtcaaggcgggcgtcttggccttgacctgggtctgtcggctgtttgtatccaccaagtatgggtaatggggagcaggtgtgggtaacagctgctagctcctggcagagtttcccgcccacgaggcagggaacgtggcactcactggtcctgctggtgccggagcccctggatggggtcagggtgggaagcccacagcggtgctgcatgcctttccggtgtcttcgtgccatggtagggagttttaaggagccttcacccgtatctcctgtgcacctggagagtgacccgtcgctggccctttagctctcctctgttgatttactcctcgtttttctccctagagaatcatgagtggcttttaaaatgtaggaagaggaaaccatttaaaaataagtagaaaggaaggcagaaatgtccagaaaaggcaaagccatagggacagaaagggactcgtggtgattggaggctggggacatgaatgtgcaccagagacttgccagggacgtggaaatggacccgatggtcgggtcggggtgaccgcaacctggtgaacttacttaaaaatcttaaaacaaaatttttttttaagagttagggttttggccaggcatggtggctcatgcctgtaatcccagcactttgggaggccgagatgggtggatcacctgaggtcaggagttccagaccagcctgaccaacatggtgaaaccccatctctactaaaaataggaaaatcagccaggcgtggtggcaggtgcctagagtccaagctactcgggaggctgaggtgcgagaatcacttgagcctgggagatggtggttgcagtgagccaagatcatgccactgcgctccagcctgggtgacagagcgaaactccttctaaaaaaaaaaaaaagagagagagagagagaaaagaaagaaagaaagaaaaacagaaaagagttagggtttgctttgttgcccaggctggtcttgaactccgtggctcaagtgatcttcctgctttgacttcccaaagtgccaggattacaggtgcgtaccattgcacccggccctgaagtatctttgagcagtacacttcacttgaattttatggcatgtaatgtgtaccttaaaaatgcatattttagctaagcccagtataaatcattttggtctcatccttagtagtcaatggtcatgagaggtaattcagaaacagatgtactcaaaagtcaagaatatgttcaaatttagcaataaggcaaagactccaaatgtccatcaatgggtgaatggatcagcagaacatcctccatccacaccatggagtgttactcagccatgaaaaggaatgaagctttgacacaggccacagtgtggatgtaccttgaggacgtcacgctcagtaagagatgccagacacaaaaggccacacagcatgtgatcccctttctacaaaaggttcaggacgggccgatccacagaggcagggaggggatgcgtgggtgccgagactgggaggggcatgggaagtgatggttgatgggtttcttcttcttggcataattagaatgttctggaattagtggtgatggttgcaggactctgaatgtactaaatgccattgaattgtgcgttttctttttattttatgatttttttcttctttttggtgccgcagataatactcagaaagaattatgcattttaaatgggtgcactgtatgtcatatgaattacatctcaataacatgatgcatgtatagatagagcattatatatatatatatatatatatatatatatatatatatatatatatatatataaagtgtaggccgggtgcagtggctcacacctgtaatcccagcactttgggaggccaaggcaggtggatcacctgaggtcaggagtttgagactagcctggccaacatggcgaaaccccgtttctactaaaaatacaaaaattagccaggtgtggtgttaggcacctgtaatcccagctacttggggggctgaggtgggaggattgcttgaacgcgggagacggaggttgcagtgagctgagattgcgccactgcactccagcctgggcgacagagcgagactccatctcagaaataataaaataaaataaagtgtagatgcaaaaagtgtagatataaaatatatgtataatatttatttatgaagccaaacataaaaatgtaaaggacttcatattgtacaattccacttacaggaaaattctagaaaaggtgacagatcagaggtcgcctggaggctggggggttgggatcggggcagctctgggagtcgatgacagcgtcccattgagattatgctgatggttgcatagctgtagaaatgaatggcaacccttagaaccatgtgcgcttgaagattagcgtgcccagtgtgcatcgcagggtgtgtaactgcaccccagtgaagctgtgacaccaacagaaaagctcagcccgaaaaaggaggcgcagggctggaaggtgtgcagagcccggagaggtctcggactttgcatttccggtgccgacggagccgggccggaaggtgtgcagagtccggagaggtctcggactttgcatttccagtggacatggtgcagggccggaaggtgtgcagagcccggagaggctcagactttgcatttccggtgccgacggagccgggccggaaggtgtgcagagtccggagaggtctcggactttgcatttccagtggacatggtgcagggccggaaggtgtgcagagcccggagaggctcagactttgcatttccggtgccgacggagccgggccggaaggtgtgcagagtccggggaggtctcggactttgcatttccggtgcacatggtgcagggcgggaaggtgtgcagagcccggagaggctcagactttgcatttccagtgcggacagtgcaaggccggaaggtgtgcagagcccggagaggtctccgactttgcatttctggtgcacatggtgcagggtgggaaggtgtgcagagcccggagagggctcagacttagcatttccggtgccaatggcgcaaggcggaaaggtgtgcagagcccggagagggctcagactttgcatttctggtgcacatggtgcagggcgggaaggtgtgtagagcccggagagggcgcagactttgcatttcgggtgccgacggcagggccagaaggtgtgcagagcccggagaggtctcctgcatttccggtgcacatggtgcagggcgggaaggtgtgcagagcccggagagggctcagactatgcattcccggtgcttcctggggctgccacaggtttggtgttgggcttcttcaaacattcagttctggccgggcgccatggctcacgcctgtaatcccagcactttgagaggccaaggcaggaggatggcttgagcccaggagtttgagatcagcctggtcaacagagcgatatcctaaactctacagaaaattagacaggtatggtggcacgcacctgtagtccctgctagtggggggctgaagtggggaggatcgtttgagcctgagagtttgagaccagcccaggcaacatggtgaaaccccatctctacaaaaaatacagaaattagccaggcgtggtggtgcacacctgaaatcccagctactgaagaggctgaggtgggaggatcgcttgagccccggaggtcgaggctgcagtgggctatgattgcaccactgcactccaacctgggcaacagagccagaccctgtctaaaaaacagaaacaaataaccccattcatttcgacagggaaacgctagcagctgcggagctaatagtgtttgcaagctaggatacggcaattctcagcaagaaacattgcgatttctgatctcccgtgggcccttttggaaagactgcccgtgatggggtcatcgttctccatgacctgtcccagaaacacgtgtcccatggtgggggtctgtgagaacagctccctggcaggcaggctgtgggctggtggggctgcccactaagccccgagggcctggatcggagctgctagatcctctttgggcactggtggatgtaggcacctcctgccccagacgtaacaagtgactactgatgtagaacggcttctcccacacagttattatctgacagcgctgaagctcagaagtctaacgtagggccaggcgcggtggctcactcctgtaatcccagcactttgggaggtcgaggtgggcggatcacctgaggtcaggagtttgagaccatcctggctaacatggtgaaaccccatctctactaaaaatacaaaaaaaaccagccaggtgtggtggtgtgcatctgtagtcccagccactcaggaggctgaggcaggaaaatcgcttgagcccgggaggcggaggttgcagagccaagatcacgccactgcactccagcctgggcgacagagtgagactccatctcaaaaaaagaaaaaataaaaaaaaaagaagtctaacataggcctcactgggctaaaatcatggaaaatcaaggtgtgggcaggccagtccctccttggggctccaggggaaaatctggttcccgcatttcccagcgtctagaggcacccacatcccttggctcggggccccctcctcccccttcacagccacagtgaagcctcttccagtctctgtttgactctcaccctcctgcctcttctcctgaggacgctatgaggacattggggcccccagatcaccccggatgctatcctatctcacgatccttaacttcatcccatctgcggtcccttttgacatggagctgacctgtccacggcttctggggttaggatggggctgtcgctgggagcctgctgttccttctgctgacatggggaatgggctggaggggtgagcagagccgacttcctcccttgcctggtcactcacctgcctgtgacctcaaggagagaggaagaggctccccgtggggatctgccgggcgcaactctggccatcgcagggctgagttctcgaggctaagagccactgagggtcagctgcgggacccgagtcccttcttcttgtaccacctctggggaccatctgccagtttctggagtgcctccccttcatttcatagacttaagtttctcaagcaggtcattttagggatggcagtttggcctgaagccctttgatccctgattgacgtcagaacttggtgagagcctgggtgtggtggctcacgcctgtcatcgcagcactttgggaggccaaggcgggaggatggcttgagcccaggagtgtgagactagcctgggcaacatagcaagaccccatctctacaaaaaaattaaacaattagctgggtgttacagtgtgtacctgtggtcccagctacactggaggctgaggcaggaggatcacttgagcctaggagatcgagtggtgcagtgagccgagatcacaccactgcactccagcctgggcaacagggcaagaccctgtctccaaaaaaagcaacagctaaaaaggtaaaatgaagaaaagtacaaagaaggccaagcccctaagttccccagcccagcaccgatgggcctcagcatcttgccaagcctgtgctgggattttcgtgaattacattcacctgtagatttcacacaaggagggttctattctctcattcctcattcccatcactgggcatctttccttgtcgagaaacctcgacatccaccctcattcttgacgctcgttaaggcactctgtgtgatagggggtggtgacttatcactttaaaaatgattttataatgtgtttaactggtccccctagctgggcttttggaatgtctctctttttcttgatgtctttctttctctcttcctctctctctccttccttcctctctctttctttccttctccctctctctttctctcgccttcctccctctcccccttctctctccttccttcctatctctatctccctccctctgccgcttccttccctccctcctccctccctcctcccctccctccctccttccctccctccttccttcctccctccctccttccctctctccctccctccttccttcctttcttccttccctcccttcctccctccccctccctccttccctccctctcttctttcttccttccctccctcccccctccttccttccctccttcctctctccctccttcctttcttccttcactccctccttcctttctccctccctccttccctctctccctccctccttccttcctttctccctccccttccttccttccctccctccttccctccctccctcccttaccctctccttccctcccttaccctctccttccctcccttcttcccccttcccccctccttcctccccctccctccctccttctctcccttccctcccttccccccctcctcccccactccctgcctccctccctctctccttccttcctgaatccctccccttggatggttgaggtttaagttaaattcctgcgagtggatgtgctgctgagctctgtgcctgccatctacatttgacatccagccacaaaaacctccagaaacaccccattccttcctggagcgctcgttccccaccctcccagccgcagctgtgaaatctttgccaagctggcaagtaggggcgctcatctttgttttgtttgggtgtccttggtggccggtgaatccgaccgttctctgggcatccttctgtgggctgccaggctggggtctttgctgacctttctgttccggcgtctcaggcgcattgatttgtttgaacagtttataaacgtttgtttgaactctgcaaatattttcctgagcgtgtcttttgactttgcttacggtgggttttgccaaagaggaattttttttttttttgacagagtctcactctgttgtccaggctggagtgcagtggcgcgatcttggttcactgccacctcctccttccgggttcaagcgattctcccgcctcagcctcccaagctgggattgcaggtgttcgccaccatgcccagctaatttttgtatttttagtagagatggggtttcaccatgttggccaggctggtgtcgaacccctgacctcaagtgatccttctgcctcagcctcccaaaatgctgggatacaggtgtgagccaccgcacctggccaggattttaaatgtttgttatacatgagcatctcctttgttttttttatggatctcttccaaattttaagattataaaaaaatcacctgtattttgttccgattgcatgttttacacttaaattctgaactacttgaaatttaactatgctagtggggctcacggaggaagcaggggtgattctgacccaaccctcccctcccctcccctccccaggggatgctgggagatgtctagggatgtctctggttgtcacgactggggggtgctcctggcatgagtggttggaggtcagggacactgctcaacatggccccatccaagagaatcatccagccccaatgtctacagtgcccaggagggagagactctttctttctcccttcccttcccctcccctcccccttcccttctcctcccctccctcttcccttcccctcccctccccttccattcccctcccctccccttcccctccccttcccctcccctttccctccccctcccctccccctccccttcccctccttccccttcccctccccctttcccttcccatccccttctcttccccttttcttttcttttctctttctgacagagtctcgctctgtcacccaggctggagtgcagtggcatgatctcagctcactgcaacctctgcctcccaggctcaagtaattctctgcctcggcctcccgagtagctgggattacaggtgcatgccaccacgcccggctaacttttgtatatttagtagagacagggtttcaccatgttagccaggctggtcttgaactcctgacctcgtgatccacctgcctcggcctcccaaagtgctggggtgacaggcgtgagccaccgcacccggcccattcattatttcaaaactgacttcagtccctgctcacactggacaccagaataaactcccgatggggcagatggtgtaaatcagggggacccccagctcctgggattcatctcctctctccctcccaactcagggtgtggatttcaatgtgtgcagcctcctgggacctcagcatggcagaggatcatgggacgcggagtctcttgggggtccgtggaatcccctaacccggggggtctcaaccaggggtgattctgcctccaggggacatctgtaattgtcatgatggagggatgctcctggcatggagtggatggaggccagggacgctgctcagcaccctatggtgcccaggacggccccaccccagagaatcatcaggctctgatgtccacacacgcaaggggaggccccagtagaggggacggaattagtggtgagcaggtgtggtgccggctgaccttgaaggggttctctgttacaaagggtggcgtgggatgcgggcttttcctgatcttttaataatgttgctagtcattcattgagcacctcctgtttgctgggcgctgggctgggcgagtgcggctttggctcctgcgggcacagggtgggaagcttggaaactcacctccctacaaggacggacggggaggagagcgaggctgtgaggggtgcaggcgcctgcgggggtctctgacctctgggtggcagcctctccaggagagcaggtgcgccgccaagtgagggccgtggctgcctgtcctgatgacaaaaccagcaccgtgatcccctgctcctatccttctgcaggccccagggcaaaacaacaacgacaacagcaaagacgggccgggctcgggggcggggggagcctgttcctggggcctctgaagctcgatttgcagagggctgctgttaccgctggcggccacgagggggcagaggaggcccacggagtttcctggccccgggcctggagccggcagggggctggagatgcggggggtgcaggtagggacgggggtgcagtgggtgtgcaggtgggtgcaggtgaggacaagtggagttggaggtgcaggtggggacagaggtgcaggtggggacggaagtgcaggtgggcgcaggtgggcacaagtggggacggaggtgcagatgggcgcaggtgtgcgtagttgggttcaggtgggtgcaggtggggatggaggtgcaggcagtgcatactgactgtatcccagatgtcttcagtcacccccgagcccctctttaagctctgtcactacccccactgcagtttgcttgataccttcctggttcaacactgacagccctaagtcccaggcaaacccagatggttggcccctgccctaggggcccctgtgggcacactcagagcctctctgcccaaaaccagaggcggtccctgggtgttgtgcgtggcaggaggcgggaggcactggctctgctccccaggagtggccttaaggcagtcagggaatgcacctcacactcgggcacagaggtgtctccagagcagagctcggaccagagaatggaaggcataaagcatccctggagggctgggtggccctgggagagtgcaggtcatcctgccatgggaatcagaccctggcttgtccccaccatcaggccctggggtgcctgtcatcccccctcccagatgtcatgctcctcagggtgagaactggctgtggacctggggctgccactccccagctcagagaggggtcattgtcctggcgggcagagggcctggatcctcgcctgtgagttagagactcgtgcgcccctgagtgaaggcagtagagagctggttcagtttggccagaggagaattccatccaccccctgagtgggagggagagaggaggtgaatcccaggagctggagttaccctgatttatgctgtctgcccctttgggagtttattctggtgtccggtgtgagcagagagcagactctgtttttttccaaataacacagggtctctctccccctggctcctgtagacattggggccacatttttctctggggtggggctgtcctgggcactgcaggctgctgagcagcgtcccgggcctccacccactccatgccaggtgcacccgccagttgtgacaaccacaaatgtccccaaatatcactcagtgtcccttaggggacagaatcaccccaagttggccaggcacggtggctcacacctgtaatcccagcactttgggaggctgaggtgggcggatcacttgaggtcaggagttcgagaccatcctggccaacatggtgaaaactcctctgtactaaaaatacaaaaattagctgggtgtggtggcgggcgcctgcaatcccagctactccgtaggctgaggcaggagaatcaattgaacctgggaggcagaggttgcagtgagccgagattgcaccattgcactacagcctgggcaatacagcgagactccgtctcaaaaaaaaaaaaaatcaccccaagttgagacctcctgggtctcaggtgtgtcccatgatcatatggacctctgaggttccaggaggctgcacacactgaaatccacactccgagtgaggagggagagaagaggcaaatcccaggagctggggtccccctgtcttacaccgtctgctccattgggagtttgtcgtggtgtctgatgtgagcaggggacagacttgattacttttttttccctcaaattaaggcagggtctctcacattcagcactgaagactttctaccccttaggagacactggggctgggggtggggttggagatgcagagggtgcagatggagatgggttcacggggcacctgcacccacctgtgcccacctgcacccacctgcacctctgtcctcactcatctggggcaatgtctggggatatttgtggttacacgactggggggtgcccctggcatggagtgggtggaggcccgggacgctgctcagcagcctgcagtgcccaggacgaccccaccccagagaacaatccggctccgatgtccacagaacccgggtgagaacccctcttccaggataagcatttcttcagcctttttgcttcttgcctcactgagtgcggaagaactttgcgacctccagatcaccgagtgtgtttttctggtagctccttgttctcccggcgagggttttttttttttggtaacatttctgctgagagctttactggagcctcttatcctgagaagggctcttgtgtggtaagcaaactccagtccccgcggccagtcagagcgggtttatttccccctggtcggtcaccagatttcagcatgtcctggtcgtgttgaaattcacgttattatcagttcttttcgcggacaagttgttcccctgaaagaattgccaagatatacagccagagcctgaaaacgctctgctcccggaaggtcacagctcattgctaccaccctccccgagagaaaacgtgtgtgcagcccgcaagtaattacggggcgctgtgccgaaatcaggggctctgccacagtctccaggactcagaaacctctccctgtacccagcagcctccacatctgtagcccaggacaaggcagtgcttcccggcggtaggagagcttggacatgaccttgaccctctatagcaggggtcatctgggtgatgccgccccccacccccaaccccggggacactgagcaatttctgggacatctgtggttttcgcgacttgggggagctcctggcatggagtgggtggaggccagggatactgctcagcaccccgcagtgcccaggacggccccaccccagagaacaatcgggcctcaaatgtccacagtgctgagggggagaaactctgggttcattattttggggaaaaaaattcgagttattttcctgctcatgataggcaccataaacgcccagtggggcagacggtgtaaaccaggaggacccccagctcctgggactcacctcctctctccctcctcactcagggtgtggatttcaatgtgtgcagcctccggggacctcagcagggcagaggatcatgggacgcggagtctcttgggggtccgtggaatcccctatcccagggggtctcaactcggggcaattttgcacccaggagacatttgtggctgcctcgattggtggatgccatggggtggaggtcaggggtgccactcagcaccctgcagtgcccggggcagccccacaaccaagaatgattcagccccaaatgcccacagtgccggggggagaaggcccggtgcagaagaacctgcctcccgggtgagttgagagcaggcttctgtcctcttctggacagaattactacagctcccactcaagccccggtaaacagacacccgttttcaagcccaccgatgtcctctcaatgaatccccgtttcagagctgttattgcgaccacctgactctactgattgaggctccatacccagagaggctcacatccacgaccaccgagcccggggatctgagtaccccagcccagtgtgcagaccacagccacctctcgtgtgtgtgtgtgtgtgtgtgtgtgtgtgtgtgtgtgcgcgcgcgcgcgcgcgcctgttgctaagcaaccgcttgaacagtcagcctcccacagaacgagggatgaggcaccaacttggtcatcggcagattcatcgagccttggccgcctttgactcaaaatacacacggcggtgacagtcgcatatgatgagatgctgggggcaggggacatgggggagccgagtggaggccagagaggatggctctgccaatctgtggcttgaccttgaccctctctgaccctctacagcaggggtcagagtccattgcccaggacagcaatgatgaggcccgttggatgctaattttcctcccatccgcttcatcgttttagtgaaccagcacccacctgcagggcccctgccaggctaacaccctcggatctctgcgcagacactcccggtgccgcctggggatgcgtgtcatagatggttaaggtgcagcctggggaggcccaaggtggggtctgttgagaagttaggggcctggtagaggggccccctgtcccaccagcagggttcaaggggctgagggctcctgagcagacatgggccaggcagaggcccaggcgggtgccccagtgcagagcccactgtggctggatgagcctcgtaatgacttcatgttagagcctcagctttacttatttattatttttatcggacatggatctgaattattattcttatattcttgttattattattattttagagtcagagtctcactctgttgcccaggtgcgagtgcagtggtgcgatcatagctcagtgtaactaaggggtgctcctggcagggagtgggtggaggccagggactctgctcagcaccctgcagtgccagggcagcctcaccccagagatggatccagtcccgatgtccacagtgctgacggtgagagacttccctgtagagtagaaagtctctgttcgtcagctgtttttacaattcccagtctgttttctgtgtgcgtgtgtgtgtgtgtgtgtgtgtgtgtgtgtgtgtgtgagttttgtttatagcaggttgggtttttttgttttttttttttttgagatggagtttcactcttgtctcccaggctagaatgcaatagcataatctcggctcactgcaacctccacctcccgggttcaagcaattctcctgcctcagcctcccaagtagctgggattacaggtgcctgacaccacgcctggctaatttttgtatttttagtagagacgggtttcaccatgttggtcaggctggtctcgaactcctgacctcaagtgatccacctgcctctgcctcccaaagtgctgggattacaggcatgatcccacacagcgccaggccaggagtcttacctttctaggaggcagagtttatctgttcttttggggctcctttctctagagaatgggggagagggcagcaccagggtgatgatgtccccgcagaacaggccgtcacgggattagcctagtcgatgctagttgtccttattggagatcttggggagacgccctgaaaatgctgtagtctgccttggctggttcaacgtcctttcaccccttttctctcttcctctttcagaaatggcacttctagggtcagtcggcttcattttagaagttagcaaaagaaggaaaaaactgctaaagccggggtcgaaaactgtggcccccaggccaagtcccccatctagttcctgtttttataaataaagttttattggcatacagccacagacatgctgtgcccccaccccaggcccagtctggccctccacttcctgtttttataaatgaagttttattggcacacagccacagacaaactgcagctccctgggccaagttcccccctccactccctgtttgtataaataaagttttattggcacacagccacagacatactgcaggtccctgggccaagttctctgttccacttcctgtttttatgaataaagttttattggcacacggccacagacattcatttacctgtcatcagtgactgctttcatactacaaggacagagctcagtggccttttgcagaaaaggtttgctgaccctcagcctagaggccttgagttatctgatttcatctcataaccactcgtgaggaaagaatgatcgtcactggacagataaggatgctgagacctagcgaggttaagtggcttcatgaggtgacataaccagcagtttagggcttgggctcccaactctgccacctactggctctgtgaccctgggccatctctgtgcttttctgaacctcaatgccctcgtctgtgaaaggggggagaataggcagtgcctgcctctcaaggggttaatgcatgtcaagctgtctaatactaaatgcaccattcttcctctggtcttcatgcctgctatgcctcctcagccccacacagtgctgttgagacaatcagataatgtcatagtcattagacctttttgatgatatactcagacatactcaggaggaaactgctgagttgcttggctgattgtggagggacatgatgtccaaacccttgtgtatgaataagtttgaaagctgaccataaaatcccagaatgctctagtctgcagcacataaagagtgtattagctagctatggctgcgtaacaactaccatgaatgcagtagcttagagtgacacccatttattatctcatggttccataggtcagaagtttggatgtagtgtggctgggtaagaccctgcacagaggacccagccacactatgtccaaacttctgacctcggagatgtgagccagggctgcattctcatccgaaggtttgtgtggtgacggatccccttccaagctcattccaggctcattcagaattcagttctttgtggttgatagactgtttctgttgcgttgttagctgtcaggagggggcaactctcagctctttgaggccactctcaggccacttggccttctccataggcccctcatgcttccaggctctcatttcaggaaaggcccaatcccttttaaagggtcacctgattagaccaggcccacctaggataatcgccctttcagtgaactcaaggtcaactgatttaggaccttatttacctcttcaaaatcccttctttcctgaaaagcaacctaatcaggggagtgatatctcatcatgtccacgggccctgcccacactcaaggggagggggttctacaagatatgttctccagggagatcttagactcctcttggtggcaaagggaagggggggcctgcgttcggcctcagccaggaccgaatcagcaggaccttcactccctttttctggcgtccatcccttcctcttgcaggagtactgccaggtctttggggagagggtgggggttattgggagaaaggaggcatttggaaagtaggtggcaggctgtgtcccagttacacctaaatgtgtctccacttattaaaaaaaaaaaacaacctttattttgaaatcattacagattcagaggaagttgcaaaaatcacacagagcaaaaaacatcacatgtatcttcacagtttcccccagtggtgacatcttacgtaaccatagtacaaaaccaggaaatggaccctggcaccatgtatgtgcaaagctctgtgccctttcgcacacatgcagactcggcttcaccttatttatgggtgtgcaggaacattaagtgtccataaatgtggacggagctcctcttactcgtgggcatggggtcagagggaggcgggagtacaaccaaacaaaaccatctagactttgaccgttgatgtgggtgccaggttccaatcaccgtgtgcccccacactgcgttcagggctacgctcttctgtcttctcccactagtctgtgagtctgtgaggtcttgtccactacctctttaggcagccagcccttctggtgggctttgtcgtggggagggggtggcactaggtgtgttctggggctcctagcactagaagacttgtttcaaatccagaagcacctcctattcgtgtgggcgcccaggcaacttacctgacccgtctgtgactctgtgtccttggggacctcctattctaaacacaagagcgtggcctgctgtcaccgtcaccatcctggcatctgcagaagagccaccaagcgctgcctcctgagaatttctggaaggaggagatgactggtagagtggaaagttattgaaagggacatttggagttctttccaagggacataacccatctcccaatatcccctatccatttgctcaaccttcagagagacctactaagatatccagttgttcacctcaagtcttcaactttccccaaagttctttgctgttttctctgtgccttgcacagagcctgatgcatagtacgtgctccttgggggccactttgtgtgtgtttcctactaatggcacctacagcagcaatggccaccatgtcttttacagctacagtcctaggcagaattccaagatggcgcccaagacccccaccgcctggtgcccacatcttatctaatcccctgcacttgaggatgggctggacctgcgaatacgatggggtgtcactccagtggttaggttaatgcagttaggtcgtgtgttcggtaaagggattttgcagatgcgacgaagattcctagtcagttgacctgagctcatcaaaaaggagacatcctgggtgggcctgacctcatcaggtgagcccataaaagagaccagaagcacatcccgaggtgtcaaattcagagagacagaagggagaatggtgggtgctaggggctgggggagggaagaggggagctgttgttcagtggatacagtgtctcagttttacaagatggaaggttctggagagccattgcacagcagtgtgagtatacttaacatcactgaaccgtacacataaacgtggttaagatgatccgtcttatgttatatatatatatacacacacacacacacaccacagttgaaagaaagagagaaagggaaggggtttcttgccttaaagaaagcaaacagctatgtcgtgagctgcctgtggagggtccatgtggcagacacctgagagtagcctctaggggctcagagcactcacatccaacagccagtaggtaaacagggacctcattcctagagctgcaaggaaatgaattctgccgataaccaaactagctcagaagaggaccccaaattccagatgacaactcggcccagcccataccttgattttaggcttataagactctgagcgggggacccagttaagccagactcttgacacacagaagttgtgagatggcaaatggtgtctttgttgccgctgttgttactcagcagtagctgactcatacacttgccgtgttgtttgccatgttgagattgagataatgatctccacttcacataggagaaaacagtagctgagaggggctgacgtgcccagggtcacatggcaactgtgttgtgatcatcacattaactgtgcctgtcacctgggccggaccgtcacctccttcattaagatcagggatctggtccaagtcttcaccagatgtttactgagtgagtgaaagaaacaaagaatgaaggtgctgggaccgatcctcacctgacctcctgcacacaggtgagtctgtgtctgcgaccaggaccagtgacaccataggacactgagtgaaatctcgagaacataactgtgaggctcagaaggagtagtcagcacatgcaactccccgggctgagtcagctgccggtgttgaggtcggagctgatcagcctcctggaatgtgacatgctgtaccctgactaatattccggctgaatcagagctttgctcgtaatgagaggcaagtctcgagccagtcaccctctggcccatgtgagactgggaattcagaatcagccgggagtgacagaaagccaggtctggctggcacgcctgggtgggtgtttacagcacgcgggctgccagctgtgaccagctctgaagggagccagggccagaggatgcaggtgcagaggacaggcgcccggaggaagtgggaggagaggcggccacagggctggggccccactctgggtgcccctggagccatgcagggggtgggttcacccccttaccgccatttaacatgtgaggtggatcgttctctggggtgggtcatcctgggcactgcagggtgctgacagtgtccctggcctccaccaactccatgccaggagcacccccagtcatgacaaccacaaatatccccagacatcacccagcgtcccctgggacagaaacaccttggttgagaccctctgggatagaagattccacagaccccaagagattctgcatcccatgatcctctgccctgcggaggtcccaggaggctgcacacattgaaatccacacctgagtgggaagagagagaggagatgagtcccaggagctggggctcccgggtttatgccgtctgctccatctggagtttattccagtgtctggtgtgagtagggaggacactcagtttattcccaaataattaaagcaggtctctccccctgggcactgtggacactgacactggactgttctctggggtgaggccgtcctgggcactgcagggtgctgagcagcatccctggcctccacccactccatgccaggagcatggaccgatgtgagggaatattagtcagggaaggtcccacttccctccgtcatgacaattacagatgtcccccgacaccgcccagtgtcccctgaggggacagaattaccccagttgagaccctgattgagtgaaccgatgaagacaacaccgcccaagagtgaaagcaggtgcccacaccaggagctttgttcgggaattcagggagggcttcctggaggaagtgacatgagttgagtgttgctagtgccctgaaggtgacaggtggggtgggggatacaggtgcagagatggttccaggaccttgaaaaggtgagagggagggagtgaggaggccgcacggcagaggctgcattttatcccgagggcaggagggagccatagcgggttccggctccacccatgacaacaatcaattggtttgggtccagcctccctgtgtgacagattaggaaactgaggcacagagggggtgagagatgccccagcctcctgtgggtggcagagatcccggtgggtttccacggtgccgctggtcaggctggtttggggcagggggccggcttcaggcctggggcgggagcagcatcagcttcacgttcccgctggagacacggggtcaggtgggcacccgcggtcactctctgcttctgtttggtaaaatggggggtgatcaccacccctgcagtccagggttgctgcagggagtaaatgaaataatcaggccgggcgccatggctcacgcctgtcatcccagcactttgggaggccgaggcgggtggatcacctgaggtcaggagttcgagaccagcctggccaacatagtgaaaccccatctctactaaaaatacaaaaattagccaggcgtggtggtgggcgcctgtaatcctagctacttgggaggctgaggcaggagaatcgcttgaacccgggaggcggagttgcggtgagcatcagtgagcagtccagcctgggcgacagagtgagactccgcctcaaaaacaaaacaaaaacaaaaacaaacaaaaaaccccaaaaccaaaataatcagctctgaagtccttgtcttgtgcccagcacggtgagggcgctacctgctcaccctctcacaccctcatctcctctctgacccagcttcctcctccccaaagactctgcccttcactggcttccctggcaaccatggaaacactgggaggggcatgggtgacccatggcccttctacaagttggtggcagaaccttggttctctgcttcctgatccccgtgaccgaggagaagagagaagtctggctaatctgggagcagtggctcacgcctgtaatcccagcactttcagaggccgacatgggaagatcgcttgaggccgggagtttgagaccagcctgggcaacagagacccccctctatttctgcaaaaaataaaaataaaaaccctggctgggcacagtggctcacacctataatcccagtgctttggggtgctgaagtgagagaattgcttgaggccaggattcaggaccaggctcagtaaaagagtgagacccccttgtctacaaaaaaatttttaaaaattagccgggtgcagtggtgtgcacctgtattcccagctattcgggaggctgaggcaggaggattgcttgaacccgggaggcggaggttgcagtgagctgagatcgcaccactgcactccagcctggcgacagagcaagatcttgtctcaaaagaaaggaagaggtctagaggccccaggggacaacacatgcaccctcggcacagggcccgagcccccagggaggtaaaccacaggcgtccacccctgcctggggtccggctctgcacccacaaggaaaggtgacagccaggagatggcttctgtgccctgagctgaccttgtcttcctgtctcagggcaggagtggcccagcccacagcgtggaattctgcaagctcagtaaacaccctggagcctgtgggatgggctggaggggctcgggcccctgtgcccgcctgccctctgcctgggggtaattaccagaaagcctccctccttccctccttcccagaaggcactgctgggctcagcctcctgcaggtcaggagctgctaggaatagccgccagggctggcaacaggtcacagtcactgctccggagacgagaggcctgctgtgctgtggcaccaccggcaaccagacagaggtggagctctgcctgagagccactggagcacctttctttctttcttttctttttttctttttcttttttttttttttttttgagacggagtctcgctgtctcccaggctggagttaagtggcacaatctcggctcactgcaagctccgcctcccgggttctcgccattctcctgcctcagcctccggagtagctgggactacaggcgcccaccaccacgcccggctaattttttttgtatttttattggagacggggtttcaccatgttagccaggatggtctcgatctcctgacctcgtgatccttccacctcggcctcccaaagtgctgggattacaggcgtgagccaccgcgcccggccctttctttctttttttaattgtggtaaaatatatgaaacatagtatttaccatcttagccatttctaagggctcagttcagtggcattaagcacatttgcatggtgctgcacccatcaccaccgtcatctccagaactttccatcttcccagactgaatctctgtccccgtgaaacacttgctccccgtccccttcccagcccttggcaccccccatcctgcttcccttgtactgttcgctcatgttcacagcagccaaaaggtggaagcaactcaagcgtccatcaacagatggactgtctctgtgaatctgacggctctagggacctcctaggcgtgcagtcacacaagatttgtccttttcttttagatgcagtctcgctctgtggcccaggctggagtgcagcggtgcgacctcggctcactgcaacctccgcctcccagattcaagcaattctcctgcttcagcctcctgagtagctggaattacaggcacctgccactatgcccggctaatttttgtatttttagtagagatggggtttcaccacattgcccaggctggtctccaactcctgacctcaagtgatccacctgccttggcctcccaaagtgctgggattaaaggcgtgagccaccacacctggccaatttggttttttgtgtctgggttctctcactgagcgtgacgtcctcaaggtgcatccgtgttgcagcctgtgttgggattcccttccttttcatggctgagtaatattccatcatacagatgcaccatgctgtttatctgtccatctgttgatggacgcttggattgattgcttccaccttttgggtgctgtgaacatgagtgaacagtacaagtatctgtccgagcccctccttgcaattcctttgggtaaggaacaccttgtttatttgttttcttgagacctggtcttgctctgttgcccaggctggagtgcagtggcacgatcacagctcactgcagcctcaaatgcccatgctcaagcgatcctcccatctcagcctccaaagtagctgggactacaggtgcaccaccacgcctggctaattatttttttgtagagatggggtctggctatgttgcccaggcttggaacaccccgtttgttctgggtttgatactacagcccaacctgtggtcacctttttgcctcctgggacacagaagagctcagactgagcctgggtgttgaggaccttagccggaaagtggcttctccctcacccaccctcacttggccacacacccccaggaagaaggaccaatgttttctatcagtggccgtgcccggggtgtcagagctctagtggtataaatgatacacggtgaaagtgaaaacaaagccctcctctctgccacgttgctctcgcattgagctccctttcccggaagccccctctctgccgcgttgctcgcattgggttccccatcccggaagcctccctctctgccgcgttgctcgcattgggttccccatcccggaagcctccctctctgccgcgttgctcgcattgggttccccttcccggaagccccctatctgccgcgttgctcgcgttgggttccccttcccggaagcccccctctctgccgcgttgctcgcgttgggttccccttcccggaagcccccctctctgccgcgttgctcgcgttgggttccccttcccggaagccccctctctgccgcgttgctcgcattgggttccccttcccggaagcagctggtgttgccagtttcgggggctttccctggagatgggctgaatccccagccctcattactgaccattgacttctgcagggcttatcccgcaccctttgcaagcttaaaaaccaccaggagccgggcgcggtggctcatgcctgtaatcccagcactttgggaggccgacacaggcggatcacaaggtcaggagatcgagaccatcctggctaacatggtgaaaccccgtctctactgaaaatacaaaaaattagccgggtgtggtggcgggcgcctgtagtcccagctactcaggaggctgaggcaggagaatggcgtgaacccgggaggcagagcttgcagtgagccgagatctcgccactgcactccagcctgggtgacagagcaagactccgtctcaaaagagagagaaaaaaaaaaaaagttgatgagggttttgggcaggcagagggaatcgaactcactcctccgtggtgatcagcatgaaggaaggggagagaaaaggggcagacgagcctcttgtggctgccataacaggtgaccacagacccggaagtatcaatccgcagacgtgtgtcctctcacggttctggagggcagaagtactaaaccaagctgtctgcagagctgtgctcccctgggcgctacaggagaggatccttccgcgtcctctggcttctgggggctctggcaaacctggcttgtgcttaccgtcgaattgctccagtctctgcttctgttttctgctgtctctctgtgtctccttctttgtttttgtttgtttgtttgtttgtttgttttagatgaggtcttgctctgtcacccaggctggagtgcagtggtgccatcttggctcactgcaacctctgcctcccaggttcaagcaattctcctgcctcagcctcccgagtagctgggattacaggcgcgcaccaacacgcccggctaactttgtgtttttagtagagatgaggtttgtccatgttggtcaggctggtctcgaactccttatctcaggtgatctgcccacctcggcctcccaaagtgctgggattacaggagtgagccactgtgcccagccatttttctttaattaattttttgtgtctggagtcttgctgctgtgttgcacaggctggagtgcagtggcagcatcatagctcactgcagccctgaaatcctagggctcaagcaatcctcccgcctcagcttcccgagtagctgggaccacaggtgtggaccaccacatccagcttcaacataagttttaagcaaatgcaattagtccgtaacagtcattttccgaggttccccgtggacaagaattttgaagggacgtcactaaaccccttgcaagggaagtgagctttactcaggtctcaggaagctcctggggtgtgcaggaaggggcgaggtcaccccaggaggaaggcgctgtgctaaggaaaggtgactgttgatggggcccccgtttgcagaaacctgtatgagtcgtaccacctctgtgtaatctgccaccttcagagcgcctgcaggaaggcggccacgtcaccccttttataaatgaaactggaagctcaggctgggaaacccaaggtcacagaacccagcctcaaaggcagccagcatttccaccgcaggagtctgttctctgcacagagctgtcttgctctgttgcccggagccagagtgcaatggcacgatttcggctcactgcaacctccacttcccgggttcaagcaattctcctgcctcaacctcccaagtagctgggattacaggcgcacaacaccacgcccagctaactggccgacccacgttggctgggggtgctgacggcataagctcacccctaggtccctctagggtggccgatgacaggaccctaagaagctcacccccagctgggatgtttcgttgaaaatcttctcttttgcctttagttgcttgaaaacattggactcatacccaagagctttctaattggtttcgataggaaacggttctgaggtttcgccttttttaatatcctgttggtctgagactggagtggcccctggggtggcaggtttcccggtgcatgggcccagctctggtgtgtgggttgggggatcaggacagaggtttgtgaggggggcagtgacctgcctgcagagagaggggtcgggacgacggcctgtagccagggtgcagggggatctgcctttctttcattctacagggtcctctcctctcccctcccctcccctcccctcccctcccctcccctctcctcttttcttttctgtttttgagacagagttttgctcttgttgcccaggctggagtgctatggcgcgatctcggctcactgcaacctgcaacctctacctcccgggttcaagcaattctcctgcctcagcctcccaagtagctgcgaatacaggcgcgcaccaccatgcctggctaattttgtatttttagtagagacggggtttctttatgttggtcaggctggtcttgaactcccgacctcaggtgatccgcgcccccccctcgtcctcccaaaatgctaggattagctttattgagatataactgacacagcgtaaaactcaccctttaaaaatgtgcagctcagcggtttttacattcacagagttgtgcaaccatctcctttatctaattccggaacatcctatcacccccaaaagaagccctgtcccccatgagcagtcactccccatctccccccggcagccctgccacacacgcatcccctccctgtccccatggatgggcctgtcctggacatttcgtagaaatgggatcacacactgcgtggccctctgtctctggctcctttcatagagtgtgatgtcctcaaggtccatccacactgtggccggcatcagagccttgttccttttcatggctgagtcctgctccatggtggcgtttgctgtaccaggtgggacagaatggacatttcagtggtcctccgatgtctgaccttgcccttcaccctgattagggctcagccttactataaacaaatacttgctatgaacttactatgtgcgaggcctggggtagcaaacttttctgcagagatccagatggcaaatgttttagcctttgcaggctggacagtctctgcctgccattgtagcgggaaagccaccacaagcaatatgtcaacaagtgggtgtggccgtgtgccaataaaactttatttacaaaaacacacagtcagctagatgtggtccaggggccgtagttagctaacccctggcttaggacaaaggttctcaaactctctggtcctgacgattattccaaggagcttttgtttatatgccttctacttacggatatttgttgaatttgaaatcaaaactgagaaaatgtcaatcaaataggtattcattcattttaaaatagcaattataagctctcagggtagccagaatgacattttttgtttgtttgtttttcatggatagtaaccgttttcttaaagagacaaacaaaaaagttcatggaaataccaaagaaagaccaagaaactgagagcccagaggaacccacggagatgggacggtcagatgccacatgggctcctggatggggtcacaatggggcaggaaaggtcgtgaggggaaaactgagggaagctgaatcgctgtggcatttggttactaggaaggtgccagcgttccccagctgtgagcaatgccctgtggttacacagggtggcccctgaagaggaagctggtgaggcgtgggcggggactctctctttgcaactttcctgtaaatctaaaattactccaaataaaattgtttattaaaaaaaaaatagaacaggctgggcacggtggctcacgtctgtaatcccagcactttgggaggccgaggcgggtggatcatttgaggtcaggagttcgagaccagcctggacaacatggcgaaaccccgtctccactgaaaatacaaaaattaggtgggtgtggtggcacgtgcctgtaatcccagctacttgggaggctgaggcaggagaatcgcttgaacaggggaggtgcaggttgcagtgagctgaggttgcaccactgcactccagcctgggcaacagagtgagatacacacacacacacacacacacacacacacaccacacacatacaggtagaaaagagaaaaatgtggctgagagctttgcaaggggcatgggtgaggagtaatctgtgtcctcagtgccctggggttggcagggatttgggcaagatggagaagctggtgagtggaagagtagatggaaggccaacccgtcggtcagtcgcaaatattgacccgacactcactgtgtgccagggacagcctaggtgctgggggcccagcctgatacaggtggaatcaagtcctgttctcagggagcatgtgtcacacagagacagcacatgcccagacacactggcaaaccaaacagagggtcttagaagataaggaaatagtcacgcctgtaatctcagcgctttgggaggccgaggtgggaggatcacttgaggccaggagtttgagaccagcctgggcaacatagcaggaccgtatctctacaaaacatttaaaaaattagccgggcatggtggtgcacacctgtagttccagctgctctggaggctgaggtaggaggatcacttgagcccaggaggctgaggttgcggtgagctgtgactgcaccactgcactccagcctgggcaacagagcaagaccctatctcaaaaaaaaaaaaaataaaaaggaaaagacaaaataggatgaggtggcaccaagaggagagagtctgtgccacgtggtgtccaggaaggtctctaaggaggggacatccttgccaacccctgcaggatggggaggagcattgaaggcaggaggaaggacattccggagggctccctggaagcggaggtctgggagccacgggaggggacccaggccaggtctttgagggctggaggtggagaggaggatggggagaagaacagtctgaagcatcatggcagaatgtccttggtctgaggtgacctagtgtggcttcttgatcagattgatggggtcctcagagctcacagcccaaggcagggtcagagctgcagggctgggccgggctcagtgcctggatggctggtgagctctgcctccctgaaagatccagtttctggtccaggccagcggttcttaagtgggacaggtttgcctccaggggactctgggtgatatctggggacatctgtggttgtcacgactggagatgctcctggcatggagtgggtgggggtcagggacgccactcagcaccctgcagtgcaccaggatggccccatcccagagaatgatccagccctgaacgtcagagactttgggttaacggaatgtaattaggctgaaataagctaaagtttttccgatagtcacgtgctgggcagcacactggtggaaggctggtgcaaagctttcatgccagaaccttctgattccaagacactttcattcacagtcacctgcatgaccagggaggcggagctgcacttatcccgtgaccccagatgaggaaacagtcagaggaagaggcgggcagaacccgggccccactgctcttggcagctcttggaaacatcctcccctagggccctggtcaccagccttgcccaagaacccaccagctatatttgtctggtttttttttttgagatggggttttgctcaggctggagtgcgatggcgtgatctcggctcactgcaacctgcaacctctgcctcccgggttcaagcaattctgcctcagcctcctgagtagctgggattacaggcacccgccaccatgcccggctaattttgtatttttaggagagacggggtttctccctgttggtcaggctggtctcaaactcctgacctgaggtgatccgctcgctttggcctcccaaagtgctgggattataggcatgagccaccacacccagcctttctttgtttgttttttaatagagatggagtctctagcctggctaacatgacaaaacctcatctctactaaaaatacaaaaattagctgggcacggtggcacacgcctgtaatcccagctactcgggaggctgaggcaggagaatcgctggaacacgggaggcagaggttgcaatgagtcgagatcgtgccattgcactccagcctgggcagcagagcgagactccggctcaaaataataataataaattagagatggggtctcactattttgcccaggctggttttgaactcctgagctcaagggatcctctcgcctcagcctcccaaagcactgggatcacaggtgtgaggtgccatgcctggcccacaccagctgtgtttaatcaatgctgggcagccctgcagcttggtgacatcagtgggccactggctactgggtgttttttccatcctgccctgttccctgctggcaccaggggaaaaaggcccatacaggagtctgttccaggtcaccagatcctggggtggcccgtaaggatttgaaggggacaggaggcgcccctttgccgaggcccttcactgtgtcaggcacattgctggctgccgtgggtgcacaatcttagggaaccctcctgcctcctccgccttgctgcttccttgcaaagaaaatttcccactgcagagggcagcttaattgctcagcagtggctcttcagaatctcacagatgggccaggcgtggtggctcatgcctgtaatcccagcactttgggaggccgaggcgggcagatcatgaggtcaggacatcgagaccatcctggctaacatggtgaaaccccatgtctactaaaaatacaaaaaaattagccaggcgtggtggtgggtgcctgtagttccagctactctggaggctgaggcaggaggatcacttgagcccaggaggctgaggttgcagtgagctgtgactgcaccactgcactccagcctgggcaacagagcaagaccctatctcaaaaaaaaaaaaaaaaaaaaaaaaaaccggaaaagacaaagaaaataggatgaggtggcaccaagaggacagagtctgtgccacgtggtgtccaggaaggtctctaaggagaggacatccttgccgacccctgcaggatggggaggagcattgaaggcaggaggaaggacattctggagggctccctggaggcggaggtctgggggagcctgaatggtgggaacctgggaggtggagtttgcagtgagccgagatcgcgccactgcactccagcctgggcgacagagcgagactccgtctcaaaaaaaaaaaaaagagtgtcacagatggcaccttcagaccagacagtggccgcccagtaccccgaaagtggcctagaaagcggggctattccacacaccttgcccagcccagcactgaagccagggaaggagggcttgggcaggagccgcggcacaaatcacagctgcaagttctggctctgccaatggctacggggtgaccttcaacaatcagctgcctgcctcctgcctcagtgccttgtttaaaagctgaggaacgccttggcattgagaattgatgtgtgatgcaagatggggcagccgccttggaaaccagtctggtggttcctcaaaaggctgaacgcggagtcgccacatgacccagcaattccgctcctagttatctgcccagaggaattggaagcaggtgttcaaatagaaccttgccacaaatgttcatacagtacgattcacaatggctaaaaggtggaaatgacccaagtgtccgtccgtgggtaaatagataaacagcgtggccctccacacactggaacgagactcagccgtgaacgagactctgacccaggccacgtgcagcctggatgccccttgaggatgtcacactcagtgagagatgccagatccaaaaggccacacagtgtgtcatcctatttctatgaaatgtccaggacaggccagtctagagaggcaggaaggggatgtgtgggtgccaggggctggggagggggatgggaagtgacagctgatagggatggggtgtctttttggggggctgagaatgttctagagctagctagagatgatggctgcacgaatgccactggatgtctggaaagggagcttttttgttgtgtgcatttcaccacacatgtgcctgagacccgacgtgcagggcccccctgcgggtacacagagggcagggagagggtgctagggaaagtcgccgcacctgctttctggcgaccatgctcaggctgtagctgggggaactctcttcccgccctcctgggacctctcgagcctcttgagtctgctcccagtgccgttcaccgggtggtgaggatgtggtctcgcaacagacgcctgcaacggacccacctgtgcgaggctggccccctttaccccgggggtaggcgcggggcccgagttccctgggtggattctgcattgcacttgccggcctttagatgtcgctgtggccgtggccttcgctggccttaggctgcgagcttctgtctgattcgcacctttctcattcaggatccacacactgctgcagtccgagtttcttggcatagccagggtcccttgatcttccccctcaccaattaattaaatcaggatctctcctgctaggtactgtggacatctggggctagatcctctggggtctggccatcctgggcactgcagggtgctgagtggcgtcctggcctccacccactccatgccgggagcacctccaggcatgacaaccacaaatgtccccagacattgcccagtgtcccctgggggcaggatcacccctgattgagaccccccgcccaggttaggggaatccacagattccccaagagactctgcattccgtgaccatctctcctactgaggtcccaggaggctgcacacattgaaatccacaccctgagtggggagggagagaggaggaagagtcccaggagctgggggtccccctggtttatgccatctgccccgtcgggagtttattcttgtatctactgtgagcaggagcggggacagattgcattctccccaaataattaatgcaggatctccccctctccaggtagtgtagacacctgctcttccaatgaggcagtggcttgagacaatggactttagatgaggggctgagagcccaaagcccccctatgtgttaattcaacacctaattcaacgtatagttcaagcaaactcacctaattcaacgtaggtgctaattcagcaagagactgtgcagcctgtagcaggaagtaggctgcagccaccagccgggttaaacttgcatcagaaattctttgtctgaattccttttccacgtcccttaaacaccatccctttccctggctggttctacctggctgcagggccatgttgggacactcagggcctggggcacatttgccctcctaggctacctcctccgctctaaaaatgtccgacgttggccaggcaccgttgttcacatctgtaatctcaacactttgggaggccgaggcggacggatcacctgaggtcaggagttcgagaccatcctggccaacatggtgaaaacccgtctctactaaaaatacaaaattagccgggtgtggtggtgggtacctgtagtcccagctacccaggaggctcaggcaggagaattgcttgaactgggaggtggaagttgcagcgagccgagatcgcaccgctgcctgggcgacacagcaagactctcaaaaaaaaaaaaaaaatttctcaaaaaaaaaaaaaaattctaagctgtattttacaattgtcttggcataaagacaaacagaatccaggctggattcatgattatacactcacaagtattttattcatcttttgtcgactggattttaaaacatttccaggaaccctggacctggggcttttgtgccgtgggagcctgggtcctgcctggggggggtcctggcttcagtcttctcactgaggcccctcccctctcccaggctgggtcaccccgatatgaaatgcccaggtcccagacacaccttctttgcaggctgctaccctggaactgtttttaaatgtgggtgatgctgccccccagggggcactgggcgatgtttggggacgtgtggttatcacaactgggatgctcctggcatggagtgggcggaggtcagagatgctgctgagcaccctgcagtgcccaggatggccccaccccagagaaggatggggccccaggggagaccgtagaccaaagtcaatccaattattaaaaagaaagaaagatttggccgggcgcgctggctcacacctgtagtcccagcactttgggaggccagggtaggcggatcacgaggttgagagatcgagaccatcctggccaacatggtgaaacccggtctctactaaaaatactaaaattagctgggcgtggtggcgggtgcctgtagttccagctacttggggaggctgaagcaggagaatcgcttaaactcgggaggcggaggttgcagtgagctgagatcacactactgcacttcagcctggtgacagagcgagactccatctcaaaaaaaaaaaagatttttatttttatttacttttacttttactttttatttttttagagacagaatctccctctgtcgcccaggctggagagcagtggcgcgatcaacgctcagtgcagcctccacctccccggttcgagcgattctcctgcctcggtctcctgagtagatgggattacaggcgcccgccagcatgcccggctaatttttaattttttgtagagacctggtgttgctctcttggccaggctggtctcgaccttctgagcccaagttatcctcccaccttggcctctccaagtgctgggattacaggcgtgagccattgcacccggcctaagagatatttttaaatggtattatcaaataaatcattaaatagattcgggctatgcaccgtcttgcccacctgccttcaagccccacgcaggacgggaccccctcctgccacggtcctgggacggggcacctcgagctcactcagtggtgacagcgaggccgcctgtcgggccatgaccagcaggtggcagcacagaccagctcccgggagacctgtcctggctccagctcccagcgtcccagaaacaccgcagtctagacgctcgccaggcggaattcctcgcccctgaagtcagtctgcgtgtagacattcgcgataccagctcccagtcatcatttcccactctgcgtctcccaggctgtctcgccagggccctggatccctgggctgagcggcttagtaagggtcggggtggcggggaaccctgggcgccgcacccggtgcgaggggcccacttcccagaaagcagattgcgagagggaagccatccaaggccggtgccgggcgtggtcctttctgagaatgttgaggacgcttccccccccccgagcctggcacgtgagcccgttccccccctcccacccgccccctcgtccccaccgcctgataggaactgaaagtgtcaagtttagtgcccaggagacaggtgtctgcacgctcaggccgactgaaaccaaacctggcctgggagaaacgtatcccaggggccacctgggtccctgaggccgctttggttcaaacctcttctgaaacctgtcagcatcttgcaacaataaaagagggtctcttgtgcctgcaatcccagcactttgggaggctgaggcgggaggatcgcttaagcccaggagtttgagaccagcctggacaagacagcaagaccccgtctctactaaaaaataaaaaaattagtggccgggcgtgatagctcatgcctgtaatcccaccactttgcgaggcgggtggatcacctgaggtcaggagtttgagatcagcctggccaacatggtgaaaccccgtctctactgaaaacacaaaaattagctgagcgtggtggcagttgcctgtaatcccagctactcaggaggctgaggcaggagaatcgcttgaacccaggaggcagaggttgcaatgacccaggatcacaccactacactccagcctgggcgacagagcaagactctgtcttaaaaaagtaataataaataaataaaaattaaaaaaaaaaaagccaggtgtggcagtgcacacctatagtccaagctgctcgggaggctgaggcaggagtattgcttgagtccaggaggctgaggctgcagtgagccatgattgcaccactgcactccagtctgggcgacagggtgagaccctgtctccaaaaaaaataaaaaattaataataataataaataaagaaggtctttgtcatgttatccgaggccacctgagctgtcccctggggcaaggcccttgccagaggcttccccgtgctgtcatcatcttgacccggtgatactaacctctgagagtttaggggagggagggggccctctacttttgggagcactgggtggggagcctggcaggtgctcggtggtagtgacggaccttggccgtttaaggtgcacgctctcctgcttttcctgtaccgttcaatttcctcactcgtggtcagggagctccagaagtgcactgagttcactggctcaccgagggtcccccaatggcccagaggcacccccaggtcccactggattgtcctacggtggccagtctgcagctgtgagctctggggaccagttcctttaacccagcgtgatggtttgctggggctctgtaacctcaagccacagactggaggagggctttagcaacagagatttcttctctctcttggttctggaggctggaagtccaagacggtaacaggtgggaccctgtctgctctggcactcgggacgtggtgcgcaaacatcactgcaatccacccagctgtcctgcacaacgggattccagcaatggccaaaataaggctcacggaagagagcctgaggtcctccagcaagtgagcggctaaactgcagttgttacccggacctgtcggctcccaaatcccagggcaggaccagggtcaggcaagcaatgtattcacactgggcacaaaattgaagggggcgctaaaaaacctcagcgaccaagatgaaataacactttagtgtaaaacaaaaattagctgggtggggtggtacgtgcctgtagtcccagctccacaggacactgaggtgggaggatcatgaggctaggagttcaagaccagccttggcaacatagtgagacccccatctctacgaaaaattaaaaattagccaggtgtggtggtgcatgcctgtaatcccagctactcgggaggctaaggcaggaggattgcttgaacctgagaggcagaggttgcggtgagccaagatcgcaccactgcactccagcctggaagatggagtgagaccctgtctcaaaacaaaaaaagagagagagagagagagagagaatgtacaagaactaggtaggcatgatgtttgtacaacgttgtgaatgtgttgaatgccactgaattgttcactttaaaatgcttaattttacattatgcaaaccttacctcagtttctttaaaaagcgggtcagaaggtggctttggagaaggcacactgattttggctgtggttgcaggcctgcaggggtctgatgaggccctcagtgccagcagacagggttacctggagtggggaacgcagcaggccccctgacagcctcagtgcagaccccgggagagtgtgtcctccgtgtctgccccatgcagggaaggcctttgagactctgccatctgcatcccctgctgcagagagagggggttgcccgggaggcacccggccccttgccctggggtgtccggtggcagccaggggagctcctccaggtttccaggttgctggtctcgtgactctgcagatgactcgagaggcacaggtgtgcctgcatctggggacacgtgagcctgctgcccgtccctggattactgacctgcgtcatttgggggtgcaggggagctgcaccgaggccgtcagtgtgcctgctggggcgcccacctccagagacgatctctgtcctcccgtgtgtgtgaagagcccgtccctccagcccgcaggccttgccttgcaggggcttcggggactttttttttttttcccaggggcaaatcccacgtgggcggaacctctccgcagcaggtattactcttgcgtttcggtctttctgctcctcagacatccccgctcttttcctccacccacgcttcgccacctgtgaatcgttctgacttttaggtgtgaaaccgacgtgccacgctctgtgtcatgagtggcagggcggcgacctcagcctaacctttatttattttttttttcctccaccttcccactgacttggcttaacctttttttttttttttttctcaaataccatctgatcttctgatctccctcaaagagctgcgtctcaggtcgcaggtgaactttctggatggtgtggtctgcgtgcgtgtgtgcgtctggctgcctgccaggagggaaccgctgttgctgccctgtgtcgctgtcgcctgaacgtattgctgtcctggggggactgctccctagaaagcctccgtgccgtgtcgttggtgagcgccggtctgtgctgacactgcaggctacttcccagtgcccacgatgacagctctgcctctgaagtgagaagcggagacgccactgggaggggcggggggcggagggcacggggttcaagtgccaggctgagcctacatgggaggtacttgcagactggccccaagtgggttttatgtgttgttaaaatacataacaatgtagtttagcttgccccatcctaatatgtatttctttttcttttttcttttctttctttctttttttttttttttttaccattttagtctttctttttttttttctttttgagatggagtttcactcttgtcgcccaggctggagtgcaatggtgcgatctcggctcactgcaacctctgcctcccaggttcaagcaattctcctgcctcagcctcccaagtagctgggataacaggcgcctgccatcatgctcggctaattttttgaatttttagtagaaactaaaaatgttagggtttctccatgttggccaggctggtcttgaactcccgacctcagatgatctgcctgcctcgacctcccaaagtgctgggattacaggtgtgagccaccacacctggccttcttttttttttttgacacagggtcttgctctgtcgcccaggctggagtgcagtggtgcgatcacagctcactgcagcctcaacctcctgggctcaagtgatcctcccacctcagcctcttgagtagctgggactacagacacacaccaccatgcccagctaatttttaaatttttcgtggagacagggtctcgctgtgttgcccaggctggtctcaaaatcctgggctcaaatgatccccccgcctcggcctcctgaggtgctgggattacaggcatgagccacggtgcccggcccttgtttactgttcaaaagtttgcaactccatggcattatttccatgaacactgcgtgcaaacaccagcactatctatctagttccagaaacttgtcatcaccgagaatgggaaccttctcagtttagttttggaatgttccaaagagactgcaccatccgagcatgttattggtcttccttgccttggctgccttctctcatcctgactttttatttttgagacagggtctaactttttttttaaattaattaattaattaattaattaattatttttttttgagacagagtttcactcttgttgcccaggctggagtgcagtggcacaatcttggctcaccgcaacctccacctcccgggttcaagcgattctgctgcctcagcctcctgaatagctgggattacaggcgtgcaccaccacacccagctaatttttgtatttttagtagagatggggtttctccatgttggtcaggctggtctcgaactcctgacctcaggtgatctgcccacctcagtttcccaaagtgctgggattacaggcatgagccactgcacctggccagaaacagagtctaactttgtcacgcaggttggagtgcagtggtgcaatctcggctcactgtagcctccaactcctgggctcaagtgatcctcccacctcagccccccaaggactacaggtgcacaccaccacgcccagctaatttttgtattttttgtagagatgggatctcactatgttgcccaggctggtctcaaactcctgggctcaagcaatccacccacctcggcctcccacagtgctgggattacgggcgtgagccacccagcctcttcctgactcttaaaagcggcttgcttgcttggaagcttgcccgactgcggggcatggaggcatttcctgtgagcatctatgtttgccctgaaaagagactttgtatgtcgtgtgagtaatgcccccaaagatattggctcctaaatgtctggaacctgtgaattttcccttataggacaaagaggtcgcagaagtgatcacatgaaggatcttcagacggcagattatcctgggttctccaggtggaccctaaacaattacaaatgtccttataagagtgagattttggcaggctgcggtggctcacacctgtcatcccagcactttgggaggccaaggcgggcagatcacgaggtcaggagatcgagaccatgctggccaacatggtgaaaccccgtctctactaaaaatacaaaaattagctgggtgtggtggcgcatgcctgtaatcccagctactcgggaggctgaggcaggagaatcacttcagctgaggaggcagaggttgcagtaagccaagatcaagccactgcactccagcctgggcaacaaagcaagactctgcctcaaaaaaaaaaaaaaaaaaaaaaaagtgagatttggccaggtgtggtggctcacacctgtaatcccagcactttgggaggctgaggcaggaggatcacttgaggccacaagtttgagacctgtttggccaacatggtgaaaccccgtctctactaataatacaaaaattagctgggcatggtggcaggtgcctgtagtcccagctactcaggaggctgaggcaggagaatcacttgaacccaggaggcggaggttgcagtgagccgagatggtgtctggtgcactccaacctgggcaacagagagagaccttgtctcaaaaaacaaacaaaaaaaacaacagtgagatttgacacatgaggaaaggcatggggagatggaggcagagactggagccatgtgggctcaagccagaggatgcctggaggccccagaagctggaggaggcaggaaggatcctcccctggagcctccagagggagcacggccttgcccacatctagatttctgacctccagagccatagagaatccatttccattgttttaagccaccagatccgtgtgacttgttatagcggcttcaagccactcatactgacagccaaaaggacttggactccaacgacagaatctagttcatcccaggatttcaggtggtttcttgggcctaatacttctaagagaggggaagccgccactggattgtttccttctcgccactgccctgcatctctgtctgggaaaagcattcaaacaaaccacactttgttcttgaacttggggtggtgtgaaaatcacataatagggcagaaaactttctcttttccctccctccctccccactccctcccttccttccttccttccattcattctttttttttttttttttgaaggagggtcttgctccgttgcccaggctggagtgtctagggcagaaaactttctctttttcctccctctgtccctcgcttccttccttccttccctccctcgctccctccctccctccctccctcgcttccttccttccttcctttcattcatttttttttttttttgaagcagggtcttgctccgttgcccaggctggagtgcagtggcgcagtcctagctcactgcagcctcgacttcctggttcaagccatcctcctgcttcagcctccagagtagctgggaccacaagcacacgccaccacatccggctaatttatttttattttttgtagtgatggggtcttgctatgttgcccaggctggtctcaaactcctggcctcaagcgatcctcctgcctcggcctcccaaagtgctgggagacgggcatattatgctgcacctggctaagaccacttttcagtgtgttaaaacaggcacttctcgagacccggcacggtggctcacgcctgtaatcctagcactttggggggccgaggcgggtggatcacgaggtcaagagatcgataccatcctggctaacacagtgaaaccccgtctctactaaaaatacaaaaaattagcggggcgtggtggcgggcgcctgtagtcccagctactcaggaggctgaggcaggagaatggcgtgaacccaggaggcagagcttgcagtgagccgagattgcaccactgcactccagcctgggtgacagagcgagactctgtctcaaaaaataaaataataataataataataaaagaacaggcacttctcccttaaacgcttagttcctccttctgtaaaataaatctaggtgacacaatctctgaaatcctttccagcttgaacacgctaggaaaaactgggagatctatgaacagtgaataaaaatgaactgaaatgatcctcctagctgcaggggcttctgatgcctgcattctccagatggttggtttcctaaatttagccgccgccccgcaagggtgagccctgcatagtttttggtcgatctccagtccaggctgtgaatacacagccctgatttgcatttctgaaccctcggggatggctggattcctcgggctactctgcttggaattttcagccccagagagccaccgcggtctcaccggatgccggtcccacccgatgcgagaagctccgggggttccccctcattctggcatcagctccctctctgcagcctgtggaacagaaagaacacagctttaggccgggcacggcggctcacgcctgtaatcctagcactttgggaggccgaggcgggtggatcacgaggtcaggagatcgagatcaccctggctaacacggtgaaaccccgtctctactaaaaatacaaaaattagccaggcatggtggtgcgcacctgtaatcccagctactcgggaggctgaggcaggaggatcgcttgaacccgggaggcggaggtttcagtgaggcaagactgtgctattgtgctccagcctgggcaacaagagcgaaactccatcaaaaaaaagaacagaacagaacagaaaagagaaaaagaaagaaagaaagggaaggaaggaaggggaaaggaaagggagaaagaaaagaaaggaaggaaggaaagagagagagaaagaaagaaagagaaagaaaagaaagaaaggaagaaaggaagaaacaaaaagaaagaaagaaagaaagaaagaaaaagagaaaaagaaagagaaagagagaaaagggtgggtagcgcatctttccttgcagagccgcagtgagcccccttccagctgtgaactatcaacctgcctataaaaggcaattctgattgaaggaaaagggaggggtggtggtgaggggagggccgggtggccctctgcccagcccgagattggcttccgtttctggcttgctgtccagcgtatgggattgatttagattcccagaacaccacggaaggtagcacatgctgtgacgattgcgtagtggttcgtgctccggggcccggttggagatccctgctgcccgtctgtccgcctgtgcgaggccacagatctgcctgcatttccctgcaggctcgggaggagctggcagaacctgctgcttctgcacagcgcattcctgtctgctggcagctcctccccagcgccctgaagggagtgctggatctgcttaaaagcgtgcaggagggggtgggtacaggggagccagggcctgcagaggacgcagcccgcagcccagtcctcagtgctgctttttctgttgttgttttgagacggagtctcgctctgtcgcccaggctggagtgcagtggcgcgatctcagctcactgcaacctctgcctcccgggttcaagcaatcctcctgtctcagcctcccaagtagctgagattacaggcgtgcaccaccacgcccggctaatttttgcatttttagtagagacggggtttcaccatgttggccaggctggtctcgaactcctgacctcaggtgacctgcccatctcggcctcccagagtgctgggattacaggcgtgagccactgtgcccggcttctagtgcttctccagatcctagcagactttcttccccagggtgcctccacagtgctgcttgcagattctggaaggatcatctgggattccactgctctcctcccctctcctctcctcccctcccctcccctgtcttctcttttcttctttctgagacagggtcttactctgtggcccaggctgaagtgcagtgatgaaatcataactcactgcaacctcagcctccttaagtgagcctcccgcttcaacctccctagtagctgggactacaggctcacaccaccatgcccggctaatttttttataaagacagggtctcgccatgttgctcaggctggtctcgaactcctgggctcaagggatcctcctgccccggcctcccaacgtgcttgggattacagacgtgagccaccatgcccggccttcactgcctttcttttcctcaataaaaatctgacatcgggggattgcattgctctgttaccctttcttcaggcacctctcttttcctgctgccaaacagtggagacaggaagccaaaaaaaattgcccagtccttgttcctggggagctcattgtagagcaggggagacagacacgtatattgcaagcatgtacatgtatctgcaataggcacgagccgcgccgtggcaggactgagtccacatggctggggaaacacactgcctggtaactggaggctggtcagatagtggttgagctgaattgaggagttacctactctagggtttacctacttgtgccccatggtttttagggacaacaggcatcccagctgtaccccgggccatctggatggaactagaatggatgcaaagaacacagctttggagtcaagcaaaccttccttagttctattttttacataagtaataatttgtttttggagatggtggcgggggggaggtctctccttgtcacccaggctggagtgtagtggcgtgatcctagctcactgcagcctcaaactcccgggctcaagcgatcctaccacttcagcctcccaagtagctgggagcacaggcacacaccaccacaactgctttatgtttctcttttttattctccttcagccgtacttttcagctttgaggacttgagcaggtttattaccatcttggatcgcattttctcttctgtgaagtagagagaatacctgtgtattggagttctcaaagtgtggtccagggacacccaggggttggtctctgagacccttttggtgggggaccactaggtcaaaactgctaagatagaagccaggcactgtggctcacacctgtaatcccagcgctttgagaggtcaaggtgggtggatcacctgagctcaggagttcgagaccagcctggccaacatggtgaaaccctgtctctactaaaaattaaaaaaaaaaattagccaggtgtggtggtggcgcctgtaatcccagctacttgggaggctgaggcaggagaatcacttgaacccaggaggcggaggttgaagtgagctgagattgcgccactgcactccagcctgggtgacagagcgagactccatctcacaaaaaaaaaaaaaaaaaaatgccaagatactctgggtctccttcctcccagtctctcccacacagatggtggagttttcagaggttgcatgacgtttgatatcacagtggattgaactcagaggcttatacaagaatccagctgtcttctattaagccagacatgaaagaaatttgcaaaaatgtaaaacaatgccactatttcccctcaatgttttttttttttgaaaaatagttacttttcacttaaacgtgtcatcctcctaatataaaatatatggtttaaaaaaatatttaatgggattatgttaacttgtaacaggagtatagctaaaatctacataaacacaagctgtttaagggccttaattttttattaccatatttatgtatatattttggcatcatatttatatatatttattttatatgacagctttattgagatttttacatgccatagaattcactttttaaagtgtacaattcagtggtttttagaatatccagagttgtgtaaccattaccacaatctaatttttttttttttttgagatggagtcttgctctgttgcccaggctggagtgcggtggcgccatctcagctctctgcaacctccacctccagggctcaagcgattctcctgcctcagcctcctgagtagctgggatcacaggccagcaccaccacccccggctaatttttgtatttttagtagagacggggtttcgccgtattgcccaggctggtctcgaactcctgaccgcaggtgatccgcctgcctcggtctcccaaagtgctgggattacaggcgtgagccaccgcgcccggcctaacccccggttttcatgcaccgtctttgatgttgcctttaggccgtgcctgaacgccggtgtcacaaaccaaagccacaataactcaacagcttcatgaaatacccaaactcccccagctcctgtgacatcaggcaggcggagtgacgcggctgcatggcagggctgcccgagggcccccctcccaggtccgcacctccacctcctggaaacccacccgggtgggcggtgctttctcccgccgaagtcctagaaatgctcttccccaccagctgggtttatttggattcatccagcctcggctgggaggaggaaggggtgggccctcctagtatttattctgctggaatggaaacctcagatcttcgagatactcaagcagacagacagacatctaccaagtcagcgaggggaaagtgcggtgttttcggaggtcagcccgggacagcaaagcaggcaggctggggctctgatcagttcaaaaagcaccacgtggtgtctgcggcggagcaaccagcggcacgcccccaccccaggcgtccctcccacaagcaaatagcacagcccggtgacattggctttttccagccgagcgcggggcacccgcttcgcctcgtgcccgcctctccccctcttcatcatgggccctcggtggaactgtatgctagaaacttcactttccaattttggagatgcttctagaaactagacttctttccagcttgaggtgagctggaagttagatcagtttccatttctttcaactgaaaacgtgattacagaagtcagtgtttcataagctttctttttccgtgatcaccttcttttgagacatccttttcctagtggctccttagaaagaataacggtggcaagagatttaaatgcacccgatgtctgattcttttgacggaagatgcccaagtagcattattattattattattattattattattattattattattattattttattacttttcattttttttgagacggagtctcgctctgtcgctcaggctggagtgcagtggcgcgatctcagctcactgcaagctctgcctcctgggttcacaccattctcctgcctcagcctcccgagtagctgggactacaggcgcccgccaccacacccagctaattttttgtatttttagtagagatggggtttcaccgtgttagccaggatggtctcgatctcctgacctcgtgatccgcccgcctcggcctcccaaagtgctgggagtacaggcgtgagccaccacgcccggccaattctgtattttcagtagagatgtggtttcaccatgttggccaggctggtctcgaactcctgacctcaggtgatccgcccaccttggcctcccaaagtgctgggattaacagatatgagccaccgcgcccggccgcccactagttttgattgtgagttcttttggtccttggttttcgtaagcgttgcttcctcctctgtagtagagtaacaagcatgcagcgtagagtcgccgtgagagctggattcggtcgttgatggacagagccgagtggagagcctgagatgactcagtgccacacaggtgctgctcacacagttgtcctggtcattgtcgtctaaccactgaaactccctagacttttcctacacatgcacactcacatagatacgtacagcaatatggagcgcattgtacattggcagtcctgagctgctttttacctttctaaatttaatttcttttttttttttttttttgaaacagagtctcactctgttgcccaggctggagtgcagtggcgcaatctcggctcactgcaagctctgcctcctgggttcacgccattctcctgcctcagcctcccgagtagctggcactacaggcgcccgccaccacgcctggctaattttttgtatttttagtagagacggggtttcaccgtgttagccaggatggtctcgatctgctgacctcgtgatccacccacctcggcctcccaaagtgctgggattacaggtgtgagccaccacactcggccttattattattatttttgagaaggagttttgctcttgtcacccaggctggagtgcagtggcgtgatctcggctcactgcaacctccacctcctgggttcaagcgattctcctgcctcagcctcctgagtagctaagattacaggtgcccgccaccacgcccagctaatttttgtatttttagtagacacggggtttcaccatgttggccaggctggtctcaaactcctgaccttaggtgatccgcctgcctcggcctcccacagtgttaggattacaggcgtgagccactgtgactggccccaagtagcattattatataatggagtttttgtttgtttttatcttagagacaggatcttctttctctgtcactcaagctggagtgcagtaacgccatctcagctccctgcagcagcttccaactcccaggctcaagcaatcctcccgcctcagtcaccaaagctgggataacaggtgcacaccaccatgcctggataatttttaaatttttattctttctagagattgggtcttgctatgttgtccaggatgatcttgaactcctggcctcaagtgatcttcccacctcagcctccaaaagtgctgggattgcaggtgtgagccaccgagcccagcctatacctgtgaaatttcaatatcatagatagactgtgtatctgtttatgttctgttttctgggcttaatccataaaaaaagtaaaatttgttttcatctccccaagaattgatgttcaccctgttgagaatatatttgtaaagaagtctcgtactgcaggagtgagaatggagacatcttcatcacaaatctcactccccagaattaaccactgttaacagtgtggggtggatgggaactgatcatcagtgcagaacgtgaaaggagaacaactgggtcgatatttgcccacttttttttttgggggggggacagggtctcactttgtcacccaggctggagtgcagtggcataatcatggctcactacagcctcaacctcttggactcaagcgatcctcccacctcaacctcctgagtagctgggaccacaggtggatatcactacacctgcttaatttttttttaattttaattgagacggggtctcactatgttacccaggctggtctgaaactcctgggctcaagtgattttcctgcctcagcctttcaaagtgctgggattgcaggtgtgagccccgcgctgggcctgcctactattttttattttaattttagggaccgactctcactctgtcgcccaggctgcagtgcagaggcacgatctcagctcactgcaacctccacctcctgggttcaagcgattctcctgtctcagcctcccaagtagctgggattacaggcatgcaccaccgcacccggctaatttttgtattttcagtagagatggggtttcaccatgttggccatgctggtcccaaactcctgacctcaggtgatccgcccgcctcggcctctcaaagtgctgagattacagatatgagccaccgcgcccggccgcccactagttttgattgtgagttcttctggtccttggttttcgtaagcgttgcttcctcctctgtagtagagtaacaagcatgcagcgtagagtcgccgtgagagctggattcggtcgttgatggacagagccgagtggagagcctgagatgactcagtgccacacaggtgctgctcacacagttgtcctggtcattgtcgtctaaccactgaaactccctagacttttcctacacatgcacactcacatagatacgtacagccatatggagtgcattgtacattggcggtcctgagctgctttttacctttttaaatttaatttctttttttttttttttgagacagagtctcactctgttgcccaggctggagtgcagtggtgcgatcttggctcgctgcaagctccgcctcccgggttcacgccattctcctgcctcagcctcccgagtagctgggattacaggcacccgccaccacgcccggctaattttttgtatttttactagagacggagttttgctatgttgcccaggctggtctcaaactcctgagctcaggcaatccacccgcctcggcctcccaaagtgctgggattacaggcatgagccactgcactcggcccttaaatttaatttcctttcagccgggcatggtggctcacacctataatcccagcactttgggaggctgaggtgtgtggatcaatcaactgaggtcaggagttcaagaccggcctgaccaacatggcaaaaccccgtctctactaaaaatacaaaaattagccggacgtggtggcgggcgcctgtaatgccagctacttgggaggctgaggcaggagaatcgcttgaacccgggaggtggaggttgcagtgagccaagatcacgccactgcactccagcctgggcaacagagtgagactccgtctcaaaaaaaaaaaaatttaatttcttttgagacagggtctcgctctgttgcccaggctggagtgcagtggtgccatcatggttcactgcaaccttgaccacctgggctcaagcgatcctcccacctcatcctttcaaatagctgggactacaggtacgtgccaccatgcccagctaatttttttgtattttttgtagagatgaggtcttggtatgttgcccaggctggtctcaaactcctgtcctgaagcaatcagctcgcctcagcctcccaaagggctgggattacagacgtgagccaccacgccgggccattaaagacatttttgagataatcatggacaatgggtcacaggctggttattggtaacaggaaattattgttgataatcatggagcaagttgataataagacagtgttaatttgattgggtggttctgtgttgggaaatcagaaagcttcagtgattagagaacattctgaaggttctacaggcaaagtcatatgatgtcttgaatttgtgtgaaatacccgtgcaaagctggagagagaagtgagaacagaagaagggcagaatgttaattcccgttgcaggaggtgacgacactcagagagacctcgtcctggcctgcgtgcttcaggctgtgtttgaaattttccactatatgtaattttttaaatttgcagtttctttcttcctccttccttccttccttccttccttccttccttccttccttccctccttctttctttccttctttctttctttcttgagggagtctcactctgtcgcctaggctggagtgcagtggtgtgatatctcggctcactgcaacctctacctcccaggttcaagcgattctcctgcctcagcctcccaagtagctgggactacaggtgcccaccaccacacccagctaagtgttttgtatttttagtagagatggggtttctccatgttggccaggctggtctcgaactcctgagctcaggtgatccgcccgtcttggcctcccaaagcgctgggattacaggcgtgagccactgtgcccggccttgatttgcagtttctgtaaacaacttgtataatagaaaagcagagaaataaattttcctccccttcagaagcacctcatgtttgttttaaagtatagtatttaatccagatttgagaaggtttggggtgaatgaggtaagaaagtttttttttttttttggcatcaaatatttcggcctgcctctcagcttgcttcagaaaacttaaaacatcacaatagtaatcaaaacatatataacattgaaacagaaggaaatggcatggaccacagaactccaaggattgtttaaaaaaaaaaaaaaagtgctaccccgggaaaagtatttgcaatttttttttttttttagatggagtctcactctgttgcccaggcaggagtgcagtggcacaatctcggctcactgcaagctccgtgtcccaggttcaagcgattctcctgcctcagcacccctagtagctgggactacaggcagccgcccccatgcccggctaatttttgtatttttagtagagacgaggtttcgccttgttgcccgggctggtctcgaacttctgacctcaggtgatccacctacctcagcctcccaaagtgctgggattacaggtgtgagccaccacgcccagtcctactcttaatacttttgaaatctttagagcagcttgaaggcttgtaaatatatagaacgaatattttaaaaaacaaaaattgactcaatactatttcttttcactttgaaaatataaagcacaaaataaagacaaacattccaagttttttttttaaaaaaggaattttccactatacatttttaagagaggcagagattaagaacaacatcaggccgttggtgaccaagaccagaagcctctcccctcaatctgggtggccacaggccacttctcaccacccggtgccctgtcctctttgaagtttttagtctgtgctggattttcttacttttttgtgacctcagctgttggttagaaagagtatgcattttcttttctttttttttcctccctccctctccttccttccttccttctttccttccttccttttcttctttctttttttcccttctcctttcccctccctccgtccctctctccctccctccctttctttctttcttccgtccttccttccttccttccctccctctccttccttccttctttccttccttccttcgttttcttctttctttttttccttctcctctcccctgcctctctccctctctccctccctccctctctctctctctctttctttctttctttctctcttccctccctccctctccttccttccttcccctccccctcccctcccctccccttccttccctctccttgttgctctgtcacccaggctggagtgaaacgatgcaatcatagctcactagagcctcgacctcctgggctcaagcaatccttctgcctcaacgtcctgagtagctgggaccatgggcacataccagcacacctggatgctttttaaaaattttttctagagataggatcttgctatgtttcccaggctggtcatgaactcctgggctcaagcgatcttcctgcctcagtctcccaaagtgctgggattacaggcatgagccactgcacctggcctttgttcatttctttcatccagtcttgcttgggttttagaggaggagagatttaaagtgatgttttctgccacattgctagaaataaaaatgctgtgatagaaggagcaatttttttttaatgtagcaactctacttttcagccttttgaaaaatgttaagagttgtttttggttgccattttttgtcagtgtgatcagtgagcttcattctttttagttagcgcgttcttgtgtatggatatgccagagtgacttgaagaacacactactgatctttacagtttttcttacatccaaataatgttgcagcagaaacatcatggtatacatcacttttgaccttgtctaaatatctcaggaggtaaattcctaaaagcagaaatgcagctttagaagatagtggcatttacaattctgttaatcattgacgaataaccttccacaaagtttatagcaacttgaactcctgtcaacagtgagtgaaaatgccagttcccccacagccttgccataatggttatcaactgaatttaaaagttttgccagccagttatgtgaaattagtgtctctttggtgttataatattcatttatttggccatcagtgagatcagtcacctattcctttcttttctgattgttagtatctttgcactaagtacctctgtatatcttctatttggctattgagtttttcttattgatttgtaggtgctctttacatatgacaggcactaacactttgttacatatgctacatattactattttcttccagtttgctatgtgcctttttactggctttgtggctctcctccatcctaacacacccattgtagaagagagcttcctttgggctggagccttgggatagactttcccccaactttggttctttggttgaacagcctcaatagggagtttggaaacagacaaactcaaggccacacactcagtcccctataatctctcccttaaaaaaaaaaaaaaaaaaaaaaccctttattttcaaattacgaaaacagtgacatactagaaaatcttaaaaataccaaaaggtttaaagaaagggatggaaatcatcctgcatgcattattgccatcttacaagagaggaaacagagaggaggcggagtagtatgttggcaaatagtattggcaagtaggagtatgcctgacaaatctcataagaaacagcaaggagggatgattattcttccacatcatcggttgacacagccttccagcgtggaacggcttgtttgcaagccaaacctaccgcgcaagaggttcttcttgttctctgtgaggtgctgagttgctaggttactgagagcatcaggaatccaaggaacaacatacttatatcgtgctcaactttgaaaaataaagtagatattaacattttaaaatgagtaagaataatatttattgcaccaggatttgcaaatattgaattctagttgcaattctaccatttctagtatgtatgtatgtggatggatggatggatgagtaaatggatggttggatggatggatgaatggatggataaatggatggatgggtggatggatggatgggtgaatggatgggtgggtggatggatgagtggatggatggatagttggttgggtgggcggatgggtggatggttggttgggtggatggatggatggttggttggttggttaggtgggtggatgggtgggtggatggatggatggatggatggatgaatgggtggatggatggatggatgaatggatgggtggatggatgaatgaatgggtgaatggataggtgggtggacggatggatggatgaatggatagatggatggatgggtgggtgggtgggtggatggatggatgaatgggtgaatggatgagtgggcggatggatggatggttggttgggtgggtggatgggtgggtggatggatggatggatggatggatggatgaacagatgggtggatgaatggatagatgagtgaatggatgggtggatggatgaatagatatagagacatagatatagacgacagctttatcaagatataattcacacaattctaccatttctaagcctcagttttatctataagatatggaaaattgttatgtgcccgatagagaaaaaaggaagactgacccattttctttacctgttctattttttgccttacctcttatagttttgttttttaatggtacttttaaaaactgattcatttgaaaaatccacctggataagaggcccaacctcttgataatgttgttacctatagtttatttcctaacagctttattgagataaaattatatgctataaaggccaggcacagtgactcacacacctctaatcccagcactttgggaggccgaggcaggtggatcacttgaggtcaggagttcgagaccagcctggccaacagggtgaaaccctgtctctactaaaaatacaaaaattagctgagtacggcagtgcatgtctgtaattcaagctactcgggaggctgaggtagaagaatcgcttgaacccgggaggtggaggttgcagtgagctgagatcatgtcactgtactccagcctgggcgacagagcgagactggcctgttctgaacatttcatgtcaatgggatcacacactgtgtggccttttgtctggcttctctcactgagtgtgatttttcggagttcatccacgttgtagtgcgtatgcagtgaggttttaaatgctcctggacttagtacaaccccctacgcgcagggcctaaaagagctaaatcaaggcatcatttccttactgctgccatcatctgacatgggaggaggggaccagagtcaaacagcggaggtgggaatgacacaggaagatccagagacacgtggaagactccgagagctgcaagaaatgacatctgggaggccaggcatggtggctcatgcctgtgatctcagcacttagggaggccaaggcggacggatcacttgaggtcaggagttcaagaccagcctgttcaacatggcaaaacaccatctctgctatttaaaaaaaaaaaaaaaaaaaaaaaagtgcacctgtagtcccagctacctgggaggctgaggcaggagaatcacttgaacccaggaggcggaggttacagtgagctgatatcgcgccactgcactccagcctgggccacggagggagactccatcttagaagaaagagacggccgggcgtggtggctcatgcctggaatcccagcactttgggaggctgaggcaggcggatcacctgaggttgggagttcgagaccagcctgaccaaggtggagaaaccccatctctactaaaaatacaaaattagccaggtgtggtggctcatgcctgtaatcccagctacttgggaggctgaggcaggagaatcgcttgaacctggaagggggaggttgtggtgagccaagatcgcgccattacactccagcctgggtcacagagggagactccatcttaaagaagagaaaggagacctgggagtcagctggcaccagggccagcaagggacggctgatgtcacacctgagcacctgggaagagaggtgccaccacgaagacaaagcaagggagtcggggaggaaaagaagccagtttccccagaaagatgaccacctggtggggtctgcggtgtgatcagcaagcctgggtttgctgggtctgaggacttggagccactccaaccaggacaaccctgggtaacccagctggggttggtcaccctgagtctggagttcccacggaacgggccaaggttagatgcgtcagcaggcggtttgaaatgaaggtcagaggaggatggctaagaaatacggcccctgactgacgggagaaagttccacggggcccgcgtccagctgccgccgccctgggctcctgcttttttcccagccgggggaacgggccctttgaccgccctgcccggccctgtgcgattcaccagctgttgacttttaaaagaaaaacaaacctcatgacgtgcgttaaggtctgtttactacctgtcgctttgcagagagccgcgtcgtgctggtttatctcattgtgactttttaatctgatgtctttcgggttgtcctcagggagctgattaggatgtaaaggccagttgcaattcagccggactctcccagtgcacaaacaacattgtcaccagtccccggccaccctctcacgcccccaccaagcttaggaaaatagtttgtgctcaagggacttgctaggtttctaagcagcctgtgaagtgccgtatttctgctgcacaaattgtacccggggaccttttacaccacaacaggccgtttgcaaatagagagatggtttttcttctcttgctccaatctggatgcttttcatttccttttcatgcccagttgccctggcttgaatttgcaataacaatactgaatagaaacagtgagagtggccacccttatcttgttcctgttctttctttctttttcttttctttccttccttccttctctctctctctccttcttttcttttctttccttccttccttccttccttccttccttctctctttctctctcttttcttgagatgagagtcttgctgtgtcgcccaggctggagtgcagtggcacgatcttggctcaccgcaacctctgcctcccaggttcaagtgattctcctgcctcagcctgccaggtagctcctggaggctgagacagcgtccccctcccttccatgcttccacggtcggtgtgatgctgcctcgagttacagctttttgtgaactgcatgaggcccgggtgactcagcagcccaggcctgcctcccctttgaagcccgtttgtggccgttacaaggtggccgcctgcgtaccgacccccgagctgacgccggctgttgtcctcaccggccagagcctctgccatcccaggcgctagatctcacagctcctttgggtcccaggaactttcccagccccttgcagttgcatctcagcagctgtgattctcatcagaagacattgtgcccggggagccctctgcccttccgcccaggacctgagaacgtgggtgagcttccccggcagaggaagcaacgcagggtacgcaggtgaggtcggagggacaggagagacccctgggtctgcacctgggaatgcttcggtccaggcagagaccctagagccagatgctcagggacgatctggtgattgtgtgcaggtcacttcctcctggtgtcttcttgccgccgcaactctccgtggtgaaacctccaacccaggggtcctaacctgcggctgatcctagcccctgggggacatcgggtgacgtctggggccaaaaattagccggatgtggtgttgcgtggtagtggatgccaggattctccactgtcattatgatttcaaggtgacattctttttttttttttttttttttttttgagatggagtcccgctctgtcacccaggctggagtgcggtggcacaatctctgctcactgcaacctctgcctccccggctcaagcgattctcctgcctcagcctcccgagtagctgggactacaggcacgtgacaccacacccggctaatttttgtatttttagtagagacagggtttcaccattttggccaggctggtttcaaactcctgacctcaaataatccgcccacctcagcctcccaaagtgctgggattacaggcgtgagccactgcacccggccaaggtgacattctactggatctacacacgatattcactgtgagttcccattgagggatgcttgcgtgcgtgtgtgtaaattctaccttctttttcatttgagcccttggctgtcaaatgtcagggctgggatttgccctcatttccagagtgtgtgagtgtccttccctccccatccttccctttcagcctcagctgagctcttgggggaccgaggtcaccagcagcttgtctgggcccgctggctcccagccccccaagccagacgcgccatcccagattccccatttgcggccctcgctttgaatttatgggcctgctgagcggaatgggaaactcatcagggagtgtgaaagtcactctagaaggtgggaatgccagcagccaccagcccccagcacctgcaccaacaaggggtcttgccacacagcttgggctggggcgggcaaagctggagggtggggcagtggaaggtgggagctcttgatcctccccgatctcaccccatcaagacggctgcaagactgtgctgagccagccccggttccacaagtctacaaagggggtgagagttccgtttttcatcatcaaaatcgtacaactttatgtttacaaaagtaacactggcttgttgctgaaaaaatatttcagaaaactcacaaagatttaaagaaaaagggatactgaaaaatcaatacattttggccggggcacggcggttcacgcctgtaatcccagcactttgggaggccgaggcgggtggatcacgaggtcaagagagtgagaccatcctggccaacatggtgaaaccccgtctctactaaaaatacaaaaaaatagccgggcgtggtggcgggtgcctgtaatcccagctactcgggaggctgaggcaggagaatggcgtgaacccgggaggcggaggttacagtgagccgagatcgcgccactgcactccagcctgggaaacagggcaagcctctgtctcaaaaaaaaaattactgaattttacactttatgagggtgaattttatggtatatgaatgatgtctccattttgtttttaaaaggaaaagttcccctggtaatcccaatctggagatgaagactgttaaaatctcttccaggctgcctgtttctaactggctgttttcaatatacttttgaacttacggagaagttgcaagaatagccgcaggcacttcgtatactctttatactcaaatatgccaactgtttacacttgccttgccctattttttcttttattattctctcactccatcgttcaccgtgtgtgtgtatacacatttatgtgtgtctatgtatttatgtataaattgcaggtggatatgtatgtatatatctatatatacgcagaaagatagttacttatatggcatatatgctagatatattattatgcagttatgtatacacagaattatatgtatgtaattgtgcatgtatgcatattaatttatttccagtcatttgaaattaagttggagacatcatgccccattaaccctaaagatcttggtggatattttctaagaacaaggcccttccttccttcattcctaccttctttccttccttccttccttcttttcttccctccctccatccctccctccctccttccttccttccttccctccctccctccgtccctccctccctccttccttctttccttccttccttccctccctccctccatccctccctccctccttccttctttccttccttccctccctccctccctccttccttccttccttctttccttccttccttccctccctccctccctctatccctccctccctccctccctccttccttccttctttccttccttccctccctccctccgtccctccctccctccttccttctttccttccttctttccctccctccctccatccctccctccctccatccgtccctccctccttccttccttctttccttccttccttacttccctccctccctctatccctccctccctccttccttccttctttccttccttccctccctccctccctccttccttccttccttcctccttccttccctctctctctctttttaaggcagggtctgccctgtcgcccaggctggagtgcagtgttgcaatcatgcctcactgcagccttgacctcttgggctcaagtgatcctccctcctcagcctcccaagtagctgggacacatcaccatgcctggctaatttttttattttttgagacaaggtcttgcctgtcacctaggctggagtacagtgatgcaatcacagctcactgcagcctcaaacttctgggctctagcaatcctcccacctcagtctcccaagtagctggaactacagtcacgtgccatcgctttttttttttttttttaattctttgcggagatagggtctccctatgttgccctggctggtcttgagctcctgaccttaaaccatcctcccacctcagcctcccgaagtggtaggattataggcatgaaccactggcacccagccaagctggctctgtgtccttctgatacgttgccataattctttgagtttccttactttctggcccaaaaagatgctccagaaatataatatttttttctgcctcagtcctggagccaacctcttctccaacccatcctggtgacttttagttcttccaaacatgtactgttaaaaaatatgcaccacacccacacatgtatggacttttctgaataatcatagaatcacactattgatactgttctttaatctgttttttttaatttagcaatatattatgggaatctttccacattatcaaatatggatttgcgacatcctttttagtgaatgttaagtgttttatcttttggttgtaccacagattactgaactaatctcctaaattaaataggagtgcagtgccaccatcagggctcactgtagcctgggactcttgggctcaagggaggcatctaagttgtttattatttctttacttttatccataataattcttcaggtaaagtgcttgcatatgcacctctgcacaatcctatttatgggcctgctgagcggaatgggaaactcatcaggaagtgtgaaagtcactctagaaggtgggaatgccagcagccaccagcccccagcacctgcaccaacaaggggtcttgccacacagcttgggctggggcgggcaaagctggagggtggggcagtcgaaggtgagagctcttggtcctccccaacctcaccccatgaagacggctgcaagactgtgctgagccagcccgggttccacagtctacaaagggggtgagaggtccatttttaatcatcaaaatagtacaactttatgtttacaaaagtaacactggcttgttgctaaaaaattttttcagaaaacacacaaaggtttaaagaaaaatatccttaggacagttttccagagggagatttgctttcaagaacagttattccaatgtcctccacccactgtctgctagtccatgatttatcacaacttgaccatccctggatattatctatttaaaaaaaaaatacttgccagttagaccaggtgtagtggctcatgcctgtaatctcattactttgggaggctgaggcaggaggattgcttaagcccaagagtttgagaccaacctgggcaacatagcaagaccccatctctacaaaaatatttaacaatttggctgggcacagtggctcacgcctataatcccagcactttgggaggctgaggtgggcagatcacctgaggtcaagagatcgagaccatcctggccaacatggtgaaaccccatctctactaaaaatacaaaaaatagctgggcatggtggcttgcacctgcagtcctagctactcgggaagctgaggcaggagaatcgcttgaacgtggtaggtggaggttgcagtgagccaagatcaagttactgcactccagcctgggtgacagagcgagactctgtctcaaaaaaaaaaaaaaaaaaaaaaaaaaaaaattaacaattagccagccatggtggcatgcacctgtagtcccagctacttggaaggtggagctaggtggatctcttgagcccaggaagtccaagctgcagtgaggcacaattgtaccactacactccagcctgggcaacagagcaagaccctgtctcaaaaaaaaaaattgtcatttaaaggctaaaagtaacagctcattgtatgatctataatcttttttattactggagagcttgaaagttttcataatgaacatttataatgctttttgtggattatgttcacttttaacaattttattttttacattttgagataatatgtgaattatagaagaggtgcaaaaatagtacagagtgttcccttacacctttcatccagcttcccattggctgatatcttccataactacagaacatttatcaccactaaaaaaatcaaccttgctgcaatattaagtatagggctgattcaaatttcatccttttttccatttccacgtgcttttgtgttccatgatctgatccaggatcccacatttattaagctggtttgttcacttttattgattttttggagatctttatatattaaggacctcaactttttgtctctcgtccctttggcaaagtatttccattttgctttttcactttggtgatgacttcaagagatgggtggtaggtgacataggatgatgctggcaccctggcttaaagtgagggttatagggcacaggctgcatgccaaaccctccacaaaatgttctcacctccctgtcccctcccagacattctctgtttctctaacacaaattgagcaactggccacttgtcaccttgtgaaaccttgatattttattccacaaagttgtgcctatcttgagtagagcctacaccttagaccataacacggttcatgcgttgtttcaacacctgttgggtgatgcagagtgaatggggcctggccaggcatcttgttgaggaacatgtcacagtgtcctcaccctcaagaaggggaggtgtcccatccctgcagggtggggtgaaaacacgtgcagaagtgggcattgggagtgcagccaggagcttggctgcaggcgtcctggctgcagacacagctttgctgctgtgtttggtaaacaacaccagggaccagggagggggcccccacatcccaccccacagcctcagacctgttctcacccccctgtggtttgggaactcagtatctctgctgacccctcctgggcaatttgcaagtgaaggaattgactgctggtgctccaggccacccgagagacaccctccgccccccacccccccacccccatcacccctccacccccgcggccccccccatcagtctgtcacccaggcctctgggcacttttagacaaactctgttgggggaggggagaggaggaagcagagattaatcactttcaggctgggcctgcggcgaaggcacttctagtgagggacatcatagtgcattttcccacagcgttcatggaagtctttcttgaggcctgatatgaggggaagacgagggaagaagacaccagtctctgcctcaacaaccaggcagaggccgggcgcagtggcccacgcctgtaatcccaacactctgggaggctgaggcgggtggagcatctaggatcgggagttcaagaccatcctggccaacatggtgaaaccctgtctctactaaaaatacaaaaattagccgggcgtggtggtgcacacctgtaatcccagctactcgggaggctgaggcaggagaatcgcttgaacctgggagggggaggttgcagtgagccgtgattgcaccactgcactccagcctgggagacagactaagactctgtctcaaaaaaaaaaatgtaaaaattaactgggcttggtggcacctgtagtcccagctacttgggaggctgagtggggacgatcccttgaggccaagagtttgaggctgcagtgagctgtgattgcaccactgcactccagcctgggtaacagcaagaccttgtctctaaaataaaataaaacagaaccaggcacagagctgggcacggtggttcatgcctgcaatcccagcactttgggaggtcaaggcaggtggatcccctgaggtcaggagttcgagaccagcctggctaacatggcaaaacctcgtctctactaaaaatacaaaaattagccggacatggtggagtgcacctgtagtcccagctacttgggaggccaaggcaggagaatctcttgaaaccaggaggcggaggttgcagtgagccgagatcacaccactgcactccagcctgggcaacagagtgagactcagcctcaaaaaaaaaaaaaaaaaaaaaatagaaccagacagagagcagcagggctgcgtcctatccctgccccttagacagagaggcatgaaggggtgagcaggccaggccgggaccaatgtcgggggccaggactgggactggtagggttggcagggctcactcagctgcgtgtatgggccctgacccctgggcacacctgcattcccctgccctgggagttgctccagtgtttattgagtgggtcctctgggatggcactgggggggtgcaatggttttttttaaagtcctagtggattctggccaggtgtccgaggaggacacaagctgagagacacctgcgcccccagaactggaggaggcagaaagcgttctcccctggaacctctggagggagcacaggcttgcagaccccatgattttggacttctggcctccagaactgggagaggatccatgtctgtggttttaagaccccctcccagtcccccatttgtggcactttcttacggcagccccaggacacccatccacagagttcctgggaaatggggatgtcaggcccgtcgtctgcacgtttggcaaccagaaaagcccctgtccgtgggggtgcgtcccctgctccccgcatttctgccaaagccccttccgtcggcagcttgtccttgcatgtccccgaggaaggtgaccagcaggcggagctgctgcccagcggcggccgtcccctcgccctcctccctcctcttgttaccataaacacttggagacctcagaggaaaacgctcaaggattcccagcctccagggctgtgtgccgagggcttcagaggctcgcatggggagcgccctttcctgcacccgccctgttgactctgctatcttcccggtcgcccggcttcccggggcagcctgatggccagggcgcaggtctgggtgggtgccaggtgcctgccctcctgcccgcccgccctggccaccctgagctgcaggacacagagacccggacgggagccagccgtgctgggcgtggcctggactctgggttacgctggggcagtgaaatttcaaaacaaacttagccacatggtccgagtcaggtgtgtccgggtgacccctgtgcagaccttggcgtctggacctgcccggccgggggcacccatcccgcagatgctgaggcggagccccaaatcacgggaccctctgctgcaggcaccggcggggcgggctgccagggccggagacgagccatgtgcattcttgggatgttttttcgtttaaccgtctctccctctcccagccatttcctggcctctcgcagacaagcgacagacaagcaggtctggcgccgggccacgctggtggttttccatgccggggtcagtctgggatccacatccccacagctcggcccctggggggccgggagccaggggtttgaggccccgatccaccccttcccagctctgtgaccttaaaatcctttagcatcggtttccctacttgtgcatgttaacatttggaagctgatgattcttggtctcggggtgttggggggcttcctggcagggagtgggtggagaccagagacgctgctcagcaccctgcagtgcccaggacggccccaccccagagagaaggatccagccccaatgtccacagggctgagggggagaggtcctgctgaaaagctgcaaacaggtgcttttctgcccagcttctccggcctggttagcgatgaaacctgtggctgccagccattgagcccagcccctgggcgggcgttgctcgtgaattccttaggccctgcaggacgggcagtctcttgcttgtggctggagcaccgttttctgttgatttatttatattctgcctcattccacaaaggatcggagcaagcattcaggaagagattctatcaaatacaaaactgcaaatagcttcctaacatagtagagaacagggcgagtcaggagttggcactaggctgccctcggtcctctgggtcccgtattgggttctccgagggcccccggctctaacgggggatttgtcccagctctgcctacgctacctgtgtctcagcagatctctgagcctcaaagccctcagagaccctcaaagcccctaagaatcagcaccctctatgatgtcataatgctgaataagacaagcacgtagccgggcgcggtggctcacgcctgtaatctcagcactttgggaggccaaggtgggaggatcacttgagcccaagagttcaagaccagcctgggcaacaacgagacctccgtctctacaaaaaaataaaagaattagccgggcgtggtggtgcacacctgtggtcccagctactcgaggggctgaggtgggaggatctggagcctgggaggttgaggctgcagtgagctgtgattgcgccattgcattccagcctgggtgacagcaagacttcatctcaaaaaaaaaaaaaaaggaaaataacaccataacattttatatagggatgttctacattttctttttagatttatttctcaatataaatatgtagcaaatgcttacatgcatatataatatgtaaaatattacgctgattttttttttttttttttttttgagatggaatcttgctctgtcacccaggctggagtgcagtggcgtgatctcggctcactgcaacctccgcctcctggcttaaagcaattttcctgcctcagcctcccaaagtgctaggattacaggcgtgagccaccacgcccacccagaagactctagcttagcagagttgtgggaagacactcccctgctggttcctggtgtgaagaagtgagcggtgcattgcgagaaggcccgaggagggtctgatagctaggacccaagggtggcccataggagctgggagtgtcccccaggcaacagccagcaaggaaacagggaccccggtcctacaaccacagggaggcaaatggtgccaacagcctgagggaatgctggatgaagagccttccccgggcgagccttggatgagacgcagccccaaccaacacccagactgcagccctgggggtaccctgaacagaggccctggcttggctgttcccggactcctgaccccacaaaccgtgacgtactaagtggatgtgtgttggaaggcgccacatggatggcaattggttacgcaacacagagactgagctcactgccccacagccccagcttgcgaggtggaccttgtcctgaccctgccaacaggaatacaaagacttactggaactttgcacacgggacagccctggtgactcacgtagcgtgaatgacttaagagcaaattcaggccgggcacagaggcccacgcctgtaatcccggcactttgggaggctgaggtgggaggatcacttgagcccaggagtttgagaccagcctgggccacatagcgagaccctgtctttagaacaaattttaaaaattagccagggtgatgctgcactcctgtaatcttagctactcaggaggctgaggcagcaggatcgcttgcgttcaggagtttgagaccagcctgggcaacccagggagaccccatctgtaaaaaaaagttttaaaaattacccagatgggctggtacgcacctgtagtcccagctactcaggaggctgaggtgggaggatcgcttgagcccaggaggtggaggctgcattgagctgtgattgcacccctgcactcagcctgggcagtgaagcaagacccctgtttcttaaataaataaataaataaatacataataaaataaaaaagaccaagtttagttcccaagggttcctggtttcccagacgtgtgagggtggccaccagctgctgcagtgcccgtcccccgcctgccgcggcccgccctgtcctccctggggtcagcaagcatccagggaccacggtgaactctaggagggagtgggtcagccccacccagggcggattcccagcacaccgtgtgcaggcctgggtcgaagggttctgctggaatcaacccggcatgtttgtttttgctgcagtcccctggggccgtccgggctgcacgcctgcacgtcatccgaggccgccccactgcggtgggttgggaaactcagtcttggagcctgccagcctcacaactcctgctctgggagcacgtgcccgtgccgcatgtgtctgtgtgtgtctgcatgcatctgtgtgtctggttctgtgtgtgtctgtgtgtgtgtctgcatgtctgcgtgtacctgagtgtgagcatgtgtctgtgtgtgtctgtgtgtgtgtctgcatgtctgcgtgtacctgagtgtgagcatgtgtgtgtctgcctgcatgtgcctgtgtctgcatgtgtctgcctttgtgtgtctgtatgtgcctgtgtgtctgtgtatgcctgcgtgtgcctgcgtgtctgcgtgtgcctgcgtgtgcctgtgtctgcgtgtgcctgcgtgtctgcgtgtgcctgcctgtctgcgtgtgcctgcgtgtgtctgcatgtctgtgtgtgcctgcgtgtctgcatgtgcctgcgtgtgcctgcgtgtctgcgtgtgcctgcgtgtgcgtgtgcctgcgtgtctgcgtgtgcctgcctgtctgcgtgtgtctgcgtgtgcctgcgtgtctgcatgtgcctgcgtgtgcctgcgtgtctgcgtgtgcctgtgtgtgcctgcatgtctgtgtgtgcctgcgtgtgcctgcgtgtctgcgtgtgcctgcgtgtctgcgtgtgcctgcgtgtgtctgcgtgtgcctgcctgtctgcgtgtgcctgcgtgtgtctgcatgtctgtgtgtgcctgcgtgtctgcatgtgcctgcgtgtgcctgcgtgtccacacgccctgaggaggcgcccgttctgctttgtacacttccctggagctttccagatcaatcccaaaggatgcccaaaaagactcgagcagggcactgtggctcacacccgtaatcacagcactttgagaggccgaggcaggaggattgcttgaacccagtagttcctggcaacagcaagtccctgtctctacaaaaaaattttaaaaattagctggataggctggtgcaaacctgtggtcctagctactctggaggctgaggtgggaggatagcttgagcccaggaggtccaggctgcagtaagctatgacggtgccactgcactccagcctgggcaatagagcaagaccccatctaaaaaaaaaaaaaagaaagaaagaaaaaaaggaaagaaaaagaaaaaagaaagagagattccaaccagcctttcttccctggttccctgacagctcagagttaaccattgtgcccctaagcctaacagcagctggagctgatagcctttcacagggcctgccagcagccttggagaaaccacgagcccatttaacaggcaggacgctgaggctctgataacaagtgcggtttcggacaagagcgggagaggagatggagaaacagaccctcgtgcgtggctggtggggatggaacaaggcccagcctggcagcttctcacatggtaaacacggaattaccatagggcccagcaatcccactcctggggatagaccccacagaactgacagcagggactgaaagaggtgtttgcacacacaagtgcacagcggcatgattcccaacagccccagggtggaagccaccccaggcgcccatcagtggataaacacagcatggtccaaccagacagtggaatattacgcagccatgaaaaggaagggaatccagacacgggctacagcgtggatgaaccttgaggacctcacgctcagtgagaggatccagacacaaaaggacgtatcctgtgtgatcccactcctgggaagtccctagagtcgtcagattcacagagacaggaagtaggatgagtgagtgccaggggctggggagggggacagggagtgagtgtttcatggggacagagtttcagtttgggaagaggagaaagttctggagaggatggtggtgatggcggcacaacattgtagtgagaaaagagagagggagaggaagggctgaaagccccaagccccatcttccggctccagcgtcatatgagatgcgtgttcccgcggcctcaccgttgagtttgaaggcgtgatgtcagaatgcaggcccagcagggacaccccgggagatggtgggggtggctggcagggcgggtttcacctggactgcaccagcccaggtgtgacgggctctgggccagacccaggcacccaaggtgagaaggcagcatctctggtctcgggatacccaggcctccccgaggcggcagaactccggccgtacctcgcagcagctggtccgtggcacccacggtatgtcccattcatgcagtgcctttccagcctcttccagaaagaatttaattcacccgttcgcatatgaccacgggagggaaatgccaatcccacttttattgtttgtttttgttttaagatggagtcttgctctgtcacccaggctggagtgcagtggcgtgatctcggctcactgccacctccgcctcccaggttcaagcgattctcctgcctcagcctcccgagtagctgggattacaggcgcccacgaccacgcctggctaatttttgtatttttagtcgagacggggtttcgccgtgaacaagacactaactctttcaccatgttgaccaggctggtctcgaactcctgacctcaggtaatctgcccgcctcggcctccgaaactgctgggattacaggtgtgagccaccacccccagccccaatcccacttttagatcgttctccacagatagcgcagaagcagcttgtcggaagccacgcagctgtgaggggacagggtacagacaagatcttaagtcttctagccgcttccctaagactagccccgcctcctccatcagtgcagaaacttggctggggagtgggctcggaactgtggtcccctcaatacctatttcatgaaggaagccaggccaggcgtgggggctcaggcctgtaatcccagcactttgggaggctgaggcgggcggatcacctgaggttgggagttcgagaccagcctgggcagcatggtgaaaccccgtcgctactaaaaatacaaaaaattagccgggtgtggtggcgcctgtaatcccagctactcaggaggctgaggcaggagaatcgcttgaacctgggagacggaggttgcagtgagccatgatcgcaccactgcactccagcctaggcgacggggcaagactctgtctcaaaacaaaaaaaaaaaaaaaaaaaggagaaatttccagaacaggcagatccacagagaatatgcatggatgtgtggttggaggagacgggggtgactgctaatgcggacggggtttccatttaaggcgatgaaacagttctggaattcagccagcacagtggctcacacctgtaatctcagcaacctgggagtccgaggtgggaggattgcttgagaccaggagttcaagaccagcctgggcaatatagtgagaccccatctctagaagaaaagaattttaagttagccgtgcatgctggttcatgtctgcagccccagctactcgggaggctgagatgggaggatcgcttgagcccaggaattcaaggcttcaccgagataaggaggtgccactgtagtccggcctgggcaacagatcgttaactcttaaaaaaaaaaaaaaaaagggccgggcgcggtggcttacacctgtagtcccagctactcaggaggctgaggcaggagaatcgcttgaaccggggaggcagaggttgcagtgagccgagatcaggccactgcactccagcctggcgacagagcgagactccgtctcaaaaaaaagaaaagaaaaagtgttggaactacgtagtgttgatggttgcacagctctgtgaaggaattaaaaacttgctcgaccagcctaggcaacgtagcgaaacccgtctctacaaaaaacaaaaaaattaagcaagcatggtggcatgcacctatagtcccagatacgtgggaagctgaggcaggaggattgcttgagcccaggagttaaagaccagcctgggcaacacagcaagaccctgtctctaaaaaacaaaaaattagcctggtgttgtggtgtgcccctgtggtcccagccactcggcaggctgagctgggaggatcgcttgagctcgggaggtggaggctgcagtgagctatgatcacaccactgcactccagcctggtggacacagtgagaccccatctcaaagaaaaacaaaacaaaacaaaacaacaaaaacacaaagagagagggacaatgtggcattgtcaaaagaacagacaaataggccaatgggacaggataggtaggtagcccatattttatatgactcatataaaacggtcaactggccgggcgcagtggctcacacctgtaatcccaacactttgggaggccaaggtgggcagatcacctgaggtcaggagttcgagaccagcctggccaacatggtgaaaccccgtctctactgaaaatacaaaaattagccaggcgtggtggcactcgcctataatcccagctactcagaagggtgaggcaggaggatcacttaaccccgggaggcagaggttgcagtgagccgagaccgcacctctgcactctagcctgggcgacagagcaagactccatctcaaaaaaaaaaaaaaaaaaaaaaaaaggaaagaaatgaaaagaaaagtgaccacacatctgataactctttcacttaacgtagcctgcaggcaccctccaagccacccctgcacgctacccatcctagaaatgcaacgtggcctaaccacgcctctgcaggcagattgagatggttccagtttggaagcattcacagttctgcaatcagaacaaggataaggatataggtagacatctttgcccacgtgtccaacaaggtctttgcaataaattcgtaggtatggaattgtcgcatcagcaggtagcaccttctcggttccgacaatgccgccacattttcttccaaaaatgttgaccagggaccctctgttatctgtgctggagaggcccccattccgcagatcctagaagacactgggcgtcgtcaggcttccatcggtgacagtccgagaggccagggtggaatcctgttattggtgcatgtgttgttgtttgttaaagctggacaactccgccgggcacggtggctcacgcctatcatctcagcactttgggaggccaaggtgggtggatcacttgagtctaagagtttgagacccacctggacaacatagtgagaccccatctctaaaaaaaaaaaatacaaacattagccaggcgtggtggcgtgcacatgtaatcccagctactggggaggctgaggcaggaggatcggttgagctcaggaggtcaaggctgcagtgagctgtgattgcaccactgtactccagcctgggtgacagagcaagaccctgtctcaaaaaattaaaaagccaagctgaacatctgtttttaggcttggggttttgtttccttgtgtgaattgtgggttcacgtcctttaccatctctccactgtccgaggagcgctgtctgctcctggaaaaccttccagtaccttctgttcatggctgagacttggctcctgggctgtctgtctctctcaagctcctcctggggcccattatggggctgcgtccttagggatttagcttctcctttgctctcatgagttctcggctaagtgggtgtggagatgcccattttacagatggaagagctgaggtttgcagatgccacttccccagtgaacacgggccccatccacatgtggctggaaagggaagtttccttcctgacctgaggcccagtcaagctctgcgtgtctccccgtgcctgactgtcatagtctgttttgtgttgctataaaggaatagagctgaggctgaggggtttataaagcatagaagtttatctggttcacagttctacagaccatacagttctacagaccatacaagcatggtgccagcatctcctgggcttctggtgaggcctcaggaagtttccactcatggcagaaggtgaagggggaacgggcatctcatacggccagagagggagcgagagaaaggagggaggaggtgccaggctttttttaacaaccaggtcgtccgtgaactaacagagtgggaactcgctcattcccgaggggagagcaccaagccatgagggacccccctcccgccacaacccaaatgccgcccacccagcctcacctccaacatagggggtcgcatttcagtgtgagatccggaggcacaaacattggccccatgtcactgacattgctcagtcctgtgctgctggattctaggattttgtggctatttttgtcgcagttgttctagtgtggtggttctcagctggggctgatcctgctcccaggggacaccgggagatgtctggtgacgtttgtggttgtcatgactgggggacgggtgatgtctggggacatctgtggttgtcccgatggggatgctcttggcatggagtgagtggaagccagggacgctgctcagcaccctgcagtgcccaggatggctccaccccagagaacggtctggctacagtgtccacagtgctaagagagaccctatttagtatgatagcgacataattgtcatgtctcacactttttgtttaagaatggagatgattggccaggtgcggtgactcacgcctgtaatcccagcactttgggaggccgaggcgggtggatcccgaggtcaggagatcgagaccatcctggctaacccggtgaaccctcgtctctactaaaaatacaaaaaattagccgggtgtggtggcgggcgcctgtagtcccagctactcgggaggctgaggcaggagaatggtgtcaacccaggaggcggagcttgcagtgagccgagatcgcgccactgcactccagcctgggcgacagagcgagactctgtctcacaaaaaaaagaaagagagagagagagagaatggagatgatcgccatccactgtgtagctgttcctgctccagcagttatgctgcaccctttgtggaactgatccccagcaggtgcctcatgctggggcctctcccttcactgagttgtgtgtgtgtgcgcgcacctgtgggtatatgcatgtgtgcatttgtgtgtatgtgtgtgtgtgcttgcatgcttgtgtgtatgtgtgtgcgcttctgtgtatatgtttgtgcttttgtgtatatgtgtctgcttgtgtgtatatgtgtgtaaatatgtgtatgtgtatgtttttgtgcacagatctgtatgcgtatatttgtgtgtatttgtatatttgtatatgtatgtatatgtgtatagtgtggatatgtgtgtgcacatgagtatgtgtgtgtacttgtgtgtatatttgtgtgtatttgcatatgtgtatatatttgtgtgtatatgtgtgtgtatatatgtgcgtgtatatgtgtgtatgtgtatttatgtgtatatgtgtatgtgtgtatgtgtgtatgtatgtatatgtgtctgtatgtgtatatgtgtgtctatattttatgtatgtgtgtatgtgtatatatgtgtatgtgtatgtgtatatgtgtatttgtgtatatgtgtatatatgtgtgtatgtgtatatatgtgtgtatgtctatatatgtgtgtatttgtgcatgtgtatgtgtgtatatgtgtgtatatatatgtgtatgtgtgtatatgtgcacgtgtatgtgcacacacagagaccctgtgtatgtgcgtaagtctgtgtgtatgtgcatgtgtgtgtgtatgtatatgtatgtgtgtatgtatatgtatgtgtgtatgtctatgtgtatatgtgtgtgtgtttgtgttgtatatgtgtgtctatatgtgtgtatgtgcacgtgtgtgtatgtatgtctatatgtgtgtatatgtgtgtgtgcgtgtgtatgtgtgtgcgtgtgtatatgtgtgtaagtctatatgtgtctctatatgtgtgtatgtctatatgtgtgtatgtgcacgtgtgtgcatgtctgtatgtgtatgtctatatgtgtgtgtatgtgcatgtgtgtatgtgtgtgtatgtatgtgtatgtgtgtgcatgtgtatatgtgtgtatgtctatatgtgtgtatgtgcatgtgtgtaagtgtgtgtgtgtgcatgtgtatatgtgtgtatgtctatatgtgtgtgtatctgcacgtgtgtgcatgtgtgcttgcatgcccgtgtctctgtttttgggtggctggagtgcctggtgagatgcattttccaggaaggcgttgtgaacgccctacttcctgagttcctgctgaatggcaacgcccttctctcccttccatgcctgagcgcgtggtgcccgggaacagatgggtgacttccctgttgcccagttgacattgccctgcccccgtcggagtctggtgctctgaagaggagacttgtgaccttttaggtctcatcctagaccacaaggcagcgagcttttcctgtaaagggccagagggttgctgttttcggctctgtggcccagtctccggctccagcactcagctctgccgctggagcacagaagcgtcagaggcagtgcctaagtaggatacgacagaggacaccggcccagtgcagcggctcacgcttgcaatcccagcactttgggaggccgaggtgggacgatcgcttgagctcaggagctcaagaccagcctgggcaaaatggcgaaaccccatctatacaaaaaaatgcaaaaattagctggtgtggtagtgtgcacctgtagtcccagctgctcaggaggctgaggcagggaggtcgcttgagcctgggaggtcgaggcagcgtgattgcaccacgggcactccagcctgggtgacagagtgagaccctatgtcacacacacacacacacacaaatcgacgacaactgagaagaaataaacctgcagatggaaaaggtgtgttctggaagcatcactacaggaatgatcacggccaacccaatgacttgaaattaaggagattctagagcagaggtcagccagcaagggcccatgatggacagtgtgggttttttgttattgtttttgtgtttttttttttgttttttttttgttttttttgtttttttttttgagacggagtctcgctctgtcgcccaggccggactgtggactgcagtggcgcgatctcggctcactgcaagctccgcctcccggattcaagcgattctcctgcctcagcctctcgagtagctgggattacagacgcccgccaccgcgcccggctaatttttttgtatttttagtagacacggggtttcaccatgttggtcaggctggtctcgaactcctggcctcagatgatccgcctgcctcggcctcccaaagtgctgggattacaggcttgagccaccatgcccagcgacagtgtgtttttgtaaataaagttttattggcacccaccatgcccactcattgagaaatcgtccacagcagcctctcctgcctctgtggctgagtcgagcagttgcaacagagaccatctgacccacaaagccagagaagtttgctctctggccttttacaggaaaatgttgccaaccctggccttacaacctctagccagtcctttagcagtgggggtgggaggggaaggaggtgtcccccgaccattgctgtggccccagttctggtctgctgtctcggacccttcccccggagccaggctgagacgccttttagggctttgtgtgagtttcatggggtgctcgtacaaggtccacagacctagccgtttagacaccacgggttcattctctctccgctctggagaccggaagtccaaggccaaggtgtaggcagggctgggttcttccgaagccagtggggagaatccatcccagggccactcccagctcctggtgatggccggagatccttggccttccctggcttgtggaagtgacacccccaatctctgccttgtcaccccaatctcctatctatacagcattctccctcccgtgtgcatctgtgtccaaatgtcccctttatttattttttatatttatttatttatttatttatgagacggagtctggctctgtcgcccaggctggagtgcagtggtgcgattttggctcactgccacctccgcctcccaggttcaagcgattctcctgcctcagcctcccgagtagctgggattacaggtgcccaccaccacgcctgactaatttttgtatttttagtagagacggggtttcaccatgttggccaggctggtctcgaactcctaacctcagatgatccgcctgccctggcctcccgaagtgctgggataacaggcgtgagccaccgtgcccggcctctaccatggtttaaaatgtctgcacacatcattccgcccgtcccctgcagaagcgctgagcacattacactctgcagacgcttcctgtaggactcggccgggctcacacagcctccaccctgagctgccggtaactgtcacctggagtctcaactgccctgtgcccggcacaccccagaccactcaatcaggttcttccgggtgggatgggcctctcccagtgattgcaggttttaggaaccctgggcgaactggttcctaatcctaaatttctgcagttctcatggattcagtcctggagggaaggaactaaccgacccttcctttgacgcaaacagcttttgtttttgtttttttttttttgagacagagtctctctctattgcccaggctggagtgcaatggcacgatctcggctcactgcaacctccgcctctcgggttcaagtgattctcttgcctcagtctcctgagtagctggaattacaggcgtgtgccaccacgtccagctaatttttgtatttttttagtagagacggggtttcaccatgttggccaggctggtctcgatctcctgacctcatgatccacccgcctcggcctcccaaagtgctgggatgacaggtgtgagccaccgcgcctggcacagctttggtttttgagcctgcagggtgcacacgttgtgtgagggttgcacgtgtgttttccgttttccccatgtagtctgagcccgtgattccaacaggaaggcgtcatcttctccacctcagggtcttctgttgtcatggctacagggagacacagaagcttagcggatattttattgtatttatttcatttcattccatttcaagacagggtctcactgtgttgaccagagtggtctcaacctcctagtctcaagtggtcctcctgcctcagcctcccagagtgctgggattgcaggcatgagccaccgcatctggcctgattcttttttttttttttaaatgaccaatgtattcatttcctagagtgccatgcaaattattacagattgcggggctttaaataacagacattttgtgacagtctcctctcctacttttggaggccagaagtctgagatcaaggtgtctgcagggctaggctccctccagagactccaggggcagggtccttccggcctctcccagcttctgggggctctaggagtctggcttgtggccgtgtcaccccagtctctgcctccatctccacacagccatgtcctctcctctgcatctctaaatctctccttcttggtgtttgtttgtctgttttgagacagagtcttgctctgtcacccaggctggagtgcggtggcaccatcttggctcattgcaacctccgcctcttgggttcaagcaattctcgtgcctccgcctcccgagtggtacaggtgcacgccaccatgcctggctaatttttgtatttttggtagagatggggtttcaccacgttggccaggctggtctcgaactcctggcctcaagcgatcctcccgcctcggcctcccaaagttctgggtttacaggtgtgagccaccaatctcagcctgtgtctctccttcttaaaaggacaccagtcattggatttagggcccaccctacaaacaggatgatgatttcatcccaagatccgtatcatcttccatctgcagagaccccatctctgagaaggttacgtgccaagcttccaggaggacgtgagcttttgcgggacactattcaacccactgcattcaatacacattctttttcttgagttgaaaattagctacactcctgtttaggagcctgcccttacacacacgaacaccattctcattggctaaccatcctttgatttttccctgctgtttctcccaccccacccaacacccccaaataccaccttcaccgtctcctccattccttgatttgcaatgctgctgtgttgtttatgtatgagcttcaaatcctctctggaccaaggaagtttgggtgcgaaggtttaaataactcaacagttcacaattaggctaaaaattcacacataaaatgagcccactgaagtgttcaaaggtgtgacctgggccgggcgcggtggctcatgcctattatcccagcactttgggaggccgaggtgggcagatcacttgaggtcaggagttcaagaccagcctgggcaacatggcgaaaccccatctctactaaaaattccaaaattagccaggcgtggtggtgcacacccgtagttccaactactatagggaggctgaggcaggagaatcacttgaacccgggagtcagaggttgcagtgagccaagatcgtgccactgcactccagcctgggcgacagaaatgaaacctatctcaaaacaaaaacaaaaaaaagtgtgacctcaataatgcttgggagtggttctcttaggatcctgagtagaatgtggggacatttctggtagtcacgactacggggtgctcccagcatggagtgggtggaggccagggacgctgctcagcagcctacagtgccgaggacggccccaccccagagaatgatccaggcccaatgtccagagtacagaacgggagagacctgtgttcattatttgaaaaatactgggccggacgcagtggctcacacctgtaatcccagcactttgggaggctgaggcaggtggatcgcgaggtcaggagatcgagaccatcctggctaacacggtgaaaccccgtctttactaaaagtacaaaaaaaaaattagctgggcgtggtggtgggcgcctgtagtcccagctacttgggaggctgaggcaggagaatggcgtgaacccgggaggaggagcttgcagtgagccgagatcacgccactgcactccagcctgggcgacagagcgagactctgtctcaaaaaacaaaaaaaaagaaaaagaaaaagattgaatctgtcccttgctcacactggacaccagaataaactcccgatggggccgatggtgtaaaccagagggactgcagctcctgggactcacatcctctctccctccccactcagagtgtggatttcaatgtgtgcagccttctgggaactcagcagggcagaggattatggacgcagagtctcttgggggtctgtggaatcccctaagattccagtgtacgctgggagcgatcctgtcccccctgaccagggtacactcagtaaatgtctgggggcacctgctgctggcatggagtgtgtggaggtcagggacactgctcagcaccctgcagtgcccaggatggccccaccccagagaaggatctggccccagtgtccacagtgcccggggggaaaaaccctgttgtaggtattgaaagtgagtgtagctttcagctgaacagaaatcatgagtattaatcatttaaaagaaaaggaaaaggagcggggcgcggtggctcacgcctgtaatcccggcactttgggaggctgaggcaggagaatcacttgaacctgggaggcggaggttgcagtgagccgagatcgcgccactgcactccagcctgggcgacagagccagactctgtctcaaaaaaaaaaagaaagaaaaagaaagaaaagaaaaaggaacccgctgtagatgtgtgttcctggggctgagcaggtggggaccccggcagctccggggctgcggtgactcacggctctggctctgtgtgaacctgcagatcccaagggtgttactgcaaacccctgagtgggtggagggcgtgaatgcctgccccggaccctggtttctttctgagaagcagaacgcagagagacttctcagagaaatgtcggaggaaggggattacccgctggtctcccagaagagcctgcgaagctcagaaacagggtttcctgtttctcgggtcgccccggggcagctgcctctgctgggcactttgctctcaggtgcttttcagagtgcaaagaagagaaagaagccagtgtcatttctttttttttagacagagttttgctcttgtcacccaggctggagtgcaatggtgcaatctcggctcactgcaacctctgcctcccaggttcaagcgattctcctgcctcagcctcccgagtagctgggatcacaggcgcctgccgctatgcccagctaatttttttttttttttttagtagagacggagtttcaccatgttgggcagactggtcttgaactcctacttcaggtgatccacccgcctcggcctcccaaagtgctgggattacaggaatgagccactgcgcccggccaaccagtgtcatttctatctttctgagagaggctcttgtggggattgtgtgtccaagagtgctaagagctgggagggtcaaagacccaggccagggtgcagagaggaagggacaaggggaggacagggcccctcctgggcacagaagggcagtggtgctgacaccaaaactgtgacaggacctaaccagggtctccccagggcaccgtggatattggggcctgggtcattctctggggttgggccaacctgggcactgcagggtgctgaacagcgtccctggcctccacccactccattccaggagcacccccagtcgtgacagccacagatgtccccagacatggcccagcatcccctgggagcagaatcatcctggttgagcccccctgggttatgggattccacggacccccaagagactctgcgtcccatgatcctctgccctgctgaggtcccaggaggctgcacacattgcaatccacaccttgaatgggggagggagagaggaggtgagtcccaggagctgggatccctctggtttacacaccgtctgccccatcgggagcttattctgatgcctactgtgagcagaaattgcattcaactgttttcccaaataatttttttttttttttttttgaaacagtctccttctgtcgcccaggctggagtgcaatggtacgatctcggctcactgcaacatccgcctcccaggttcaggcagttctcctgcctcagcctcctgagtacctgggattacaggcacccaccaccacgcctggctaatttttgtatttttagtagagacggggtctacccatgttggtcaggctggtctcgaactcctgacatcaagtgatccacccacctcggcctcccaaagtgctgggatgacaggcgtgagccaccgcgcccagcttttttccaaataatgaattcagggtccccccaggccctgtggacatcggggctggatccttctctggagcagggccgtcctgggcaccgcagcgtccgcctaccccatgccaggagcacccccaagtctggataaccacaatgtccccagccaccgcccagggtcccctgggagcagggccactcccaggtgagaatcactgcctcaagggaagggctgggtgggacacagaaataagatgtggaggtaaggggtcctgcttgggccccctaaagcaggtcggacctcctctcctgagaatcgaccctgggggccggtgggagacagacctgggggatggggtgatgtggggtctgaggcggtcccttccttcctgccacggccaggccctcagcacactaggggcgcgagggacaggctgggtttgtactgtagtcccctttgtcattcacggagtccgtatttgcgaattcgccggcttggtgtgtatttgtgaaccccaaatcaatgcctggggtactttccctcttatccttggacacgcagagagagacaagaaattagagtcatggacgtgcgttccctgagcccaggccacgctccgcctccccgtttcccctcctaggtggaccacgccctcattactgtctagcgagagcctcggggtttgcgtttttgtgctctttttggtgattttgctgtttgcagtggccccaggcatcgtgctgaggccccttctcgtgtccctcagggcctcgtggaggaactggtaggtgagaaaagctttgctcaggcaggactgagagagcagctgccctattcaacactcacatcatcgataggcattcaagaagacacctttgagccaggcacggtggctcacgcctgtaatcccagcactttgggaggctgaggcaggcggatcacgaggtcaagagatcgagaccagtctgaccaacatggagaaaccctgtctctactaaaaatgcaaaattagctgggcatggcggtgcatgcctgtaatcccagctactcgggaggctgaggcaggagaatcgcttgaacccaggaggcggaggttgcagtgagccgacatccaccattgtactccagcctgggcaacaagagccaaactccatcttgagagaaaaaaaaattagccggacatggtggtgggtgcctgtaatcccagctactctggaggccaaggcagtagaatcacttgagcccaggagactgaggctgcagtgagctgagattgcaccattgcactccagcctgggcaacagagcgagaccctgtctccaaaaaaaaaaaaaaaaagacacacagaacaggtcatgtattgatcagataaaggaaagtttcctgaaactcaaaggaaactacccctacaaaaatgttctctaggagtaatgatttgtgttcgcaaactcagtttttgtggtgacttcacagaacagaactaccacaaataatgagaatctaatcaactgtggatatatatgtatatgtatatatatgtgtgtgtgtgtatatatatatattctttgtgactatgaaaggaatataactggctgggcgcgatggctcacgcttataatcccagcactttgggggggccaaggtgggtggatcacatgaggtcaggagtttgagaccagcctggccatgttggtgaaaccccgtctctactgaaaatacaaaaattagccaagagtggtggtgcatgcctgtaatgccagctacttgggagtctgaggcaggagaattgcttgagcccaggaggcagaggttgcagtgagcagagatcgcgccattgcactccatcctgggtgacaaaatgacacctgtcccaaaaaaaataataaataaataaaaaggaaagagagagaagaaagaaagaaaaaagaaagaaagagaaggaaaggaaggaagaaagaaaagagaaagaaagaaagaagaggaaagaaagttatataacttcattttacagaatctgagaatcacataaggagaggaaaatcatccacaatcccagcactttatcctttccccagacatctacacacactctcttatttttaaaaattgaggttctacaacatggtttgatcatctgcctttaaacccatttttgctggccgggtgcagtggcacacacctgtcatccagcactttaggaggccaaggtgggaggatcgcttgggcccaggagtttgagaccagcctgggcaacatggcaaaaccccatctctacaggaataaaaattagctgggtgtggtggcatgtggctgtagtctcagctactcaggaggctgaggagggaggatcgcttgagcccaggaggttgaggctgcagtgagctgtgatcacgccattgcactccagcctgggtaacagaccctatctcaaaaaaaaaacaaaaacaaaaacaaaaaaacacggtgcccatctgtggcaaggatgatgaaaataatacagtgtgcacatgaaaagcagtatttccagccacctaaaagtaagcctgagaggccgggcgcggtggctcacgcctgtaatcccagcactttcggaggccgaggtgggcggatcacgaggtcaggagatcaaggccatcctggctaacacggtgaaaccccctctctactaaaaacacaaaaaattacccaggcctggtggcccgtgcctgtagtcccagctacttgagaggctgaggcaggagagtcgcttgtacccaggaggcagaggttgcagtgagccgagatcgcactactgcagtccagcctgggcgacagagtgagactctgtctcaaagagaaaaaaagtaagcctgagagagaaatgcaccgagtcaccccatcagaataaggagctgtggttccctggtcaaggaccatggcctggggcagggtcaaagtcctgtgggttctgaggctgacccggggctgcaggtgaggtggccccagcatcctcggtcactgtcctgattttatggatcaggagctgaggtcacaccgggctggcctgggcacatcgcactttgactcagagtttgtgatgggtcagaagtctaacttcccgtctttctctatcacggtcctgaaacggtgctacaactccattcgctgacccggccaggcggagcctctgagtcttttgtgagtgcaggtgcctttgggcaggaggaggaaaagtcctgcagcccctcgtttcttgagtctgtgcatgtttactagcaggaccttgcttcagatgcagggctgggtggaggcgctcgctcctgcgtgcatgtgtgcgtgcacgtgtgtgtgtgtctgtgtgtgtgcacatgtgtgtgtctgtgtgcacatgtgtgtctgtgcgtgtatgtgcacctctgtgtgtgcacgtgtctgtgtgtgcaaatgtgtgtgcacgtgtgtgtgcacatgtgcgtctgtgtgtgcatgtgtgtctgtgtgtgcatgcaaatgtgtgtgcacgtgtcttgtgtgtacgtgtgtgcgcgtgtctttgtgtgcatgtgcgtgagtgtgcagtacacgtgtgtacgtgtgtgcgtgtgtctgagtattcctgtgtgcacgtgtgtgcgtgtgtctgtgtgcgtgcatatgtgtgtgagtgtgcgtgtgtctgtgtgtgcgtgtgtgtgtgtagaggtgggaggggaggcagcccccctggatgtctctaggtcactaagaggttagggatctcacacggagtgattctgccccccaggggacccggggcagtgtctggggacatttgtggccaacacatctggggggtgctcctggcacggagcaggtggatgccagggacgcagctcaccaccctgcagagcccaggatgctcccgccccggagaacaatccggcgctggtgtccgtattgctgggtgggaggagagaccctggcttaggagaaggtgacctcagtcaccgccttcctgcagctgagacccgggagcctctgggaaagccgggactcggcctccccagctgggctgcaaggtgaggaggcttcccgccgacctcagcttccttggcctccaatgcagccccggggcgcagggctgctgagaaagtgtcgtgtgtgggtggcccggactccagcccaggagcagcagccatgtggctcttctttgtgtcggtggaaaaaaacccattggtttgtggaaatagcaaatgtttgtgacggaagaggggcctggccggcttcagagaccacaggggcccttcagggcaggagggaaacagccttggccacgtgaacccggcccagcccggcctcgagcagctcaggaagctgggcctgggttgggcccggtgcaggggcgtctgctgacctcgccgggcaagcccactgcagggtgagccccgctaggcaggacggggcctcccctagagctgacagtggtgcagctcctggcttctccaagtggggctgccggctcagcagcagagcagtggtggcctaaccgggagacacagaacctggcatctgggttcattgtgcgcaagtcccggccccatgacctcggccggtgtagacgctccgcaaggcaggggcctttgcctgcctcgggcctccttgtccacgaaataggaggctgccgcgaagctggagggggcagatcgctgcctggatctccctccagaccttagtgggagtcaggaaagaccacggaaggtggtccccgtgggcccccctcgcgatccgtgcactgtgcattggagacggccgtgggccccccctcgcgatccgtgcactgtgcattggagacggatacggggcctggccctgtgcagggtccggcttggaacagaggattccgttccatggaaaaccgcagctccaaaggccccaaccgccccgacccccggagaccaatcaccggggcctggagacgttctttccttcctattgacctcctggccctgggcggctcacatgagacccccggccttcctgccccccgtatacctgtcacttcctccattcggggttaattggtttgtccccagtttccactttccacctctccctttgcccggcacgtggcttacataaaagtagaaatcagagatggaaaaacaccgaagtattccatgggaaggcgccgtgcctgggtattttgtttttcttgcactggtgtgtctgatggactggactttgactgtggggttggggcttccttgttctgaaatggaataacacaagtttctggaagataatttgccctgttgtccagcaagagaagcatccaggtcttctccgcacggatcggtggtaaagaataaagtggattctgcccccgttttctccggagggcacggccctttcgaattcccatgcctcatttttggggacagcaacgtcgttctccgataaaagctggaggtagctctgtgagttccttgtaagtaaaaaatatgtaaccatgcttttctctttctctctccttttttaaacagggtgtacagcaagctgtgattcctgggaaaactaaaaaaggtatgtggcattttctcttacttcatgaggttggaatctcttgttttttagaaaaaggaacaaacaagccccagtcttttatgtgtgcctgacactttgggaggttgagtcatcccataaaagggctccgggctcagagccaggaaacctgagttcaaatcccagatccccttttaccagctctgccccgtttgggtgggttcgcgtcaactgtctgcagtggagatgacgttctccgttttgcaggaaggttgcaaagattaaacaagcatatagatacaaaaatataaaaatagccaggtgcagtggctcacgcctgtaatcccagcactttgggaggctgaggcaggtgggtcacctgaggtcaggtgtttgagaccaggctgaccaacacagcgaaaccccgtctctaccaaaagtacaaaaattagcagggcatggtggcaggtgcctgtaatcccagctactctggaagctgaggcaggagaatcgcttgaacctgggagatggaggttgcagtgagctaagatcatgccaccgtacaccagcctgggcaacagagtgagactctgtctcaaaaaaaaaaaaatatatatatatatatagcatatatattttatacacacatatacctatatatatgtatacacagtggcgtgcgcctgtagtcccagctactcaggaggctgaggcaagaggattgcttgaacccaggagttcggggttgcagtgagctatgattgcaccactgtactccagcctaggtgacagagtgagacccggtctcttaaaaaatatacccagtgtggtggcacgtgcctgtcatcctagcattttgggaggctgaggcagaaggatcacttgagcccaggaggtggaggctactgtgagctgtgattgtgattgcaccatgggactccacgctgggcaacagagtgagaccaggtctctaaagaaaagaaaaaaatatatatattatatattatatataatatattatagttcactgctataatatactattatatcatagctcactgcaatcttgaactcctgggttcaagcaatccctttgcctcagcctcctgagtagctgggactataggtgcacgccactgtgtatacatatatacatataatatatacatatgtgtaatatatattacatataatatatacatatgtgtaatatatattacatataatatattacatacaatatattacatgcaatatgcacatgtatgtaatattacatagaatatgtacatgtatgcaatgttacatataatatgtacatgtatgcaatattacatataatatgtacatgtatgtgatatattacacatgatacgtacatgtgtgtgatataacattacatgcaatatgtgcatatatgtaatatattgcatgtaatatgtacatatatgtaatatattatatgtaatgtgcacatgtgtgtaatataacatattacatgtaacgtgtgcatgtatgtaatataacatattacatgtaacgtgtgcatgtatgtagtatgatatattgcatgtaatatgtgcgtgtatgtgatatgatttattacatgtgatattacatatatgtaatgtgatgttacatgtaatgtgtacatatatgtaatgagatgtacatataaaatataatatatagtatataatatataacataatatattgcatataatatataacatatatattgcatataaaatgtatattacatatatatatgtatatatatatatgctcagcaccatgctggcatgtcagtatctaagagatgtgagctgaacctgaaaccatcgctgatctgtttcattcgcgtttttctaggaatttgtccatttcgtgtagattacctaattggatgtcacacactggttcataatgctaccgtgttctctgataatgccttttatttccatacagttggtagtaatgtcctcctttcgtttctgcgtgtagttatctgcatcttatttcctctttttttttttttttttggttttgcttttggtcagccccgctagaggtttgtcaatcacctagctcttttcaaagaaccaacttttggtttcgtcgactcgccagtttttctcatctctgtctcgtttatcgctgctctgatctttacaatttccttcctcctgctggcttggggctgccttcgttcttccttttctggttccttaaggcagcagtcctcaacctttttggccccagggagtggattcgtggaagacagtttttccacagacagtggggaggtggggggggtggagccgggaggatggtttggggacgattcaaacgcattactttttttgtgcactttgtttctgttattatgacattgtaatatataataaaataattccacaactcaccataatgtgggatcactgggagcccggagcttgtttcctgcaactagatggtccctgggctgggtgtggtggctcacgcctataaccccagcattttgggaggctgaggcgggtggatcacttgaggtcaggagttcgagactagcctgaccaacaagatgaaacctcatctctactaaaaatacaaaaattagccaggcgtggtggtgggcacctgtagtcccagctacttgggaggctgaggtaggagaatcgcttgaacccgggaggcggaggttgtagtgagccgagatcgcaccattgtactccagcctcggcaacagagcgagactctgtctcaataacaaacaaacaaataaaaactagatggtcccatctggaggtgatgggagacagtgacagatcatcaggcattagattatttctgtttgcttgttttgagacagagtctctctctgttgcccagtctggagtgcagtggcatgatcttagcttactgcaaactccgcctcctgggttcaagcaatttccggctgattttttgtattttttagtagagatggggttttatcatgttggccagtcgaggccattaggcattagattctcataaggagcgtgcaaccaagatcccttacatgcacagttcacaattgggttcacgcttctatgagaatctgatgccactgctgatgggacaggaggcggagctcaggcgggaatgcaagcgttggggggcagctgtgaacacacaagcagtcaggcgccgtggctcacgcctgtaatcccagcactttgggaggtcaaggtgggtggatcgcctgaggtcagaagctcgagaccagactggccaacatggcaaaaccccatctctactgaaaataaaaaaaattagccgggcgtggtgacgcatgcctgtaatcccagctacttgggaggctgaggcagaaaactcacttgagcccgggaggcagaggttgcagtgagctgagatcgtgccgttgcactccagcctgggggccagagcgagactctgtctcaaaatatgtgtgtgtatatatatatattttttaaatatatattttatttataaatatgtatatgtgtttttatatatttataaatatatatttgtttatatatttataaatgcatatttatatattatagataatagataaatatatattaataaatacatataaatatatttttatataaataataaaagattgtatgaaaatataatttaccagcacggcagggctttttggcgttccctagattttgcccccaaggtgagtgccgcatggcctcaccctagtcccggcccccacacaaatgacactcaggatgacgacgaagacagtgatgatttaaaacctggccgatggccgaggggtcgcatgtgcccgtggtgtctggtctggatccttttacgtccttctccatgaatatattctccatggagaagtccctgccctctctcctgttttctgaccgggagaccagacctcctttgctggaggtcaaacggccagggtgaggtccctggagcctgccctgagccccgtcctctgggacacacaagtgctggctgatggcagcgtggctggacggcaggtggcacggagctgcctgggcaaggctcaggtgtctccaggccgcaagctcaagctgccagccatgtggccacgtgccgtggggattaggtccctatgctgcagcatctgctgggagggatgacaagaggctccagcaatgacatcaggcagctctcgtcgggccctggctaagtcccctggccctgttcccagcagccgggccatccccaccactgacgcctccctgatcctcagctccccctactcagcgactcagcagatacctctcccgtgccccctgcaggccaggtccactgctccaattcctttagttctcctaggatccctggggagcagggctcattgtccccattttataggtggggaaactgaggctcggcaaccaaaagatgtggcaaggcccgggggctggccagaggcagagcgggattggagtcacgagacttgccacagagcagctggtggtccctcaggctgtgtaggccacctgctcatctgcacaagcccctcagagcccagcagggccatggtcactctccctgggggacagtcacagaagctggggcttggtgaggaggtgagcagaggtggccgggagcggtggctcctgcctgtaatcgcagcactttgggaggctgaggtgggcggagatcacttgaggtcaggagttcaaggccagcctgaacaacatggtgaaaccgcgactctaccaaaaaataaaaaaattagccgggcttggtgttggatgcctgtaatcccagctaccagctactcaggaggctgaggcaggagaatcgcttgaacccgggaggcggaggttgcagtgagccgagattgcgccactgcactccagcctcggcgacagagcaagactccgtctcaaaataagccagcaaggagggtcgccacgggggctggatgagagagtgcctcccagccgctccttctgctgcattctacccacttcctgtgagccagtctcaacccaaacactctttccccatcccacagggattctgagaatcagggcaccccagacccaaggcagccacatttcccttttccactgagagcggaaagaggcctcggcacttcctggggcagcccaggatttggccgtgtttctgcattagcaagaaaaggcgtaatggaatttggatagacaagaaaaggggatgtaagcgtgagcaaaaccacacactccatttcattgttagaaattccatgcgtgtcatcaaaacctcatcttgggacagaggccaagacgaactcactgtcacaaggaactttgtgcacaacaagtgtgctggctcccctgtcacccccgccctcacccccggcctgctggctgaccccagacacagcagccttgtgtttcctccctcctggtcagctggtgcctggtagctgcagcggtggtagctgcagtggtgtctctccagaaggttctgggggagagactgaaattcccatgcttagccttacaatgccccggccccgtgcaaacctccagatgaaaacacagccccggccagtgcggtggctcacgtctgtcatcccagcactttgggaggccgagacacgtggatcacaaggtcaggagttcaagaccagcctggccaagatagtgaaaccccgtctctactaaaaatacaaaaattagccgggtgcggtggcgggcgcctgtaatctcagctactcaggaggctgaggcagagaattgcttgaacccagggggtggagtttgcagtgagccgagatccgccactgcactccaacctgggtgacagagtgagactccatctaaaagaaaaaaaaaaaaacacagccctgtttaagccctccgtgcatgtcctcctccacctccacccccacggctgccatttttgccaaaacgtatatcctggacttgccttcttgccgtttgctgtgtttgagcgtcgagcgttgagccagacacagttgggttggcacaggagtcagggttctctccgggggtcctgacagtttgctgccaaaccttcatgtccagacctagtgtcccccctggggtccctcgggtttgcagttgccttggcattgaggattcaaggtgtgtggcaggaacagggacccaggaaaccctttggtggcctcagcctgcccagctttgtcacttgaacctgtcgggatgcaaacaacatgcacagttcacgagaaagccgctcctggctggaacatcccttcgaccagggtctctgggtatcagcatctctgacattagggtcagattattcttgagagggggttgtcgctgtttgtttgtttgttttgttgtgttttgttttttgagacagagtctcgctctgcacccaggctggagtgtagtggcacgatcttggctcactgcgacctccgccacgtgggttcaagcgattcttctgcctcagcctcccgagtagctggaatttcagacgagcgccaccaggcccggctaatttttgtatttttagtagagatggggtttcaccacgttggccaggctggtatcgaactcctgacctcaagtgagccacacacctcagccacccaaagtgctgggattacaggtgtgagccactgggcctggctaggttttttttttttttttttttttccagacagagcctcgctctgtcgcccgggctggagtgcaatggcgcgatctcaacccactgcaacctccgcctcccgagttcacggcattctcctgccttagcctcccgagtagctgggattacaggcgcccgccaccacacccagcaaatttcttttgtattttagtagagaccaggtttcaccacgttgcccaggctggtctcgaactcctgagctcaggcaatccgccctcctcggcctcccaaagtgctgggattacaggcgtgagccaccatacctggtttttgttttttgatttttgttttccattgttaacatgaaaacatccgtaatgatccctagccctcagggagaagctccctgggcctgtagttttccgggactttctaacaacaccagggctggagtggggtggccctggagatgtcacacatgatactggtgacctctagccattctgatgatgtgacctggagcccacgggccacagcagagaaccccaggctcgaggtccatccttggccatgtgtgtgcccggacgggccggcccctgctgcagagcccagaggggtgggcctaccaggccacgtgtgcccatgcacagcagcagcacctgctatggatggaggtggggcaggcacttcacatccgagggctgcctgggcctgggagcctctgtcctgggaaggagatcggccctgggaacagagtgggttccaggaagtaacaccctttgtgaactccctgcaccatggcctccagccccttccatccaagtggcatctttggtacccagtgtctgggatgtgctggggttggcagaacaaaggcctcaaagacatccatgtcctaatccctgggagctgtggctgtgtcaccacacatggaaaaagggactctgcaggtgggattgagtgaaggaccacctgagtcatgagagcaccaccgtggatgatccggggtgggggggcgcagtgacctcacaggatcctcacgagaggaggcaggagggtgagagtcagagagagactgaagaggctgtgctgtgtctgtgaagggggaggaagggtcccgagccgagggatacgggcacctctaggcgaaaggcgggaaagagattctcccctggagcctccaggagggaccagccctgcctgtgccttgattttaaaccagtgaggcccatgttggactctgagcccagagctgtgagatgagaaacatgggtcgtgtgcagcagccacaatgtcacaggacacaacgaacgtccagggagctgccagtgtgcggagaaggggttttagtgcagcctggctgtgcatagatggttgcaatcaggggcttctcagaggggatgacatcggtggggctttgcaggatgtgtaggagttttctggggggggggcatgcgtggagaaagacccacctgtgctgaggtgggaaggcccggtactgccctctgttctcttcctaaccctcctgcccttcagctcccgagcaccaccgtcacgaggccggcgctgccccttgccctggcccggggccagggtgacagcatttcctcagccgggaagcccagaactggagtgacaggagccacggggttcagtgtcctggcccggccccggttcccgggcttgcaaactctcacatgaccgtggtcatcccccgcccccgccgaccccaccgccgggtggacagagagcagcttttcttttctcctgctcccgtcaccgcggcgaccaaacccacactggcggcgcgtcaccctctgtcgtcgcggcctctttgtctgaacaagccggctcattcttaggctccaagctccggctgaaggcagcggcgggacctgccccgctggtctatttttcactttctcgtgggcacctcattcattccctctctttagccccttctaaatatagctgccccggggaccgatttagcctgagagcaaagggcccacactgacagggacagtcacaaggcactattttccagccagtgcggccctcccttccatgtggcagaggccctcccgcccgcagccctgggccccacggccctgccttgaggtcacagagccaccaacggtcagagctggcacggaaggccccacacacagccgccctcccaggccctgctgggcgacctggccctggagaggctgcaggtgcagggtgggtgcccacgctgggtgcagggtctctgcatgcagaccctggttgctgagggggccctggggttctgtggagcgggcagcaggtgtggccagtctcagacctgtctcttgtattgaagtttccatttcagtcgggctccccgggctctgcgtgggtcccctctttggcgtcctggtgagaacatggcaggccgtggggggcctgcatcccagctgccaggggacacatcaacgcctgatcgttgccctgtgccttctcaccctgatgccctgtgtccgctctggaagctgtgtgcacctttctttttcgtttgtttgttttgttttgttttgttttgtttttgaggcagagtctcgctccgttgcccaggctggagtgcagtggcgcgattttggctcaccgcaacctttacctcccgggttcaagcaattctcctgcctcagactcctgagtagtggcattacaggtgcccaccaccactcacggctaatttttttgtatttttagtagagagggggtttcaccgtgttggccaggctggtctcaaactcctgatctcaggtgatccacccacctcagcctcccaaagtgctggtattacaggcatgagccactgcacctggccttttttttttttttttttttttaagacagtttcgctcttgttgcttaggctggagtatagtggcgcaatcttggctcactgcaacctctgcctcccaggttcaggcaattctcctgcctcagcctcctgagtagctgggattacaggcatgcgctaccatgcccagctaattttgattttttttttagtagagatggggtttcactatgttgaccaggctggtctcgaacccctgacgtcaagtgatccgcccgcctcggtctcccaaagtgctggaaatacaggcataagccaccgtgcccggcctatgtgtgcacctttctgcagagtctaaaccagggtcccctaggcactgtagacatggcggccagattgttctctgaggtgggcctgtcctgggcactgcagggtgctgagcagtatccctggcctccacccactccatgccaggagcaccccccagttacgacaaccacagatgtcgccagacagcgcccagggtcccctgggggacggaattacctctaggtgaaacccccagggataggggattccacggacccccaagagactctgcgtcccatgatcctctgctgtgctgaggtcccaggaggctgcacacaatgaaatccacaccgagctgggagggagagaggaggtgaatcccaggagttgggggtccccctggttcacaccatccatcccgttgggagcttattctagtgtgggtagggattgaaccccattttccccaaataattaactcagggtcttctccctcagcactgtggacagtggggtaagatccttctctggggtgaggctgtgctgggcacttacggttgctgagcagcgcccctggcctccacccactccatgccaggagctcccccaaccccgacaaccacagatgtctcaggcatcgcccagggtttcctggcggggctgaatcacccacccccccaattaagagccactgttggcccagcacggtggctcatgcctaaaatcccagcactttgagaggccaaggtgggcagatcacctgaggtcaggagtttgagaccaacctggccaacatggtgaaaccccatctctactaaaaatgcaaaaattagctgggcgtggtgggggtggggggcgcctataaccccagctactcaggaggctgaggcaggagaatctcctgaacccgggaggcggaggttgcagtgagccgagatcgcgccactgcacactgtcctcaggggcttctgtgagatgcactgaggtcctcatggctcccgggggtgctcatggctgaggccctcgtgcccacagcaggcgtgcagatgtgcacattgacgcaggtgcccagggacacagctctctgcaaacccagctgccccagccactgtacgaaggcgacttgttcctcacagtgcctcggagccttctcttctctcccaaactactgttccattttgtttgggtttggatcttttcctctctaaacataacaccctgtctctcttgtctctgaacactgtgttctcagaagcagtcatccctccacggggaagggctgacgtttccactccaagcattgtctcccctcctgccaaatctggttgctggttttgttgcttggggtttatttttctttcctttttcgaggcaggcagaggtttggaggggtgagaggtgggggattgccagacccccaggaggaaagagtccaggagctctgcgagctataaagctactggttctggaagttttagagccagatgaaggttgcttctgttctcacgttgctgctgcaggccggccgcccctcccgccttcaaggccaccttcccccggggctgactcaccccggcacgccgcgccacacaaggctggctctgctttgatgagcagactggaaaagcgcagccgcctcattgtggagctgcctggaagccgccagagcccgctctgagctggaattcgctgagcctgacttcctgtgccgtcaggagagcaaacgcccgctggccttaggagccggtttacaggaagcagccatgggaggacggtttgctcggctcatggagaagcagccaccctctgcacgggttttaatgctgcaccctcatctcagggctgtgaaaagaaaaattgcaggccgggagcgggggttcatgcccgggatcctagcactttgggaggccgaagcagagggattgcttgagcccaggagtttgagactggcctgagcaatacggtgaggccccagctctaaaagaaaaaatattaaaaattagccgggcatggtggtgcacacctgtagtcccagctactcagaaggctgaggtgggaggatctctggaggccaggaggtcaaggctgcagtgagctgtgattgcaccactgcactccagcctgggtgacagagcaagaccctgtgtcaaaaaaaaaaaaaaaaaggaggccaggcacggcgtctcatacatggaatcccaggactttgggaggccaaggcaggtggatcacttgagatcaggagtttgagaccagcctggccaacatggtgaaaccctgtctctacaaaaaaataaaaataaaaaataagcctggtgtggtggtggatgcctgtaatcccagctactcgggagactgaggcaggagaatcacttgaacctgggaggcggaggttgcagggagccgagatggcgtcattgcactccagcctgggtgacagagcgagactctgcctcaaaaacaaaacaaaacaaaacaaaaaccaccaaaaaaaaaaaaaaaaaaggaaaacagcagagatgatgtgtgcagcatgctcagtccagcgtctaacacctagcagcagcagatggcaaataagagctgaagctgtcctgggctgtgggaccccatgcctgctcaccggggggccctccagcctggagaccccaaccagtcccatcctggccttgcgtatcagctccttacactgcataagaaactactgcatatgtggtggcttagagcaacacgcctgcctgagcttacagttctggaggtcatggtgcaatgacgtcctctgcccagggtctcccaggctgaaactgaaacgtgagccgcctgctgtctgacgcgaagcttccagttgtcgtccccagctcattcaggttcttcctgaattcacttccttgcagtcgtagggcgcagtccccctttccttgctggctgtcagtaataaacattcagtgcacaaatgaaaaaacccaccccaggccaggcgcggtgactcgcacctgtaatcccagcactttgggaggccgcggtgggtggattgcttgaggccaggagttcaagaccagcctgggcaacatggtgaaaccccgtctcgactaaaaaatacaaaagttagctggatgtggttgtgagcgcctgtaatcgcagttactcgggaggctgaggcaggagaatcacttgaacctgggaggcggaggttgcggtgagccgagatcacgccattgcactccagcctgggtgacagagcaagactccatctcaaaaaaaaaaaaaaaaaaaaaaaaagaacacacagcgctgcctcccatgagcctagccaaggcccgactgtgtacctgccacagggagctctttggaagggccgccctgcagccagccccagacaggaggcccagcagcactgggtacagaagcaccatttcttcccatctcagccctcggccctgatcagcctttcttattttatttttattttcttgagacagagtctcactttgtcccccagtctggagtgcaatggtgaaaccctagctcactgcaacctcaaactcctggcctcaagccatcctcccgcctcagcctcccggagtagctgagactacaggcttgtgcgaccacacccagcttaccttttaatttttttttttttttttgatggagtcttgctgtgtcgcccaggctagagtgcagtggcgtgatctcggctcactgcaacctccgcctcccaggttcaagcgattctcctgcctcagcctcctgagtagctgggattacaggtgcccaccaccatgccaggctaatttttttgttttttgtatttttagtagagacggggtttcaccatcttggccaggctggtctcgaactcctgacctcgtgatccacccacctcggcctcccaacctgctgggattacaggcgtgagccactgcccccggccttgatttttttacttagaggcagggtctcgctgtattgcccaggctggagtgcagtggtgccatcccagctcactgcaccctcattatgttctcctgaaattcggcttcgcttccccaagaacatttatttttatttttttattttagagacagggtctcactgtgttgccccaggctggctttgaactcctggcctcaagcaattctcctgactcagcctcccaaagtgctgggattacaggcacgagccaccgcacccaacctgatcagcctcttttaacagggtctgggggactcaggaccttccctgccgatggaggaaccctcggtagctcccgctccctcgcctctctggccgccaggcccaggagccgctcggtaaagtccctgtctctgccaggccgggtgcattcttgacattcctgtccttttacgcaggccgccccggccagctctcagaagcctccaccggctgcatgctctctccctgctggtgagaagatggccctggcggcggcggctcctggtcggtttatcgagccgggagtggcactttcccaactatgagaactatgcttggaattcagagccaccgccagcctctctgggtctcgctgtcacggcttcctgtgcagctggaaaacacctccaagagtggccgtggcatcacagacctaaaaaaggagctgggtttgctccggcaggtctccccgggaggagggaagccagtctgtcccgctgcccggcgggcctcgctgtctgctcggcagagacaggccaggcaggtttggacttctcgggatgctccagcctcagcgcccccagggtccccgcaaaatctccaaccaccccaggcctgctgtctgcttcttggctttacagcccaggacacctggattcagcccacccacccccgagcaggggcccacgcacccaccctctgcacaggctgggcacgccgtcgggctaagggtcccggcaagaatcagtcttagagcacaggccgagtgtggaggctccgtctgtaatcccagcactttgggaggctgaggcaggaggatcaccggaggccaggagatcaaaaccagcctggacaacatagtgagacccccatctctacaaaaaattaaaaaattaggggggcatggtggtgtgtgcctgtggtcccagctacttgggaggctggggcaggagaacggcttaggcccaggagttcaagttttcagtgaggtgggatcacactactgtactctagcctgggcaacagagtaagaccccttctcagagaagaaaaagaaagaaagagagagagagacggaaggaaggaaggagaaaagaaaagaaagaaattgagaaagaaacagagagagagagagagggagggaggagggaaggaagggagggagggagggagggagagccagagagaaagagaaagaaagaagaaagaaaaaaggaaggaaagagagagagaaggagggagggaggaaggaaggaaggcaggaaggagagggagagagaagaaagaaagagaaagagggagggagggaaggaggaaggaaggaaggagagggagagagaaagaagaagggagggaggcaggaaggagaaaggagaggtgtgagttcctgcgatggtgtgtatttagaatgcagaactttaggccactggatgagcaaggcctctaggttgttctccctaaaccctttggccaatgagacagggcagctgggggagggacgacacccagcctccagcacagaggtccattcagggctccactgggaccgtgtcaggtgtgtgtccatcccccattggatatcgtatgtgtctaaaattgagcttatggccgggcgcagtgtctcccgcctgtaatcccagcgctttgggaggccgaggcgggcagatcacctgagttcaggagttcgagaccagcctggccaacatggtgaaaccccgtctctactaaaaatacaaaaattagccaggcgtggtggcggacacctgtaatcccagctgctcgggaggctgaggcaggagaatcgcttgaatcaggaagcaaaggttgcagtgagccgagatcacgcctttgtactccagcctgggtgacaagagggaaacaccatccaaaaaaaaaaaaaaagttggtatatatgtttatttctcagtttgtgaaaatatccttaatttattgtcgtcacaaacaaatttcaattctgattactatgcaaggaaaaaacagaagataatctgctttgcaacgcagtttatagttcatttgtttacaggaacatgcaatatatgaaaaattactaactaaactacaagtattaaatacctaaattagttaacagtttattataatttatttaacaatctagggctgggtgccgtggctcacgcctgtaatcccagcactttgggaggccgaggtgggcagatcatgaggtcaggagatcgagaccatcctggctaacacggtgaaaccctgtctctactaaaaatacaaaaaaaaattagccgggcatggtggcgggcgcctgtaatcccagctactcgggaggttgaggcaggagaatggcttgaacccaggacgcagagtttgcagtgagctgagattgcgccactgcactccagcctgggagacagagtgagactccgtctcaaaaaaaaagaaaaaaaagaaaaatatatatatctaggaagtctgaagccatcagcacttccaatgcagtgaggaattcaggaatctcagtggagctgttagagtagtgaaccttgtaagtaaaatatatgcatgcctttctattgtgtttttttaaagacagggtcttgctctgttgcccaggctggagtgcagcggtgcaatcatagctcacttcagcttccaactcctgggctcaagcagtcttcctgcctcagcctcccgggtagctggaactacaggtgtgcaccaccatgccaggctaatttttttttttttttttttttgcagagacgggggtctcactatgttgcccaggctggtctcaaactcctggcctcaaatgatcctccagccttggcctcccaaagtggtaggatcacaggcatgagtcaccaccactgctgatggcctgacgcatgctttggatagcatcgtggagggatctctctaaaattgacctggtcggtttcattctcagcagactgacctgggccactcagcacggctttccttattcctgatgctcgtgtatgttctctttttacaataaagtcatcatcgtcagaagataccagtttaccatccatggcatcagggcctccgtagccactgcagcttttctcctctccattcattgttgttttgttttgttttgttttgttttgtttgagagagagtcttgctctgttgtccaggctggagggcagtggcgcaatcatagctcactacagcctccgccttccaggttcaagcaattctcccacctcagcctcctgagtagctgggactacaggcatgcaccaccacatccggctgatgtttgtattttttggtagagatggggtttcaccgtgttggccaggctggtctggaactcctgaccgcaagtgatctgcctgcctcggcctcccaaagtgcattcattatgttcttttgaaattctgtgtcgcttccctcaagacctttcataatttcttgtcagccctgcagtcactgtaaccgggtcccagcctaacaccacaacccccactccagggccagtttcccgcctccagcttcaccacaacccccactccagggccagtttcccgcctccagcttcctgtcccatcagaaccgtacactttgagcatgctcagtgtattatatgttgattacatttatatattatgaccctattctatattctatatcagatttattttattatagccaggtgccatggctcacgcttgcagccccagtgatttgggaggctgaggcaggaggatcgcttgagaccagcctgggcaacatagctgtagagacttcatctctacaaaaaataaaaaactagccaggcctagtggcatgcacctgtagtcccagctactcaggaggcccaggcaggaggatcgcttgagcccgggagttggaggctgcagtgagctatgattgcaccactgcactccagcctggacaacagagtgagaacctggctctaaaaatatgtatgtggccgggcgcggtggctcatgcttgtaatcccagcactttgggaggccgaggcgggcggatcacgaggtcaggagatggagaccatcctggctaacacggtgaaaccccgtctctactaaacaaaatacaaaaaattagccgggcgcggtggcgggcacctgtagtcccagctactcgggaggctgaggcaggagaatggcgtgaacccgggaggcggagcttgcagtgagcagagatcacaccactgcactccagcctgggcgacagagcgagactccgtctcaaaaaaaaaaaataaaaataaaaataaaaatatgtatgtatatatattttattatctgtataataaaatatacacatacacaaatggagtccgaccaggaagcacagactgtaccccaaggccaagagagcccctcccgagaacccagggtggcccagcctctgcacagaacccctagggtgtcgtggagcacaggggaaaccgctgtctagttctgaactttacagccgagaaagctgaggctcagggaagtccaggggacgtgctcagaaccaggtctccggcccaagaaagtcctccctgtcgggacctcgctgcaggcctcctgtgctctgtcacatatacgacccacacacgcttcagtgcggcagtgctcttgtctgcaagccagaaacacagatcttatatttcttgctccaagacaaacaaaacatcgattgttttaatctttcactttagttctgattaggaagaaaacatgtggcttcagtttcaaaaacagcaagctgaggcccttttcttttcttttcttttctttttttttttgagatggagtttcgctcctgttgcccaggctggagtgcaatggtgcaatctcggctcactgcaaccgccgcctcccaggttcaagcaattctcctgcctcagcctcctgagtagctgggactacaggcgcccgccaccacacccagctactgtttttgtatttttagtagagacgggatttcatcatgttggccaggctggtctcaaactcctgacctcgtgatccgcccacctcggcctcccaaagtgctgggattacgggtgggagccaccgcgcccggccttcttttctttttgagatatgtctcactctgttgcccggctgaagtacagtggtgtggtcacaactcaccgcagcctccaactcctggactcaagcgatcctcctgcctcagccatccaagtagctgagactataggcacacaccaccacacccagttaattttcttatttttgtacaggtggggtttcactctgttgctcgggctggtttcaaactcctgggctcaagtgaccctcccaccttggcctcccaaagcactggaattccaagcatgagccaccacacctggcccaggatttcaacatatgaacttgatggggtcagaggaggacacaaatatttagtctgcaacaaacagcccatatgactttccgagtgtaccgtgttctaggaattccgagtcaaggtcacctggtgctagaagccattaaaaaacatgtgttccaaaaagaaataacatttgaagcccgcatcataaagaaggaatatgtcacaggggaaagagatcttccagggttaaggtcgacatctgcaaagacaggcatagcccccgcttcaggccccaagcaaatgtctcttgaacatttatataccaggttctggggacaacaattcagatctttttttttttttttgagacaaggtcttactctgtcacccaggctggagtgcagtggcatgatctcggctcactgcaacctccacttcctgggctcaagcgattctcccacctcagcctcctgagtagctgggactacaggtgtgcaccaccacacccaactagttttttgtattttttttttttttttgtagagtcaaggttttgccatgttgcccaggctggtctcgaactcttgggctcaagtgatcctcctgcctcagcctcccaaagtgctgggactaccagcatgagccactgcacccagcccccagatctttggcctcatgaggctgacagtccagtaggcatacaactcaaatatcaaattataaatactacaagaaaagaaacagagggccatgagagaatgatgtggtgggctgaatgactggctccaagattgttgtaactgttaattttatgtgttaacttgactggtccatggggtgcacagatatctgtttaaatgttattctgtgtgtctgtgagaatgtttctggatgaaatgaaccataggctgtgtaaagcatattcctccccctccccaatgtgggggcctcatctaatcagttaaagccctcaatagaacaaaaatgctaagtaagagataattcctcctgcctggcagccttcaagctgacagataggtttttccagcctttggactccagtggaaacatctgctcttgggtctcaagcctgctggctttcagacagaaactatcagttctcgtgtctctctagcttgccaattgtacatcttatggcttctcagcctccataattatgtgagccaatttcttataataaatatcttctgggcaagccatctaccttctctgggtcttagtttcccagggacagccatctccctcatggccccctccaggatttccgaatctggaaaatgctgagctcatgaggccacagggtgagaaaggagatgatcctggagccatgcatcagagaaggcagttctttgatgggattggagctgggggaagaattcctagcagtgggaattgaacaataagccttgatttttgcacttgattttgtaaggaattggaagctgctggtggtttctgagtaggggaggaacagattcaactgcattttcagaagcgcactctagctgttaggagatggagggagtggggagtggagcggaggccactggtggagtacacggggatctgcctgaggctgcagagcactgctgaagtggacatccaaggaggggctggctggactgaagaaaagtctctggggacagctggcattgagtcttatcacactgacattggaccagtcacagcggatgaggatgtatatatattttttcagatgctgacttcattttgtgtgtgtgtagaattgcaaaattcaattaatgtcactagtaaactcctgaaataatatttataactcctatcactggaatcccgtgaccaaaattatataataaaaatcgtataataaaaatgtgaaggcagaagcatagaacatcttctgttgtgggttggttggaggtgaggactgagctgaaggctgatatgattcatgtgtgtttgttctaaggcttttgcagagtttttcacttcctgttgatctttccactggaattttagaattatcttatcaagctctttcctctctacaacatttttgttgtttttcacttcttcctgcattttctacctttcatctggaattatctttctctagttttaccttttaaaaggcaagtctgttggtgagaaagtctggttttgtttatctgaaaatgcccttatttccccctaattcttgaaggatattttcactgggtccacctaattgctgctgttttttcctctggcaacttttgtttgttgatttttgtttgtaattaactgattttatcaaagtccaattcaaatgcagtaagatgaacagatcttaaagatacagtttgatggattttagcaaatgtgtacacctgtgtacaccaacagctcaaccaacatagagaacatcgccatcaccctagaagttatttcatggccctttctagccaacaccctggccagaggcagcaacctctgttttcatttctatcaccatagttttgcctattcttgaactttatataaatggaattatataatatgcacctctaatatccagcttctgttgctttactttttttatttttgagaggcatttattttttaaatatttaatattaatatttaatatattaatattaattaaatactaatatttaatattgaataatgtattatcttttatttttttagaatacatttatatttttgagaatcatacacgttgcttgatctctcaatagtttattctttttttgtgtgcagccgtatttcattgtgtgaaatgccatggcttgtttattctctcgttgacaggcatttgggttgtttccaggttttgctgttatgagtaaaagcttatgaacatctcgtacaagtccttttatggagacatgtttttatttatcttgaataaatccctaggagtggaattgctgggtcataggtgaggtatgtgttcagccttataagaaactgctaagccattttccatggtggttgtactatttcacattcctgtcagtaatggatgatgcctccagttcttctacatcctcccaaatatttagtgttgtcagtcttttaaatttttgccactctagtggttgagaggcagtctctcttgatgactttaattcatatttccttcatgactaatcattagacaccatttcatgtgcttattggccatttctctgccactttttaggacatttcttttgcctgaggttctagggattctgaaatctgtggcttgaggtctttttatcagttttagaaagttattggtcattatctcttcaaagattgttcctgcttcattctctctctcctccttctggtgttccaataacacgtatattagacgtcactgcatcttctatgtcttttgctctttcttctgtagtttctttccctttgtgtcgtcttgcttcattctggatatttttctctgttctgtcttccagttcactaatttttatttcttccattgaattcttacttttcagatattgtcattttctccatatccactggttcctttttttccccattgttccaatttgcagcgaaaattccaatctcatctttttatctctttgaacgtaattaacacaattaatttaaagtctctgtcaattcccagtatatggaaaccctgtgggtctctttgtagtgctggtttttgtttttttttttgtttttttttttgagacggagtctcgttcttttgcccaggctgcagtgcagtggcgtgatctcagctcactgcaagctccgcctcccgggttcatgccattctcctgcttcagcctcccaagtagctgggactagaggcgcctgccatggcgcccggctaattttttgtgtttttagtagagacggggtttcaccgtgtcagccaggatggtcttgatctcctgacctcatgatccgcctgcctaggcctcccaaagtgctgggattacaggcgtgagccaccgcacctggcagtgctggttatttctgctgatttttgtttatgtggtcctggctcctcgtatgtcttacttgcatgccagatattgtattgtgcatttttttttttttttgggacggagtctcgctctgttacccaggctggagtgcagtggcacgatctcggttcactgcaagctccacctcccgggttcatgccactctcctgcctcagcctccggagtagctgggactacaggtgcctgccaccaagcctggctaattttttgtatttttagtagagacggggtttcaccatgttagccaggatggtcttgatctcctgacctcgtgagccaccgcgcccggcctgtattgcggatttgcatgtagaaataatctgaggcctgggatcgtattattttcctccagaggggatttatgtttacttcttccaggcatttggggccaccagcaatctcgcatcaccttaatccaatattagggattgagattattcaaaactctgctgtagttgctagaaggacctgtctgcttcctcttgatctttactcctttttttttttttttttttttttttgagacggaatctcactcagctgccaaagctggaatacagtggcacgatctcggttcactgcaaccaccgtctcccggattcaagggattctctcatctcagctcctgactagctgggattacaagaacccgccatcatgcccagctaatttttgtattttagtagagacggggtttcaccatgttgaccaggctagtcttgaactcccgacctcaggtcatccacctgcctcggtctcccaaagtgctgggattccaggcgtgagccactgtgcccagctgtgaccgttactcttacagtgcaatattaagttgtcccaattcacaccaagggggaatttaccaagccttctctcctcaggaaaccctggacctcaatttctgtacccttggcctcgtgaagctgatagaaatatcactcggcctctcagcaaaccctcccaaccccaggaaaaagtgaccccaaacccaggctctctttcgatcctcccctaaatcctggctggaaattctccattatcttaataaccctgcaggcccttgagcagatgctttgacattctgtccagcttttctttcttttttgagacagggtctcactctgtcacccaggctggagtgcagtggcacaacgtcagctcactgcaacctctgcctcccgggtttaagtgattgttgtacctcagcctcctgagtagctgggactacaggcacccgccaccacgtccagctaatttttgtattttaatagagacggggtttcaccatgttggccaggctggtctcaaactcccgacttcaagtgatcctcccacctcagcctcccaaagtgctgggattacaggcttgagccaccgcacccagccctgtccagcttttttttcttttttttgagacagggtctctctctgtcgcccaggctggagtgcagtggcacaatctcagctcactgcaaccactgcctcccgggtttaagtgattcttgtgcctcagcctcccaagtagctgggactacaggcacgtgccaccatgcccagctaatttttgtatttttagcagagatggggtttcaccatgttggccaggctggtctcaaactcccgacctcaagtgatcctcccgcctcgacctcccacagtgctgggatcacaggcgtgagccgccgcacccggccctgtccagcttttctagtggacctcagcaagagagtgggtttgtccttagctgctaatccaccattgtgcaagccaaaatctgccaagagagatttttaacccaaagtccaagtcgtttagaaggaggtcatggatattctagatcctcttgatcttggagccacaggatgacaaatggggacccatcctcagccttgagaggagccctctcatcttccagctgaggaagccaagacccaaaaaccaggagcagagccagagtgcgagcccggattttccatttccaggcaggcaccgtgtggtccctcttcaggagcaggtgtcagcccttatcccttgaacaagatccctggcaatgacctcacctctccctgaaacctgaatgttctgtcagttcagcaagaggctgatgcaactcacagtccccagaggcccttttgtctctcatcgagtccataaatgacacggaaatgatctaagcatgactggtcaccctggacttctggaactcatcacggagcttacaagactctcctctcacctttaccctatggctcagaagaagaagggatttgcccaagctcatgctttaagttcaacaacacaaaaatgggccgggcgtggtggctcacgcctgtcatcccagcactttgggaggcccaggcaggtggatcacctgaggtcaggagttcgagaccagcctggccaacatggcaaaaccctgtctccactaaaaatacaaaaattagccgggcgtggtggcgcatgcttgtaatcccagctactccgggaggctgaggcaagagaatcgcttgaacctgggaggcggaggttgcagtgagccgagttggtgccactgcactccagcctgggcgacagagtgagccatcatctccaaaaaacaaacaaacaaacaaaaaaacccaccaacacaaaaatgggtaatttcaggacacccagtttgtggctctatcccgaatccgatccatgctgatttttaatctgatcagcttccagctctgcccaggtctctccagggccggcggtggggggctgttgcaattccctgctgcaccccagcctcagggcaggtcaggggagtggcgacagggtgcaagtccacggggagtgagatttctcaagagctccgggcaaaccggcccttccacattcgctgggtgcaggatgttccagccaccttgtctttccagcagctgtgtttatatttggcagttgccacaggtccctggaagagggtcctcttcctgcctgccagactctggaacccctgtttcctcacacaggaacctgggggccaggcctggtgcagagatgagagtgtccctctgagaattccaacagaggtcactggggctcagagagggaaggaaactttcccaaggccacacagcttggtagagcaagggcagatttctggcctaccaccttcccgagttccctcctctgtgggagctgtggtctcactcccttcaaatgcaacggggctcacatctgggggaagactcccgccctgtggggcctctcctagtcacaaagcattctgggatgctaataaaattaaagcccttttggaaacacccctgtatttacttttttttttttttttgagaccattctcctgcctcagcctcctgagtagctgggactacaggtgcccgccgccatgcccggctaatttttttgtatttttttttttttttagtagagacagggtttcaccgtgttagccaggatggtctgtatctcctggcctcgtgatctgcccgcctcggcctcccaaagtgctgggattacaggcgtgagccactgagccaggcctttttttttttttttttttttagacagggtctcactctgtcacccaggccggagtgcagtggcgcgatcttggctcactgcaacctccacctcctgggttcaagcgattcttgtgcctcagcctcctgagtagctagaattacaggcacgcactaccatgcctggctcatttttttgtatttttagcagacgtgggggtttcaccatgttggccaggctggtcttgaactcctgacctcaaatgacccacccgcctcaacctcccaaagttctgggattacaggcatgagccaccacgcctagcatattttcattcagtaccatttatttttggggccttcagtcagctgggttcaaactctttgcgttttgcctaagggaaccactctgagctgcaggatttctcctgataagggagttccataaaggcctaaaattttcccccaggggacacctgtccaagtctggggacatttgtgctggtcatgactgtgggcgcactggtgggggggggggtttcctggcaaggagtgggtggagaccagggatgctgcccagcaccctgcagtgcccaggacagccccaccccagaaaaggatccagccagagggagagggcctgtactggagtgagttaaacttcccggtgtagatcaggtctctttaggattttaggaacttcggagttcagcccattttgcagactggggccctaggctgtgtctctctttactgacaccactgtcaattttgtcgcagttttgggtctttgtctgctcagccatctgctcagcaaacgtttaggccacacctcctcacctcctctcctcctcccagtggggacaggttcgagggcgggggcacagctccagaggggcgatgcctccaggcaggaacccaggcccccttcctggagggatgcgcgacaccaaaactccctctgcacccccagatgagggccggtgggagtggtgccgtctgagtgagacacagcattgggctgacctcagggtcccggttctgatagtgtctcatagtcacaggtgacgtcgccctggaggggaccgggagagggtgcgtggggctccctggactatgtttgcaactgcctgagtccataattgtttcaaaataaaaagttaagatagggccgggagcagtggctcacgcctgtaatcccagcactttgggaggctgaggcgggtggatcactaggtcaggagtttgagaccagcctgaccaacatggtgaaaccccgtctctactaaaaatacaaaaattagcccggtgtggtggcgcgcgcctgtagtcccagctactcgggaggctgaggcaggagaatggcatgaactcaggaggtggaggttgcagtgagccgagattgtgccactgcactccagcctgggcgacagagcgagactccctctcaaaaaaaaaaagttaagataaacaatattcaataaacctataacagattctataactatataatacatatatacagatataaaatagtaatctaaatatattataaatacaaatataaaatcaatagcaaacaatgtaaatgtcaaaatagaaatcaaactatataattaataatgtataaattatgtaaatgatgaataaatataaaatatgtatgcaataagtgtataatacatactaaatactaaaactatatattagtaatacaaaactgatatgaatatatagtgaatgaatcttcaaatatgtaataaatgcatgataaatgacataaatataaatatgagtataaatataaatatatgagtaaacaaatatataataaaatatataaatatgtaataaatgtataatactatagtataatatagtataagtttatattataaactaatagtagaccaggcgcggtggctcacgcctgtaatcccagcactttgggaggtcgaggcgggtggatcacctgaggtcaggcgtttgagaccagcctggccaacatggggaaaccccgtctctattaaaaatacaaaaattggccaggcgcagtggctcacgcctttaatcccagcactctgggaggccgaggcaggcggatcacaagatcaggagatcgagaccatcctggctaacacggtgaaaccccgtatctactaaaaatataaaaaattagccaggcgtggtggcgggcgcctgtagtctcagctacttgggaagctgaagcaggagaatggcgtgaaccctggaggaggaggttgcagtgagccaagatcgcgccactgcactccagcctcggagacagagccagactctgtctcaaaaaaaaaaaaaaaaattggcgtggaggcaggcacctgtaatcccagccactcgggaggctgaggcaagagaatcgcttgaacccggaaggcggaggttgcagtgagctgagatcgcgccaccgcacttcagcctgggcgacagagcgagactccgactcaaaaaaaaaagaggcagagcacttgctttcattctaacttttcactcttacacataacgcaattataaacgcctttctatatgtagatttttatttcttttcattttttgccctcgggataactgccggagcaaggggttagagggcggctgctccctgggggtccctgtggtcccacctccctccctgccggtgctgccagctcctgtcctgcggttttgttcagcccttctgtgcactggagcctcgtgtctgatcagctcaggtctgctctgtttcggggctggtcacccttccctgagcgaccacagatttccactatgtcctggagtgggggggtaccctcatccttcttgactttcaggcgcgagtgggatttttctgcacgaggcgggcttagactcgggtgtggctatgagccttttgctaggaggccagcgcggggccgggcggcgtccctcttcagttttatttttggagagcctggcctggagccttgcctgcctgcaggagcctgtgcaccgaggcagagcccgaccgtcaggagggagccgtggggactgtgtgcacctttgaccacctggccctgcccccggagctgcctgctcccgcccctcccacagcttccccgggccacgggccccgaggcaagctcattcaggtcggggtgcccggcacccgtgcgcctctgcagggaggcagttgggaggggcgttcctggctgactcagtgcgtggccagttctgctgctgttggcttagtcctctgctgggggcatggctgctcctgagtcagtgccggctggtgacaccaccgagacggggacttagggaggcgactgcatgggtgatgcaatctgtgtctgagtctcggcatctcagcccaagcatccacatgcactcccgtgcgcacacacacgcacacgcatgtacacatgcagacacatgtacacacccacgcacgcacatatccacgcacctacagtgacgtacacacacgccaacacgcatgcacacacccatagtgacatgcatgcccacacacgtgtgcgcacacgcacatgcagtgccgtgtccacacacgtgcacatacacacgtgcacactggcatgcatgtccacacacatgcacgtatgcaaatgcacctatgcacacactcatatgcagacgcacacacgtagatgtgtacatgcactcatatagacacatgcacatgtacacacatgcaaggatgcacactcatatgcatgctgacgtgcacacccatgcatatgcaggtacacatacacatgcagatatgtgtgcacacacgcatatatgcacactcatgaatgccagtatacacatacacacatacatgcacacgcaaggtacacatacatgcacatgtgcacacacatacacatgtgcacactgacatgcacaccacgtgtacacacgtgtacagtcacatgtgcatcattgacatacatgcaaataaacatagacacacacacacagcgcagtcctctctggccttcctggcaggcctgggttattacccagcccaaaggcagcatctcgcagggaatttcgcccaaaacagaaaagccagcacggctcaggacctgatgctcacatggaaattgcgggcggtggctgcccagggcagcaggggcccagggtctgggtggacactcctgactgtggatgctaaataggaccccctggccttccaaggaaaacaggaggtgcggccagcccgtttgttctctgcgtgcacgtatttttagcactgagtaatttaggtatttttaagcccaaccaagggcggttttccctgagttggatgttttgtggctgctttgaagctctctggaatcagagccctctgagcggccacacgtgggctctgcctccagagcagacagattgggccttctctgcccccaaaaagtgggggtgggacgtctgctggaaaccaaggaggctgggcggtgtcaaagggattttttgtttaattgccccttttattgagatcgccgtggagtcacagccagtgctaacaaagaatgtagaggaattctgtgtgtcattccccggccgtccctggtggtaacatttggtaaagctatgggcaggatcgcagccagacagtcacacacccaccagcctcactcaggttccacagtattcagtattgtgcccgctggtgtgtgagtgtgtgaggctctctgtgagtttatcactcatgtaggcttgtggattcatcaccgtagttgaggcactaacagggatcattcgtgttgcccttttattatttattcagagatggggtctcactaaattgcccagtctggcctcaacctcccaggctcaagtgatcctcccacctcagcctcccaagtagctgggaccacaggagtgcgctacccatgcccagctaattttctaattttttgtagagagggggtcttgctatgttgcctaggctggcctcaaactcctggactcaagtgatcctcgcatctcagcctcccaaagtgctggtattacaggcaagagccaccatgcctggctgtgttgcccttttatacagagacctatctccctcccagcccctgcccctccctgatccctggcagccgctaatctgttctccatttctaaaatttcgtccttgggccgggcatggtggctcatgcctgtaatcccagcactttgggaggtcgagacaggcagatcacttgaggccaggagtttgagaccagcctggccaacatggtaaaaccatgtctctaccaaaaatacaaagattagccaggcatggtggcacatgcacctgtaatcccagctactcaggaggcagaagtgagagtatcgctggagctggagaagcggagcttgcagtgagctgagatcatgccactgcactccagcctgggcaacagagcgagactctgtctaaaaaaagtcctcttaaacacattacacaaacagaagcatgctacacatcccaggccctggagattcccctgcggtgtggtatgcatggatggtcctttccttcttttttttttttttttttttttttttttgagacagagtctcactctgtcccccaggctggagtgcagtggcgtgatctctgctcactgcaagctccgccttccgggttcaccccattctcctgcctcagcctcccgagtagctgggactacaggcacccgccaccacgcccgggagacggggtttcaccgtgttagccaggatggtcttgatctcctgaccttgtgacccgcccgcctcggcctcccaaagtgctgggattacaggcgtgagccaccgcgcccggccagtcctttccttcttatcactaagtaggcattttttgagaactctggaatctgccttgacttctctgcggctgcctggctctgcaaaacagacagcgatgccatgagttatgacagagacagggtgcggcttaattaactgctcacagacgcccggctgggactgcggctgcccaggactcttgaacctggcccctgcccctgccacccccatcagcaccaaccccctcactgggtcctacgaagcaggtttctctaggctggacactactgacacgtggggctggatcgttccctggagcggggccgtcctgggcactgcagggtgctgagcagcatccgtggcctccacccactccctgccaggagcacccccaagtcatgacagccacaaatgtcccagacatcacccagtgctccatggagggcagagtcatccccagatgagatctggggattccacggactcccaagagactctgcgtcctgtgatcgtctgccctgttgaggtcctgggtttttccaggagaattcaagaagcaacagcatgggctcctgactggttcaatatgaaggacacggaggagaggccgggctcacacctgtcatcccagcactttgagaggccgaggagggtggatcacctgaggtcaggagttcaagaccagcctggccaacatggtgaaacgctgtctgtactaaaaatacaaaaattagccgggtgtggtggcacgtgcctgtaatcccagctactcgggaggctgaggcaggagaatcgcttgaacccgggaggcagaggttgcagtgagccgagatcacaccactgcactccagcctgggcaacagagcaagactctgtctcaaaaaaaaaaaaaaaaaaacacggagggggacagtcaccaggggttctgctgtgatccctgccctgacccagggtctcccctgggtactatggatatcgcgttcggatccttccctggcgtggggccgtccggggcactgcagggagctgagcaatgtccctggcctccacccaacccactccatgccaggagcaccccccacagccacagatgtccccagatatcacccagtgtcccctggagggcaagaacccctgccatggactgaggcaggccacccgggagcctgcgtgggtcctcccttctccagagggcctggcctattgcctttgccctttctttattttttctttatttttttttttgagacggagtcttgctctgtcgtccaggctggagtgcaggggcaccatctcggctcactgcaagctccacctcccgggttcacgtcattctcctgcctcagcctccagagtagctgggactataggcacccaccaccatgcctggctaatttttgtatttttttttttttttttagtaacgatgaggtttcaccgtgttagccaggatggtctcgatctcctgacctcatgatccacctgcctcagcctcccaaagtgctgggattacaggcgtgagccaccacgcccagcctgccttcgccctttcattctctcgttctgcaaactcccacagaggattgtgacggctgaccgcgtgccaggctctatgctgagagttaaacgagtgccagctctttgtacacggaggcccctggtccccacccagaggcaaagtggccgtgcctagagtcgggaaggttgagccaaggccgggcgcccctgctgccacccagaggcctgacctgaactttgacccacacccctctgcttcccccacagctctctgaacaacggggcccagagctgatggcagacaatgtcagccactaacaacatagcccaggcccggaagctggtggaacagctacgcatagaagccgggattgagcgcatcaaggtgagcccagcgggcatcaggaagaggaggggagagacccttgggggccccgcaaatgatgaacaggaggctcggcaggagggcagaggcttgcaccccaactgtgtctcttgctgtgtgaccttgaggccctcccttaacctctctgagcctccatttcctcggcagaaagaggcagctgatctaacacctatctcctgccttcgtgcagcaatgtaacgtgctttgtaaacacactggggccccgtggagacggtcatcgtgacagagcgctttgtcgtcctcatctgcattgatctgtccagctccttggcaatgacagatgcaaattaaactgagagacacagtcccaggcgggaggagactgcatgtcgtatctacttttcacttctgtgttgtttgaaggatttgtttgttttgtttgtttgagacggagtcttgctctgtcacccaggctggagtgcagtggcgcgatctcggctcactgcaacctctgcctcccgggttcaagcaattcttctgcctcaacctcccaaatagctgggattacaggcatgcaccaccatgcctggctaattttttgtatttttagtagagacggcgtttcgccatgttgcccaggctggtcttgaactcctaacttcaggtgatccgcctgcctcggcctcccaaagtcctgggattccaggcgtgagccaccatgcctggcccgtttgaagttttttacaaggatcacacttgaggctgcgccttgtcgagatttattttaaggcaagctctgaaatctgcagtgtaggccagcaggctggagacccagggaagagttggtgctgcagctggaaccccaaggccacctggaggcagagttccctcctcctggaaggaccccaggctttttctcttaagcccttcaactgattagatgaggcccatctgcattacagacggtcacctgctgtgcttgaagtctacggatttaaatgtgaatcacatcaaaaaaaaaaaaaaaattttgcatgtgaggcacagtggctcacagctgtaatcccagcacattgggaggccgaggcaggaggatcacttgaggtcaggcgttcaattccagcctgggcaacaacatagcaagaccccatctctacaaaataaaaaacaggctgagcgcggtgactcacacttataattccagcactttgggaagctgaggtgggcagatcacctgaggtcaggggttcgagaccagcctggccaacatggtgaaaccccgtctctcctaaaaatacaaaaaaaagattacccgggtatggtggtgcatgcctgtaatcccagctatttgggaggctgaggcaggagaatcacttgaacctgggaggtggaggttgcagtgagccgagatcgcaccattgcactccagcctggggaacagagcgagactctatctcaaaaaaaaaaaaaaaaaaaaaagaaacaagaaaaaaacaaccttcacagcaacatctaaaaaaacatttaactggccaggcacggtgactcacgcctggaatcgcagcactttgggaggctgaggtgggcggatcacaaggtcaggagttcgagaccagcctggccaatatggtgaaaccccatctctactaaaattacaaaaaaattagccaggcgtggtggcaggctcctatagtcccagctacttgggagactgagtcaggagaatagcttgaacccgagaggcagaggttgcagtgagctgagattgcgccactgccctccaaccccaagcgacagggtgagactccatctcagaaaaaaaacaaaaacaaaaaaacatttaaccaaaccctggggcaccatggcccgccctagtgcacccataaaatcagccatcaccccacgtatccactcagaactcagctctccagcacctgtcaccagcttgtcattattggccacgggaatttattaggaaggggtgaccggcccttgctttgctcccagcggggaggcggacagagtcgtccctgctggccaggtggcacaggtggttctgatcggccggtgagtctccctccagcgcagctctgagccctcccagaccccatcacgctgctgctggccgggatccaaccagtaggggaggggtctgcctcccacgaggtgtctgaatgttccagcaatctgactgctgaggacagacctgagcattcaaagcattccttcgggctgaaaagagagaaagccctggttgaagtggttttccttttacgagtgggtgccagcccccagcccgggcggagggcggtgactcatcctgccctgtttgatgttgaggaggggcccccaccgcccctttgaatgtcgggcctcggggggagccaggatttgacccgtccccactcccagtcccgcctgaggttttacatccccagctccaacgcggcgaccagaaccacagaacctcaacggcgacgatcttggggctcaccagcccagcgcagtgggcatggggggtggtgccaaggtgccacgtgctggagccacaatgccagctattttcggggtctggaggctatttctgtcgtccaggagggccgcttcccaaatagaagtctagaaagcaggccaggtccgagtcatcacaggccgcagccggcgggctcactctgtgggcatgagcgtcccccggctgcccagctgggcaagaccccaaagctgtcccacaggctcctggccgtttgaagggcccaggtcccaggtatccttggggtccaaaggaggacagaggatctgggatgcagaggtactggccaggcgaggcggctcatgcctgtaaccccagcactttcagaggtctaggcgggagggtcgcctgagcctaggagttcgagaccagcctgagcaacatagtgagacctcatctgtaccagaaaattattctaaaaattatggccaggccaggcacggtggctcatgcctgtaatcccagcactttggcaggctgaggtgggcgggccacctgaggtcaggagattgagaccagcctggccaacatggtgaaaccccgtctctactaaaaatacaaaaattaccctggcgtggtggcgtgcgcctggagtcccagccacttgggaggctgaggtgggagaattgcttggacccagggggcggaggttgcagtgagccgagatcacgccactgcactccagcctggctgacagagtgagactctgtctcaaaaaaataaataaataataaaaatgaaaattatggccaggtgtagtggctcactcccgtagtcccagctactcaggtactcccagctgaggcgggagaatcacttgagcccaggaggtggaggctgcattgagctatgatagcaccactgcattccagcctgggggacagagcgagaccctgtctcaaaaacagataacaaaggcacctccgtgaagcgacactgcgatccttctcggatcatcccctcacctctgccacatctaatcctccccctgtgatcgccctctcgccttccaggaaagaaagcaaggagagaaaggtcgctgagtcccacagagacacagttaccggttacgggatgagatccagggccagatggacgtgtccccgtgtagcctgacccaggacaccggacaccccagccccagccctgctggggtgagctaagcggggagtggcagcggcacccccaaaggcatggccaggagagacgggcgtgtagcctggggcgggctggcagcagcccggggcagggggtccctcctgtgaccggaagcatcagcccctcagagggttggagtcatcagggggttcaggctgcaagagaaacatggagacgggcttatctcgtcctcaccgggcccagccccctggccgggtgtcaccgtgaaacctccctcaagctcatcaaatgtgcaggcagcgttttcctatcaggaccttccttccttggggtgagaatgaggtcttggactccgaaaacggggtccatctgtccctgaccctttgtgttcaaaatctggcaacgcttgctgaaggaagctcagccttttcttttttaaaaaaatattttttaggccaggtgccgtggctcacgcctgtaatcccagcactttgggaggctaaggcaggtggatcacttgaagttaggagtttgagaccagcctggccaacatgctgaaacccgtctctactaaaaatacaaaaattagctgggcgtggtggcaggcacctgtagtcccagctactcaggaggctgaggcaggagaattgcttgaacccggggagcaagagattgcagtgatcacaccactgcatttttctttttttaattttgggaaaagacacacataaatttatttatttgtttatttatcttaattgagacagggtcttgctccatcccccaggctggagtgcaatggtgtaatcttgactcactgcagccttaacctcccaggctcaagcaatcctccagcctcagccccccagttagctgggactacagatgcccacatcactatgcctggctcatttttgtattttttgtagagatagggcctcactgtgttgcctaggctggtctcaaactcctgggctcaagtgatcctcccgcctccgcctcccaacatgttgggattacaggtgtgagccaccgcacctggccaagacacatataaagtttaccactagtgatatttaatatagtcacaatgctgtgcatccaatcacgtttattccaggacattccatcaccccaaaaggaaaccctgtcccccatcagccatcactccccagcaccggcacccacgcatccccttcctgtctctgtggataggcctgtcctggacatttcatagaaatgggatcacacggccgggcgcagtggctcacacctgtaatcccagcactgtgggaggctgaggcaggcatatcgcgaggtcaggagttcgagaccagcctgatcaacatggtgaaaccctgtctctactaaaaatacaaaaattagctgggtgtggtggtgcatgaaggtaatcccagctactcgggaggctgaggcaggagaatcacttgaacccgcgaggtggaggttgcagtgagccgagatcgtgccactgcactagagcctgggcgacaaatagagtctctgtctcaaaaaaaaaaaagaaagaaatgggatcacacactgtgtggccttctgtgtctggcatctctcactgagcatgaggcccttgagatgcatccacgttgtggcctatgtcagagcctcactccttttcatggctgagtaatattccagcgtgtggacgggccgcactgtttgcccacgcccccatcaatgggctcctgagctgtttccgcctgtggctcttgggaatggtgctgctgtgaacccgggtgtgccagcctcttcttatgtctcctctgtctcctccttgtgctcaaacacaggtctccaaagcggcgtctgacctcatgagctactgtgagcaacatgcccggaacgaccccctgctggtcggagtccctgcctcggagaacccctttaaggacaagaaaccttgtattattttataactgtgttctcatatgttctctctctctctctctctttctctctctctctctctgtctctgtctctgtctcaggcagggcatcattcagtaattagctcaaacaaaacatctcaagtccccaaaacctttaattccaaaagaaatcccccctctccccgccaaaaaaggcgttcccaccgcccggatggggtagaatggaccttgtaggtggagatgaattttcaggtccgaccccatggccctctcagtttgggccaaaagggatggaggctttacggccacttcccgttcggaataactgaaatcccccagcgatggggtaacaattttttaaaactctcgattgccgtttcaattgtggaccggcgccgagggggaaagggaggtgacttcgcccggtggcaatagttccgggagaattggccattggtaaaaagacttcatagggtcactggaatgctttgtgttgtttttaagtagaggtaaaattgagatggggggcgggaggtgacatcatgaagttttttggaaatatctctttatttaaaaaattgttactccatacggctaaactcggattgtgatggttgaacccgtcgctaaactgcacgatcctgcaatgaatgcacgatggagtgtgggggtctggagggggcttcgtctatgaaaagttgccaagtgtgactcccctgcatgatgttagccatgggtcctttctgcagggtcccctctgtgccagaaatgggttttcgggacttgccccagggaagccgtcaccggcccggcccatcatgtttttggattttttttttttttctttttttgagatggagtttcattcttgttacccaggctggagtgcagctgcatgatttcagctcaccgcaacctctgcctccccggttcaagcgattctcctgcctcagcctcccgagtagctgagactacaggcgtgtgccactacgcccggctaattgttgtatttttagtagagacggggtttcaccgtattggccaggccgctctcaaactcctgacctcgggatccgcccacctcggcctcccaaagtgctgggattacaggcatgagccaccgcgcccagtgtgttttaagcatgaggcatccgcgtggctgggagaggctttgaccatccttggctcttccaggttgtcctaccctctggcatccaccatagacgtttttcaaacagaaaatgcaggctggggagccgcggcagggcgggtggggctaccctgtgctgctgtgtgtacaaaattgttccatgatcttggagtgactctgaaggactctgggaggtgagacgttgtcccggagatcaaaacgtccgctcaaaacgttaccctgtcgctcgaacccgatctttttgcttttccacccccgtgcaacccaggacggctgtctgaggccgggagatgccttagacgcaggatgggccactcctcccagcggcaagtggaaatcgaagatgtcatggggtcggggggaggcttctgaaagatgactgcgtcctcctctgcggcacggacgggagcaggtgcagccacatcttccagggcctgccggcatcacctgcggccacacctgagatggaccccacgcagccctgatcgcaggaggcctggccgccccgaccccctccacggggctggcctagaagcaagtagtagaataaaactagcctagtcctgtccctccggccccagtggagacaggcgtctaagaacccgtgccgagagggttcctggacggccgcccaggtcctccgtgcaggcccgtgaggcggggatccctgcttggctcacttcctgagctggtgactgccagggttcccacctcgccaaggctagagggctccgggtgtgtgtgcaggtgtcgggggagtgacctccactcctcaacctcgggcagctcccacaggccacagccgggctccccacccccggcacccagctctctacggcaggtccgggagggctggggcttcggggagccctacccgccaaacctgctgttggcccgggagagccccagaggctcccggagactgcagcctcctgtggttgggctgggagccggcagggtttggggtgtgggcgtccccaccacgcatagcaggaatggcaggaagggacaaaagcctgttccagagaccctgggaggaccccaggcagggagagcccgcctgcctccaccctttccaacaagccatcttggtaactgggaacaaacacaccccaccccgtttttccttaaaagaggccttaatccccgagcccccgctgccagggcagagggaggagggggcacagctgtgccaagcccggccccactggtgtgtcctcacaatgtgaccccagaaatgccagcagggaacggaggctgctgcagagacgcagccccaggcagccggggctcctaggctggtgcagatggtggggttaaacgggctgagcgttccaggtaaactgaggctcggggaggggaaggacaggctggcctctccttcactgtccacagggccttgggttccctgagctgtccagaccccaccatctcccggaccccagggaggtggccattgccagaagcctgtgggtttctttctagcttgggggattaaaaaaaaaattctccacttttttttttcttgagtagacttcagtgaccacactgtggaaaatacctttgcagacgtggcacccgagtgcacacaccgaccgccacatgtgcttttctgccgggaatccctggggtgaacgcatgttttatgggcgtttccaggagcgcgcgtgcacctccagacggggagctggcgggcgggggtggcagcagcagctctagccttggggggacaagcctctctcagctacgccaggggaaaagagagttaaggacactcacccccacccacgcacacacacaaggcagcgtcgggtgggagagagaaggccgtttctccttctgtagcctgggtctcccacgggccttccccgctgctgagcgagacaccagtagccaggtgaagggccacagcgggccaggccccgaccctgttgtgacccacctgggcaccttcccggaccagctccgcctcccctgccctcctctctccaggaaggagccagaaccctcacccctctcccaccctccccaggggtaaccccaggccaagcacagatagctcagctgcgacctctggcctctggggacataaacggggcggctgggccagggcggaaggtgctcctgtttccctccttctgcgtggtccctttgacgggccggccaccgtgtccgaggcgcaacgctaggcctccaggccacgcatccatctccaagttaacagcccgtcctgcccaagttctggggcaggtaggagagggccgtcacacacctgtccgcccgtgagtgacccgggggggcttccgggtggaggtggagccaccacgcccttcctcaaggggtcacttattaaaaagtccacggcctgaggccaggccctctgcacagaagccatatgccggccagccgcgcctcctcctctgtccacggaaccgctgcccatctaaccttcgtaaagacctgtctcctgtttccagccgccgcctgtggttctagcaggttctatgccatctgcattgggatgtctggttgtttttatttctgacttttttaaaattccaggtgtgccgcacccactttctcgcagtgttttaatattgtgtggagttgtcgataccacgtgaattcatacacaataaaaagcctcactctccctttt

SEQ ID NO: 712 - DNA, 15975 bp, Homo sapiens
cgggacggccgcgggaaaaggcgcgcggaaggggtcctgccaccgcgccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagaggtgacgccgcgggcccctgcgggacgggtggcgggaaggagggaggcgcggctggggagagcgctcgggagctgccgggcgctgcggaccccgtttagtcctaacctcaatcctgcgagggaggggacgcatcgtcctcctcgccttacagacgccgaaacggagggtcccattagggacgtgactggcgcgggcaacacacacagcagcgacagccgggaggtaagccgcgtcccagcggctccgcggccgggctcgcagtcgccccagtgatgccgtggcccccgaggcgggcgtcatcgggcagcgtttgcccagtgctggagggttagggagagctgcctgggcttgaccgcgcgccggtctcaaagtcctggctttggcccctcctccgttttcccctgtggaccattccgcttcgcagcgttttcaaaaactggagcgaaagtgatgtgggcggggcaaaggcggcgggaagaggagagcactgaagctggcgcgggaacttggtttcctggtggcctcccatccaatccccacgaaccagctttcctcttaaaccttgaaaagagaaattcgggagttcgagtataagttcttagtcgtcctttcctctttcctttccgacaggagcaccccaggcaaaaaatgtctcgcgggtcattggcgccaggctttcaggggacagtggggcggggcggggtgggcacaggacgttaggcagccgttggccctccctaaggccacaccgtcctgccgtcctggatcctgcgccagctgcgcgggggaggggactcgaaggtgtgtgagccaggggctgaccttgaccgctcagataaatggagcgcagccttgacacaggggtggaggtggttttgaatggggaaacccattcgtggtgaagcagattcactgtagctagcggaaaagccctccggcccacggacccatctagagacgaatacatagcagctgctgtggctgattggcgtgggacagcgtggggagttttgtctgaggagagggatccacttttctgcagctccaagcccaggggcctttgatgagccatagacctcatttttaacccacctttctgcttagacattgagcaagttacttctcatatagcttccctatatgttaaaaatggagaaaataatgcttagtaggcaattctgataaaagcaggtgcttgcaaaaatctctctgttgtctgaatataaactgtaccacaagcgagtgcggatgaacgaggactgcatttaaagataagtttttacactttcatttctctgtggctcgacacttctgatgcctccctttttgttcctgggacacatgcttggtgttgtcttcacacctttgtgacaggattagcactagtgggcagtggatgatagctcctcccttttgccacatgttcatccctgccctcgccaccatctcactgtgtggaattcctgtgtccactggtcaccggggcacagaagtgctgtctcagcctgaatcgggccactgatgggacttgcagcctgggagctccaccgtgatctctggcccactttgcgggagtctaggctttctggatgctccagggcctcacgtcccagggcagttttcttccctgaagaaagttggatggcatgatctgtcttcccatcttgaaaccgtatggcaaattgtttttcagatgaattccctctgctgacaaccaaacgtgtgttctggaagggtgttttggaggagttgctgtggtttatcaaggtaaagaagtcgctgctattagaagtcagtagtctgttctcaacacagcagccagtgagatcctttcaaaactcaaagcagccaggtgtggtggctcacgcctgtaatcccaccactttgggaggctgagtcagatcacctgaggttaggaatttgagaccagcctggccaacatggcgacaccccagtctctactaataacacaaaaaattagccaggtgtgctggtgcatgtctgtaatcctagctactcaggaggctgaggcatgagaattgctcacgaggcggaggttgtagtgagctgagatcgtggcactgtactccagcctgggcgacagagggagaacccatgtcaaaaacaaaaaaagacaccaccaaaggtcaaagcatatcattcctcaccctcaagcccttagtggctccatttcactcagtaagagccacggtccttatggtgtccgtttttcagctctgaccttagctgctgctctctgcaccagccctgctgttcttgtgagtttttgagcacaccgggacatccccactccctggaaccttcttcccccacacttggcttcttcctttgagtctctactccactcgggcaagccttcctagacctcctgatttaaaactgtgactctcccccaacctccttggtgtttctccatagacgaacatcaccatctgatgtatgtcagcctttcccttcccctgttagaagggggacagcaggtagtaaaagtgaaatgtgctgtaagctttatgagggcagaggatttgtttctcgtgttcactgttgtatcgccagggcctcaaacacagcctgccacatagtaggagtcaacatatattgatcactaaatgtagataccacctgtgttcccatgttcatataaattctagaagagtctcttcagtaacaaggtgaaccccttccagagggctgagtaggtacctcaggccggggccagagtgctgtgaagacaggcagcagcccagaccaagcttctctgtgttccgtgtcctggtctagaaccagcgatgttctttctgaccagtgctttttggaaggtggctgaggtctgggctcaggtctgggccatactagaagctgggatcccttctatagagcacttggtatggcttgtatggtcttggggcaagccagacccaagccctcttatcccattttagaaagggcttcaatttggatccagccccaggtctgccttagctctgtattcttggggtattttgttctgtattggcctatcttgactaacaatgaaccttggatttgaaacatatcatcagaaacctcagaagacaacattcttaaactggctagagcctggtctgaatggatgaaaaggagagacttttgaagcaatatgtaaaagattgagaaatgatttgttggaaatttctcaattggagaaatttctttgatttgttggaaatttctttgattctttctcaatcaaagaaaatcgggacaaactcaacaatagaaagggaggaagcaagatactcagaaataaaatgcattcccctgtttcaacttaatgcttcaattcaggattctaaggaatccttgccaggaatgtcagactcaccttgatagttggagttactccattggtgactcgatcaaatacaggagttgaggcacctgcactgtaaaatactgattagtctgatcattaggaatatcctgtatgccaggtagaagatacattgaacagattgcatgtaggcattaaattcattttggggtattacatatagacaacacatttcattaagaaacataaaactgtcagatcggtggaatacttaaaagcacttggaggtgtttagcctaaaaagcttagttgaggggaatggaagaaaagatctgggagggtggttccaaagaagggatcagactgtcctaaagccctcaggaatctgggctgggaccagcctacttaaagataggatgggcagctgggtgtggtggctcacgcctgtaatcccagcacttcgggaggccgaagtgggcggatcacctgaggtcaggagttcgaggccagcctgaccaacatggagaaacactgtctctactaaaaatacaaaattagctgggtgtagtggcgcatgcctgtaatcccagctactcgggaggctgaggcaggggaatcgcttgaacctgggaggtggagggtgccgtgagccacgatcgcgccattgcactccagcctgggcaacaagagcgaaactctcaaaaaacaaaaaaaaggatgggttccatatgggtggtgtcaagtgcccacctcctagcaagtcagcaggggccagaggcccttgtaagtggtgtctcggggggatcaactgagatggcttaggatttacctggatgcctgctctgctctccccatctcttccagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcaggtgaggagatagaacaatgccttccatttcccgggtgcccttcctagcatgtgtttgctccgttgttttagataaggtctgggggatgagtcaatgtcacaggagctgatgtatagctttgaccttgtgaggggtggtgccaggttaagccacaattaagcctcatgaaggccgtttcacactcttttttttttttttttttaattattatactttaagttttagggtacatgtgcacaatgtgcaggttagttacatatgtatacatgtgccatgctggtgcgctgcacccactaactcatgatctagcatcaggtatatctcccaatgctatccctcccccctcctcccaccccacaacagtccccagagtgtgatgttccccttcctgtgtccatatgttctcgttgttcaattcccacctatgagtgagaatatgcagtgtttggttttttgttcttgcgatagtttactgagaatgatgatttccaatttcatccacgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttaatagtcctttgggtatatacccagtaatgggagggctgggtcaaatggtatttctagttctagatccctgaggaatcgccacactgacttccacaatggttgaactagtttacagtcccaccaacagtataaaagtgttcctatttctccacatcctctccagcacctgttgtttcctgactttttaatgattgccattctaactggtgtgagatggtgtctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttataaatttgtttgagttcattgtagattctggatattagctctttgtcagatgagtaggttgcaaaaattttctcccattttgtgggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttttacatatggctagccagttttcccagcaccatttattaaatagggaatcctttccccattgcttgtttttctcaggtttgtcaaagatcagatagttgtagatatgcggtgttatttctgagggctctgttctgttccattgatctatatgtctgttttggtaccagtaccatactgttttggttactgtagccttgtagtatagtttgaagtcaggtagtgtgatgtctccagctttgttcttttggcttaggattgacttggcgatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatggtcttccatttctttgtatcctcttttatttcattgagcagtggtttgtagttctccttgaagaggtccttcacatcccttttaaggtggattcctaggtattttattctctttgaagcaattgtgagtggaagttcactcatgatttggctctctgtttgtctgttattggtgtataagaatgcttgtgatttttgcagattgattttatatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgatgtgttgttgaattttgtcaaaggccttttctgcatctattgagataatcatgtggtttttgtctttggatctgtttatatgctggattacatttattgatttgtgtatattgaaccagccttgcatcccagggatgaagcccacatgatcatggtggataagctttttgatgtgctgctggattcggtttgccagtattttattgaggaattttgcatcaatgttcatcaaggatattggtctaaaattctcttttttggttgtgtctctgcccagctttggtatcaggatgatgctggcttcataaaatgagttagggaggattccctctttttctattgattggaatagtttcagaaggaatggtaccagttcctctttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcaaggaatttatccatttcttctagattttctagtttatttgcgtagaggtgtttgtagtaatctctgatggtagtttgtatttctgtgggattggtggtgatatcccctttatcattttttattgcgtctatttgattcttctctttttctttattagtcttgctagcggtctataaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctctgttctcgttggtttcaaagaacatctttatttctgccttcatttcgttatgtacccagtagtcattccggagcaggttgttcagtttccatgtagttgagcagttttgagtgagtttcttagttctgagttctagtttgattgcactgtggtctgagagatagtttgttataatttctgttcttttacatttgctgaggagagctttacttccaactatgtggtcaattttggaataggtgtggtgcggtgctgaaaaaaatgtatattctgttgatttggggtggagagttctgtagatgtctattaggtccgcttagtgcagagctgagttcaattcctgggtatccttgttaactttctgtctcgttgatctgtctaatgttgacagtggggtgttaaagtctcccattattaatgtgtgggagtctaagtctctttgtaggtcagatgattggcacttactgggcgcttggcactttccatactgtgtcatcggcagatagctgcatggttggtgttcgtgctggggaatgggaagttcatcggtgggacaagggacaaaatgcccccattgctttgttgtggctttaatctccctttcgaggctgagccacagcgtgctgtaggtggcgctgctgtgaagcgcagtgccagggtcacactccactcccagctctgcagaggtggagaaagaatgaaacatctcactcctggacttccactttcctgtcactgttggtgtcacctcttactggatgtcacagagcccagcccctcccacctgtccctaggaaaagcagatgccaccttggaatgtggggtttgtgtgtgcaatttactagctgggcagagaccagcaacctggagagcaggtgtctcatctaaggggacagtcacatttcacctccagccacctggaggaatttgggcctggtgatgtcagaattcttcaataaaagcctaaaatctatattttatgtgcggtcatgagatctgttaaatgttagcaacttcaggaagtttaaaaatgctgtgtggacctagaataggcaagttcttaaaggcagaaagtggaatgctagtttccagggactggggaacagggaggaatggggagttcatgtttaatgggcacagaggttttgttagggatgacgaaaaagttcgggagatggtgatggagatggtgatggtgatggagatggtgatggtgatggagatggtgatggtgatggagatggagatggtgatggagatggagatggtgatggtgatggagatggtgatggtgatggagatggagatggtgatggagatggtgatggtgatggagatggagatggtgatggtgatggagatggtgatggtgatggagatggagatggagatggtgatggtgatggtgatggagatggtgatggtgatggtgatggtgatggagatggtgatggtgatggtgatggtgatggagatggtgatggtgatggtgatggagatggtgatggtgatggagatggagatggtgatggtgatggtgatggagatggtgatggtgatgggatggtgatggagatggtgatggtgatggtgatggagatggtgatggtgatggagatggtgatggagatggtgatggtgatggagatggtgatggtgatggtgatggtgatggagatggtgatggtgatggtgatggtgatggtgatggagatggtgatggtgatggtgatggtgatgatggagatggtgatggtgatggtgatggtgatggtgatggagatggtgatggtgatggtgatggtgatggagatggtgatggtgatggtgatggagatggtgatggtgatggagatggtgatggtgatggtgatggtgatggtgatggtgatggagatgggtgatggtgatggttgcctaacatcaggaacgtgcttaatgcttctgaattgcacacaaaaatggcaagtttaatattatgtgtactttatcacaatgaaaaaagctgctgcgtgggccaagttacttgtgcaggtaagtgttctgcaggtcgttgcctgcacctcagttgtagggtgtccgtaggatgtgaggccagtccccgggcttaatgatgctttaaatcctgcctagtattcaattatttcttgtcgcttaaaaggcctaataaaattatggttttagtttacagtggtatgaatgcttagctgttggattttagtaggaaagtttgtccctttttgtttttaattttgttttacagattcacaggaatttttttttttttttttttaatgcacagaaagtttccctggacacactacccagtttcccccagtgataatatcttgggtaacatcctgtatacattcacattggtgcattcctcagagttgtcagattttgctagttttacgtgcacttgtgtatgtgtgtatttgcaattttagcacgtgtagactcttgtaaccactacaatcaagttacagaactacactaccaaggttcatctttttaaaatctttgatgttacctttttcggaacagtgaccatgagaggactttcctcccaaaattttgagaactactgaaccagaatatagtctgacactaataggtagaaatttaaccaaaggagattatgaagctctgcacttcagttaacaaatcacttctcagcttccagttccatctcagaaggaaggaaagggattaaaatccagagaccagaaatgggagcaaagtacaaggtggtgtaatcattacagaggtttcctgatgtttccaagtcagtcgtgtgttgagctgctaaactctaaagtaattttaggtggaagtgttggaaacatgctgctgaggtgatagaaaggaatccatggtcctctgttagttggaaagtatatggaatactatattctacataagatacaacactctctgtgagacaaggataaagtagattttgtcagtgaaattgtgacaagaatcgctgatgggtttagagcctaagtttgcgaggagcactggaagaaattaagattgttgagattggaaagggttagctatggggggaacaggaggaggtgactccatgacagaccaaatattcaaaggactgtgtagaagaggaaaaagactttgttagggctccagaggacagagccaggagtcagacagggccttgaactcaacccaccgagatctgcaaactttgcaggatgcaccagatgtcttgtagccatgggtcaaggggggaccctgggtaagagactgtaatagatgacctctaaggccatctcatgacatgtgtgattaatgtatgtacctgtcctctctttttgacaattctacagattattcaggacagggagttgaccaactgcaaagagtgattgacaccatcaaaaccaaccctgacgacagaagaatcatcatgtgcgcttggaatccaagaggttgaaagaaccccgtcgtcttcatttatactaaccatactcttagagggaagcaatctggttttgtgcagaggcacctgagggaggcaggaccctgggaacttcccccagccacatggttgattgtgtgacgttgggcaagtcacattttgctgcactttcaccttcagatcatgaggttgggcccagaggattttttttttttttttttttttttgagacagagttttgctctgttgcccaggctggaatgcaacggcgtgatcttggctcactgtaacctctgcctcctgggttcgagtgattctcctgcctcagcctcccaagtagctgggattacaggcatgtgccaccatgcccggctaattttgtatttttagtagagacggggtttcaccatgttggtcaggctggtcttgaactcctgacctcagatgatctgcctgcctcagcctcccaaccagatgatcttaatttgtgtatttatactcattcttacaccaaaaagggttttaaattgcctagaaactacatgtaagatgttaacattttaaatggaagcagatgaagttccagctcgctgccacctcactaacatttttaacaattatattgtaaaattcaactctaccagggtgtagagccaggtgtggtggctcacacctgtaattccaacaactccagaggccaaggcgagaggatcatttgaacccaggaatttgaggctgtagtgagtcatgatcacgccattgcactccagcctgggcaacagagtgagaccctgaatatttaaaaacaacaacaacaacaaaactctatcaggatatcataagtacttagagtgaaatacttgcatctgtaatagagacttattttttttttttttttgagacacagtctcaccctgttgcccaggctggagtgcagtggtgtgatctccgctcacggcaacctccatctcccaggttcaagtgagttcccattcctcagccccagagctgggaccacaggcgcgcgaatttttgtatttttagcagagacggggtttcactatgttggccaggctagtctcgaactcaagttggcctcaagtgatctgcccaccctggcgtcccagtgttgggatttcaggcatgagccactgtgcctggccatgtaatagagacttttaatataggagggtgtaccagaagcaccagtttcctgtggcaaacagaattattcctgctgtatttgtaatctggtgccacgaggtagcccagatcccttcagctctgatggaagagcattgcttcagccgtaaatggacacctgcagaaaccttgcaccgatggatagtctccctcagctccgtgccatcgctgcagaggctgttatggacatcactgcagcccagtggctctctctcctggtctccaccatatgagttggcttctgtttctctcctgttttactttgcctttagctgtggtctttcaaaccaccatccctccttatcttcctctgctggttcctcagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaaggtgggctgtctcgggaagggtgacttgccagcctaccacactgagctcttcagttctttaatatgggaaaacaaattgcagagtttagtctctgattagcttttaaatttgatatgtgtaagtaagaaatgaaccagcttttactttgaaaccttcctcttctggaaggttttctggccctgtggtatacgcactaacagatctatacaggttgtttgtgatacagcttctatggattttctcaaaagctatgctgaggttgggtatggtggctcatgcctgtaatcccagcactttgggagactgagacaggagcaattgcttgaggtctggagttcaataccagcctgggcaacataacaagatgctgttgctacaaaaaaatggaaaagctacactaaattatttttttaaaaaaagccttgcggtgtctgcatattctaatgtttttaaatgatgttttaaagaattgaaactaacatactgttctgctttctcccccgggtttatagccaggtgactttatacacactttgggagatgcacatatttacctgaatcacatcgagccactgaaaattcaggtaagaattagatgttatacttttgggtttggtaccttctcttgataaaaggttgactgtggaacaggcatctgctcaatgctgtgtccaagataaagatgactgctccaaatgtggggcttcagtttagggagaagtggtgggcaggtgggcaggacaaggcaggcatctgcctcagcaaccatgggcacttaacatgtcaggtgctgtgaggtactaagcaccagtaccagagagggaagagccacattcaagccaggggattgtccaaaagggggcattttaactcattttaacttgaaggagaattgaagtgcaaatgtttttccttttcttttttttttgagatggagtctttctctgtcggccaggctggagtgtgccgtggtgcgatctcagctcactgcaacctccacctcccgggttcaagcaattcttctgcctcagcctcccaggtagctgggattacaggcacatgccaccacacccagctaatttttgtattattagtagagatggggtttcatcatgttggccaggctagtctcaaactcctgacttcaagtgatccacctgcctcagcctccgaaaattctggaattacaggcataagccaccaccctggccataaatattttttgttaattttacattaagtacaatatttaggtccaaacttcaaaagtctgttgaaatccctaagttatagcagccaacaattgatatgaaatggcaataaaaatgtaagttcatctgcttcatgagccttaaggaaaaaaactcagaaccagacactttttagccccttccaggttagatccaggttttaaaagttactcctttgagggagtttggctgcttttgagtggaggtgacttcaggcttattctctctggctctctgctctggtcgtttttagacatagtaataggttgtgacctgtcttcacatcctaattgccactgtctgttcatcccaggaatcctggctttcatccctttctgttcactgtccatgcatgtcatctttccttctttctgccagggacagatgggttagggattgtggaattcaagtaaacgtagagctactatgagttacagattgactgtgttcctgtctttaataaatttgccaagagtggttataagaacttacacctgatgaggcaccaggctcctgatgctgtgtaatgtcacaaaatacccctcactctcgatctgtgcaagagaacagctggttgcgctccaatcatgttacataacctacggcaaggtatcgacaggatcatactcctgtaaaatagaactttgttgatcacatcctgtgtacttgtttcacggacatgaggagcaattacaacaggtcgtacaattatggcaaaataatggccttattttgtttttagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagctcgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttaaagttatagttgttttatatgttgctataataaagaagtgttctgcattcgtccacgctttgttcattctgtactgccacttatctgctcagttccttcctaaaatagattaaagaactctccttaagtaaa

SEQ ID NO: 713 - DNA, 35670 bp, Homo sapiens
gcctggcgcgcagagtgcaccttcctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctaggtacgtgcgcgggccgtgttccggtaggtgggcggcttcgggtccgagggccgcggcgtcccagagcccggggggtgcttcggcgtcctcgctgtcccccgccgtaccccaccctctgcagccgcaatgacgggaggggagcgcttgggtcgcgcctgggctggggatcgggcggcggccagccgcagcgccccagttccaggcacattcggtatgatggggtggcggcccgtggcctttggcaagaatgcgaaggcttatcggggatgtgagtagtagctctccactgaacacttttctcgttgagcattttcgatttaaacaatcctagctccttcacaacaaagctgcaagtcaagtgctactgtttcccccattttacaggtgaggaaggtggtggggccctgagaaaggaggcaacttaaatggcagagcccggaatagaacccgggttctcaaagcctgcgcccctaaaggctgcgcgcagggtcgctccacttttggcccgtgccaccagatccctgtggggaatgagctcttcctgttgcccgcaatctgccaccccctgttctaggagacaaatgttgcactgtgaagttcttggcccggtgccttggcttcgagattccgggagttaagtgacccttggtccagctgaggtcagcacagatgcgggccttcaatcgggcagttacccagagaatagactggaaacaccagtttaggttcttgcagaaataacattgtaggccgggcgcggtggctcatgcctgtaatcccagcattttgggaggccgaggtgggcggatcacttgaggttagtagttggagaccagcctggccaacatggtgaaaccccgtctgtactaaaaatacaaaaaaacctggctgcccatggtggcacacacctataatcccagctactcggaaggctgaggcaggagaatcgcttgaacccgggaggtggaggttgcagtgagcggagatcacgccactgcactccagcctgagtgacagagtgagactctatctcaaaagaaagaaagagagagaaagaaaagaaaaaaaagaaaagaaataacgtaaatttattacttgggggaacttggaacggaagtgggtaattgtgtttttatttagtgcaatgtcctgggacaaggccttggaactgaagagaaaccattgttcagattctggctcttatatggctttagacaagttagctccctgggcctcaatttcctcttctgtaaagaagagaacacaaaatgtgtgtgagatagaagatgtgcaacaagttagttccctgagcagatccttggctggatcctcttatgtgacagaggcccaggtaagatttggaggcatggggaggctggtgaccttgcaggtgacttcacttactaggtctttttccctgacgttgaggatcatgccacacatgagcaacagtgcctctacagaaatatccaatgttgtaatgactgatgttgcagtgagctgtgttggctgggggacttaccaggtattactgaatgttaatgaagatgtccctaagattcccaattttctttttttttttttttgagacggagtctcactctgttgcccaggccggagagcagtggcgcgatctcggctcactgcaagctccgcctcccgggttcacgccattctcctgcctcagcctcctgagtagctgggactacaggcgccgccaccacgcccagctaatttttttttatttttgtagagacggggtttcaccatgttagccaggatggtctcgatctcctgacctcgtgatctgcccgcctcggcctcccaaagtgctgggattacagatgtgagccactgcacccagcccccttttttcttttttgtttttttttttgaaacggagtctagctctgtcacccaggctggagtgcagtggcatgatctcggtccactgcaatctctacctcactggttcaagctattctcctggtctcagcctgctgagtagctgggattacaggcatatgccaccatgcctggctaatttttgtttttgtttttttttttttttttgagacagagtcttgctctgttgtccaggctggagtgcggtggcacgatctcagctcactgcaacctcctgggttcaagcgattatcttgcctcagcctcctgagtagctggggttacaggtgcgcaccacacacccagctcatttttgtatttttagtagagatggagttttaccgtgttggtcaggctggtctcgaactcctgacctggggtgatgcacccgccttggcctcccaaagtgcttggattacaggaattgagccactgcgcccagctaatttttgtatttttagtagagatggggtttcaccatattggccaggctggtctcaaactcctgacctcaagtgatccacccacctcggcctcccaaagtgctgggattacaggcgtcagccaccgcgcctgaccgcttttttttctttctttagagagacggggtctccctatgttgcccagggtggtcttgactcttgtggtcctgtgactccccagacttcaggtgtgcaagcctgatttctgacccttggccagtcacactttctcctttgtctggcctttgaacttggggtgctctgcacttgtttactctgcgtagattgctctcatcccagatttcatggttggctcctttccacagctcagatttcagctccgggacgttccctgacccagtctaaagtagccttgcacccatttattgcatctttctttcttttcttttcttttttttttttttgagacagggtcttgttctcttggccaggctggagtgctgtgggaaaatctgggctcactgcagcctcaacctccgggactcaagtgatcatcctgcctcagccacccagagtagctgagaatacaggcgtgcgccaccaggctcgggtaattttttgtatttttttttagagacagggttttgccatgttgcctaggctggtcttgaacgcctgggctcaagtgatcttctcgtctcagcctctcagagttctgggattacaagtgtaagcaaccatgcctggccttgtgtatttctttttggttttttttgtgatggagtcttgctctgtcacccaggctggagtgcaatggtatgatctcggctcactgcaacctccacctcctgggttcaagcgattttcctacctcagcctcccgcatagctggtattacaggggcccaccactatgcccatctaatttttgtattttttagtagagacggggtttcgctgtgttggccaggctggtctcgaactcctgacctcaggtgatccgcccgccttggcctcccaaagtgctggggttacaggtgtgagccactgtgcctggccaaataatttttttttttttttaagatagagtcttgctttgttgccaggctgcggtgcagtggtgtgatctctgctcactacagtctccgcctcctgggttcaagccattcttctgcctcagcctcctgagtagctggaattacaggcgggcgccaccacacccagctaattttagtatttttagtggagatggggtttcaccatgttggccaggacagtcttgatttcctgaccttgtggtctgcccgccttggcctcccaaagtgctgggattacaggcgtgaaccactgcacctggcctttttttttttattgagacacagtctcactctgtcacccagactggagtgcagtggcacaatctcggctcactgcagcctccacctctgaggctcaagtaagtctcatgcctcaggtgtgtgccaccacacccaattaattttttatatttttgctatagacagggtttcaccatgttagccaggctggtctcaaactcctggcctcaagttgatctgcccacctcagccttccaaagtgctgggattacagatgtgagccaccttgcccagcctaatttctaaatttttgtagagacgtggtttcactgtgttgcctaggctgtggttgaactcctaggctcaaaggatcctcctgccttgactcccctaagtgctgggattacaggcataagccaccataccaggcccttttttttttttcccctggagacagagtcttgctttgtcacccaggctagagtgcagtggtgtgatctcggctcactacaacttccgcctcccgggttcaagcgattctcctgcctcagcctcccaagtagctggggttacaggtgcctgccaccacacctgggtaatttttgtatttttagtcatgttggccaggctggtctcgaacttatgacctcatgatccgcacgccttggcctcccaaagtgctgggattacaggcatgagccactgggcccagcccaacctgtaattctttaggaagatttatattcaaacaagtcctttttttatttaaaagaaaaaaacacacacacacagggtcttactctgtcacccaggctggaatgcactgccacaatcacggctcattgcaacctctagcttccaggctcaggtgatcctcccacctcagcctcctgaatagctgggactacagatgcatgccaccacgaccagctaataatttgtattttttgtagaaatggggctttgccatgttgcccaggccagtcttgaactcctgggctcaagtgatcctcctgcctcagcctcccaaagtgctggaattacaggcatgaaccaccacacccagcccaagtacatattttaactaacagcttcacaggaactctgtggattacttagagcatgtgctttggggtttcgagtcctgcctctgtggctaactttctgtgcagccctgggctaagatattttacttttctttgagacagagtctcgctctgttgccagcctggagtgcagtggtgatcttggctcactgcaacctctgactcccaggttcaagtgattctcctgcctcagcctcccgagtagctgggattacaggcgtgagccactacgcccggctaatttttgtatttttagtagagatggggtttcaccgtgtaggccaggatggtctcgatctcctgacctcctgatccgcccacctcggcctcccaaagtactgggattacaggcatgagccactgcgcccagccacaatatttcacttttctaacgtcgtttttctttctttagttcttttttttttttttttaagagtcctagcccaggctgggcgcggtggctcacacctgtaatcccagcactttgggaggccgagaccatcctggctaaccggtgaaaccccatctctactgaaaaaataaaaaaaaaattagccaggcatggtggtgggtgcctgtgttcctggctacttgggaggctgaggcaggagaatggcatgaacccgggaggtggagcttgcagtgagccgagatcgcgccactgtactccagcctgggcgacagagtgagactctgtctcaaaaaaaaaaaaaaaaagagtcctagctcagtaggtaggactataggcccatcccaccatgcccagctaacttttttttttgtagcaatgcccaggctggtcttgaactcctggcctcccaaagtgctggggttacaggtgtgagttgccatgcctggccctgagcctcaatttcattacttgaagtatgaaataaattaacacattaaagtgttgctaggattaaaatgaggtccttatgtattcaaaaatcgtacagagatttttgaggcccttcttatagcaaaactcccatttacatttttctggagcctggagaaatgtgtccagactgagtgaataggtgctatttgctgtacttacattatcatttataaaatactactggtggtcatcctggaaagatgatcccaactgcctatatcctgttcatcattaacttgtgtgtcccaaaaaatcttttgaaaagttgctaaatagtgaatatttactattttatgagggcctgccagttccctgccagtggaattgtttcaagtcaatgattcatctgttcagtcatttggaaaatactctttttttttttttttttttttttttttgaggtggagtcttgctctatggccaggctggagtgcagtggtgtgatctcggctcactgcaagctctgcctcccagattcaagagattctcctgcctcagcctcccaagtagctgggactacaggcatgtgccacaacgtccagctcattttttgtatttttagtagagatggggtttcaccaggttggccaggatggtctccaactccagatcttgtgatctgcccacctcggcctcccaaagtgctgggattgcaggcgtgagccaccgtgcccggccggaaaatattcttcatgtatagcagtgttgggtaccgcaggagattttttaaaaagtagcactcagtccttaccttcaaggaacttagtttagttgtgggagataagctatatccatgagaagtttggctgagaggaggcggagttgggctccctgcaggtggggaggagggtcagttctcatttctgagggagatgagctgacgtctgcagtttggaaaggaaccagaagttccacatggtggttttgcaatagaacatgctcgtgtttaccaagcaattctgagggaaaggctaaaaaaagtgttagtttatcaacttgatagaactaacaggtttcgatgagctttgattcaatataatgctgcggccaggcatggtggctcacgcctgtaatcccagcactttgggaggccgaggcaggcggatcacttgagaggagttcaagaccagcctgaccaacgtgataaaactccatctctacgaaaaatacacaaattagccaggcgtagtggcgcacgcctgtagtcccagctactcaggaggctgaggcaggagaatcacttgaacccaggaggcggaggttgcagtgagccaagatcacgccattgcctgggtgacagagtgagagtcttgtctcaaaaaaataaaaataaataggtggggcgcggtggctgacacctgtaatcccagcactttgggaagccaacgtgggcggatgacaaggtcaggagattgagaccatcctggctaacacagtgaaacctcgtctctactaaaaatacaaaaaattagccgggcatggtggcatgcgcctgtagtcagaagattgaggcaggagaatctcttgaacctgggagacggaggttgcagtgagccgagatcatgccactgcactctagcctgggcaacaaagactacatctcaaaaataaataaaaaataaataaaataaataaatttaattctggaagctacacatgtttttcccatttttttaggcagcttcgaaccagtgcaatgacgatgccagtcaacggggcccacaaggatgctgacctgtggtcctcacatgacaagatgctggcacaacccctcaaagacagtgatgttgaggtgagatttttggggtcttcacagatttttttatgttggaggccttcatttaatctttagttctaattacaaattaattagggacagccttgaaatgagtattatcctgctggatttagaggtggtggcagacaaaatggctacaaatcctttgagggtaaatttaaagattgctgggtttcttcaaagtgtggagcactgtgcagggtgctctggagaaaagcgagaaggggagagatcactgacagttgaccctttcctgacagttcacagggaatatagatctatctagacatctgaaagcacctttattttattttattttacttgtttatttatttttttgagacagagtttcactcttgttgcccaggctggagtgcaatggcgtgatcttggctcactgcaacctccacctcctgggttcaagggattctccagcctcagcctcctgactagctgggattgcaggcacccaccaccatgcccggctaatttttttttttttttttttttgagacagagtcttgctctgtcgcccaggctggagtgcagtggcgtgatctcagctcactgcaagttccacctcctgggttcatgccattctcctgcctcagcctcctgagtagctgggactacaggtgcctgccaccacacccggctaattttttgtattttttagtagaggtggggtttcaccatgttagccaggatggtctcgatctcctgacctcgtgatccgcccacctcagcctcccaaagtgctgggattacaggcgtgagccaccgcacccggcctttttttttttttttttttttttttttttttttttttgagatatagtcttgctctgttgctcaggctggagtgcagtgacgcgatctcagctcactgcaagctccatctcccgggttcacgccattctcctgccttagcctcccgagtagctgggactacaggtgccagccaccacgccctggctaattttttgtattatttttttttttttagtagagacgggatttcactgtgttagccaggatgatcttgatctcctgacctcgtgatccacctgtctcggcctcccaaagtgctgggattacaggcgtgagccaccacgcccggcctaaagcatcttttcttttaaggaagaagaacaaggaataaggttcagggagggagaaacttggtgaaatgtaggaataaaaataacaggatggtggtgttaaaaattaggtgggacacttaaagataactttctcttcaatcattttgtttttctttttctgagatgaagtctcgctcttgtttcccaggctggagtgcgatggcgcgatctcggctcactgaatcctccacctcccaggttcaagcgattctcctgcctcggccccccgagtagctgagattataggcgcctgccaccacacccatctaagttttgtttttttgtttgtttgtttttgagacagagttttgttcttgtcgcccaggctggagtgcaatggcgtgatctcggctcactgcaacctccgcctcccgggttcaagtgattctcctgcctcagcctcccgagtagctgggattacaggcatgtgccaccatgcccggctaattttgtattttttagtagagacgagggtttctccatgttagtcaggctggtctcgaacccccgacctcaggtgatctgcccatctcggcctcccaaagtgctgggattacaggcgtgagccaccacgcccagccaagttttgtatttttagtagagatggagtttcaccatattggccaggctggtctagaactcctgacctcaggtgatccaccagcctcggcctcccaaagtgctgggattacagtcgtgagccaccgcacctggctatcattttgtttttgttaattcattgattagtgctttctcagatactaaaacctttgaggaggattcattctattccataatgtgaaagagtgtcttttctctttaggaggttgtaatttggatcagagcaaaattttaaactaaaatttccaaatatcaagcatctgttttcttctcataaggtttacaacatcattaagaaggagagtaaccggcagagggttggattggagctgattgcctcggagaatttcgccagccgagcagttttggaggccctaggctcttgcttaaataacaaatactctgaggggtacccgggccagaggtatgtgaatatcttcaaaggcctggttctgacacagtcatagggagtactcagtcagcctaggacctaaacaatttggaaatttcagaaaacaataagcttcccagctgtaggatttctgttccacgcctgctctctgacagaactcttttattcccagcatgtgataacactgaagagctcagcgcaggtgtactcaggggcacatttcacagttctttgggggctttctagaaaaacaggccagtttgtaaggagtattgagccactggactggtgtgtggcctctgtctagaaaaggtcagtgtcatctgagggatgctgcagaaggtggccgttgccatgtgagtcatcgagtctgtattgggaatggtgtggaagtggaggctgaatctggattactgaaaaccgtttctgcattataaatgttggatttacacatgcagtggctttcagttgactctttcaccctcagaattacagtgttatattcgtttttgttttttacagtcatcatcaggcaaagaaaataaattacagaattagacatggcttttgcaaatgtgtgcatttttgtcccaaaggaaacagaaaggtcacccttggagaaggaattgccattctgtcctgagatgcccctgaagctctatgtagaagactgagaatcaagttgaaggcattgtctttctcctattgtgaataactaacttttgcattgtgccttaaagaattcaccaggtgttttctttatttctctctctcctttctttttctttttccttcctttctttcttctttcaggctaaggtattttgttaacaccaggtgttttctttttttttttcttcttttttgagacatggtctttctctcacccaggctgaagtgcagtggtgtgatcaaggttcactgcagccttggtctcctggacccaagccatcctcccacctcagcctactgagtcgctgggactacaggcacacaccaccacacccagctaattttttgtagagacagagtttcacccaggctgttgttgcccaggctgatctccatctcctgagctcaagcaatccacctgccttggcctcccagagtgcttaggattagagctgtgagccactgcacccggtccacaccaggtgttttcaaaactaatatttcattcgattctcacagcaatgtatcgagcaaggggtgatgttttctacatttttaagaagggggaccgggcgcggtggctcacgcctgtaatcccagcactttgggaggcccaggcgggcggatcacgaggtcaggagatcgagaccatcctggctaacacggtgaaaccccgtctctactaaaaatacaaaaaattagcctggcaaggtggcgggcgcctgtagtcccagctacgtgggaggctgatgcaggagaatggcgtgaaccccagggggcagagcttgcagtgagccgagatcgcgccactgcactctagcctgggcgatagcgagcctccgtctcaaaaaaaaaaaaaaagaaggggactgagtgtagtggctcacccctgtaatcccagtgctttaagaggccagggcagaggatcatttgaggctaggaatttgagaccagcctgggcaatatagtgagacgctgtctccaaaacaaaatttaaaaattagccggacatggtggcatgcgcctgtagtctcagctactcaagaaactgaggtggagtatcgcttgagcccaggagatcaaaggctgcagtgagctatgattttgccaatgcactccagctggggtgacagaatgagaccctgtttctaaatttaaaaaaaaccccgaaaaaccacaacttaaatagaagtgtaattacatcgtttattcatgttaaagggcttgttgttttttttttacacggagtatcgctctgtcacgaggctggagtgcagtggcacaatctcggctcactgcagcctccacctcccaggttcaagcgattctcttgcctcagcctcccaagtagctgggactataggcacgtgccaccacacccgactaacttatttatttatttattttttgtatttttagtagagacggggtttcaccgtgttagccaggctggtctcgatctcctgacctcatgatccgcctgcctctgtctcccaaagtgttgggattacaggcgtgagccactgtgcccagccaattaaagggctcttttaaaaggtaattattggctgggcgtggtggctcatgcctgtaattccagcactttaggaggccgagctgggtggatcatgaggtcaggagatcgagaccatcctggctaatacggtgtaaaccccatctctactaaaaaaaaatacaaaaaaattagccaggtgtggtggctggcgcctgtagtcccagctactcgggaggctaaggcaggagaatggtgtgaacctgggaggtggagtttgcagtgagccgagatcgcgccactgcactccagcctgggtgacagtgagattccgtctcaaaaaaataataaaaataaaaataaaaggtaattattacatgttttcattatattttgttaatataatttaatattaatctacctttggaacattatttaaaatcaaaggcaatatttgaaaacaataggcaaggcgtggtggttcacacctgtaatcccagcacttcgggaggctgaggcaggtggatcacctgaggtcaggagtttgagaccagcctggccaacatgtcgaaaccctgtctctactaaaaatacaaaaattagctgggtgtggaggtgcgtgcctgtaatcccagctactctggaggctgaggtaggagaatcgcttgaacttgggaggcggaggttgcagtgagccgagatcgcaccactgcactccagcctgggagacagagcaagactccatctcagaaaaaaaaaaaagaaaacagtgttgacctaacgttaatgactttgcttgatacaaacctaaaaacaaagttctgggtttaaaacaaaatgttatgtatgtgtgaataaatgaatgacaaggtctcgttgtcttgcccaggctggagtgcagtggtgcaatctcgtctcattgcagcctcaaactcttgggctcaagcaatcctcctgcctcagcctctctgtagctaggaccacaggtgcgtgccaccacaccaggctaatttttaatagacatgaggtcttgctgtgttgcccaggctggtttcaaactcctggcctcaagcagtcttcccacctgagccttccatattactaggattacaggtgtgaacaaccacatctggcctatttattttttatttatttatttatttattttgagacggagtctcactctgtcgcccaggctggagcgcagtggcacgatctcggctcactacaagctccacctcccgggttcacgccattctcctgcctcagcctcccgagtagctgggactacaggcgcccgccaccacacccggctaattttttatatattttttagtagagacggggtttcaccatgttagccaggatggtctccatctcctgacctcgtgatccgcccgcctcggcctccgaaagtgctgggattacaggcgtgagccaccgtgcccggcctattttttatctatttttatttttttgagacagagttttgctcttgttgcccagggtggagtgcaatggtacaatctcggctcaccgcaacctccgcctcccaggttcaagcaattctcctacctcagcctcctcaatagctgggaatacaggcgtgcaccaccacgcctggctaattttgtatttttaggagagatggggtttctccatgttggtcaggctggtctcgaactcctgacgtcaggtgatccgcccacttcggcctcccaaagtgctgagattacaaatgtgagccactacgccgggcccggcctatttattttttttagagttagggtctcactgtgttgctccagctgtagtgcagtggtacaatcaaagctcactgcaatctccaactcctgggttcaagtgatcctcccacctcagccttccaagtaactaggactataggtgcaagccactatacttagctcatttgtaaaattttttgtagagctgagatctcactatgttgcctagctggtcttgaactcctggcctcaagcagttctcccacctcagccttccaaatctctgagattacagacatgagccactgcatgtagttactttaaatttttttttgagactgagtcttgctgggatgcccaggctggagtgcagtggggcgatctcggctcactgcaacctccacctcctgggttcaagagattctcctgcctcagcctcccgagcagctgggattacagtcacccgccaccactcccggctaatttttgtatttttagtagagacggggtttcaccatattggccaggctggtctggaactcctgacctcaggtgatctgcccacctcggcctcccaaagtgctgggattacaggcgtgagccaccatgcccagcctaagcttgactactttagggacctcataaaagttgaatcatacagtgcttgtcttgtggtgactggtttgtttcacttagcataatgttctcaggctcatccctgttgtattaatagcatgtgataggatttctttccttttttttttctttttcttttcttttttttttttgagacagggtccaggctggagtccagtggcgtgatcacagctcactgcagcctttacctcctgggccaaagtgaatcttcccttctcagcctcccaagtagctgggactatgggcacacaccacaacacctggctaattttttgaaattttttgtagagatggggatattgctgtattgcccaggctggtctcgaactcctgggctcaagcaatcctcctgccttggctcctcaaagtgctgggattataggtataagccacctctcccagccaaaaccccctctttttatagatgagatatttgctccaagttgcacagctggtttggtctcttgactgtagattccagaggcattggtggaacacttgatcatgctggcttcagcatctgcatgttaacaagctcttctcattacttctctccactttagtttcactgtcccacccctaagcttctttggcctctgtgaagcacagactttctgggtctgagtggatctaagtctcctgctcttctcccacagatactatggcgggactgagtttattgatgaactggagaccctctgtcagaagcgagccctgcaggcctataagctggacccacagtgctggggggtcaacgtccagccctactcaggtgcttgtctcatccatatggcctggtgcagcctcttcatgtgcatcccccagggccgacatgcaccaagaagagtcctaagatggactgccatggactgccataggccgggcccagtggctcacgcctgtaatcccagcactttgggaggcggaggcaggcagaccacctgaggccggcagttcaagaccagcctgaccaacatggagaaacccggtctccactaaaaatacaaaaattagctgggtgtagtggcacatgcctgtaatcccagctactcggagcctgaggcaggagaattgcttgaacctgggaggcggaggttgcagtgagctgccgagatggcgccattgcattccagcctgggcaacaagagcgaaactccatctcaaaaaaaaaaaaaaaaaaaactgccataaataaaagataagtcacgcatccctctgcattacccttgggctcccagctctataccccctcccaggcagtgccctctctctgaacttcacctctcaaggctggtggtgaaggggcacctcctggagctcagggaaggtacaaggcctgttctcgccactcctgggtgaaggcttagtggccaaggtcccggatgccacttggtacctcagttagaaataatcatgtctcctctggtccactcgtttcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtaagcatgtgtttctctcctagcttttatttccttgggaaacctctgatgcttggctgtgcctgcaggggtaagtttggtttatgtgtcactacaggaagtccccacctcgcaccgtttttaatttccttgcagcggggactcctcaggttttcaggacccgctggggcagctgggatggagagacgagggtctgagctgaggccacagggaaaccagtgagggaggcaactactgaggagagttcagatgtggcaggggcagtggcaactgcttggaatagcaaccctggggaatagcaaccaggtcactacagttggaccccagcaacagccaccacctctgcagctctgccctcgcctggtgacatctctgctcggagcccctgtgggccagcagcagcacaaggatgcagtagctacaggcatggcaacgtccccagctccagcaccaaaaccagcagcccggcaccatccacagccacagtcctccatggccacgttagggctagcccctgcctgtgtatagtggctacagaggaacagacagtggtttgacttagggcgttcaactttaggatagtgcaaaagtgacatgcgttattagctgtacttcaagccccccatacgaccattctgcttttcagtttcagtacagtattcagtagattacatgagatagtcaacaccgtattataaaataaggtttgtgtttgactatcttgcccagtggagggtaccacagtgtcctcagcatgtttaaggtaggccagactaggttgtgatgtttggtaggttaggtatattacatgcatttttgactttatgatattttcagcttaatgatgagcttattggaatgtaaccccataagttgaggagcacctgtatggctcaggtgtacaccccattgccattgccaccccactgcacatacctgataacgcagccagcccagcagtggaaccaacaccatcagaaccagtgccaagtgctgcctctagggtgtgcagggccccaggcaaatacttgtttttcgtgggacccgtctgtataaacagttgggtcaaaaaatgcctgtaagatgtgtgggcttattcaggcatggtgatttatctataaaaacgaaggataatgggaagaagaggtaacttgctttttcttttagtgtccagtgttggtgattctttctagtgtcccggaaccatcttttcatgttctttattaataaatgtgccattcctgcttagtttcatgtttgttaccatgaaaaaaggtagcactgcatccttctgcttggctggcattgcatggtcttgggtgcatgctgtccatggttctgtgtgtactcagcctttgtctcagtgctggtgattgcacgtgtgctcttttttgcagtcatttcttttcacagaacacctaggtgtttgcagtcacagatctcctcattggccaaggccagccttgaagctagattttgaaacatgtcacaatagtaacaaaatagtttgtcttggctgggctcggtggctcacacctgtaatcacagcactttgggaagctgaggtgggcagatcacctgaggtcaggagttcgagaccagcctggccaacatgttcaaaccctgtctctactaaaaatacaaaaaattcctcaggtgtggtggtgcacacccgtagttccagctactcaggaggctgaggagggataattgcttgaacctgggaggcggaggttgcagtgagccaagattgctccattgcactccagagtgggcgacaagagtgaaactccatctcaaaaaaaataaataaataagaaaggcagggtgcagttgctcacgcttgtaatcccagcactttgggaggctgaggcaggcggatcatgaggtcaggagttcaagaccagcctggccaacacagtgaaaccccgtctctactaaaaatacatggtggtgcactcctgtaatcccagcactttgggaggtcgaagtgggcggatcatccgaggtcaggagttcgagaccagcctggccaacatggtgaaagccttctctactaaaaatacagaaattaactggacgtggtggcgggcacctgtaatcccagctactcaggaggctgaggcaggagaaccacttgaacctgggaggcggaggttgcagtgagccaagattgcaccagtgcactccagcctaggtgacagagcaagactccatctccagaaaaaaaaagaaagaatctgcgtcccgcacccagttccctccagccacccccgtctttgatgtacattgtgcaggctgcagtcctgtgggtgcagtgaggggacccacctcaggatgggcatggagaggtggggcctgggaccctggccagcttgggcagcaggaggtgcagctcacccgctgtgggggtgatttgagtcctgcccttggcggacaggaggaggagacagaccttattggcattcatcagcagccagaggcagctcacctccaccccaccgggctgcagagttggaggttagggggtgtcccagggccactgccctgcccagccttcaccagaccgcctgcctccaccttcagcccctgccccactccactgcaagagccccacgcagggccaggctagagcaacagcaacattaaccttctattttgtgtttttggcccatccccactgtgactcgagaattcctccctgtccctggtcctaagtgactgctggggtctccttccttatcctctgtgcactgtggaccccatctgcagtttattataaatgcctatgaattcttctaggagttgttctcttgtctcattttcaagattaaaaaaagaaaagaaaaacctttgaaaaacccattaaattaaaaagggagaaagcagcacaggcttttttttttttttttttttttccggtaattgtggctacacaaaaaattttagaattatgtccattttttttaaatctttttttttttcctttttgtggagaacaagatctcactatgttgcccaggcgggtctcaaactcctggactcaagctatcctactgcctctgtctccctaagagctgggattacaggcgtgagccaccatgcccggtgaattacgtccatttttactggaggtcagctgttgatatttcatttcataaaacggtttctttgccaaattcaggtgactgagaaagaaccacacccctgaagcaaaacacagcaaacaaaaccacaaatcatctttcagcttgactttctagatgaggtcttggttcccgaaaccttgtggcaagcttctatagttgggttggattataactgcctttttttatttggaaagagtgaccaccaatcctgaaacctttcactccagatgtgctggtagtttctgagggggacaccaaggtaagaggaaggaaggttgggtcagggccttcagaacagggagcctctctgcacatctcctcttccctgaggcttctcagatcccagagcccagtttttcctgtggtgcgctctatgctctgctggttatgtgtgcttacccatgactttttttttttttttttttttaagacagtatctggctctgcctcccaggctggagtgcagtggctctgtctcggctcactgcaacctctgcctcctgggctcaagcgatctttcctcttcagcctcccaagtagctgggactagaggcgcatgccaccatgcctggctaatttttgtattttttgtggagacaaggttttgccatgttgcccaggctggtcttgaactcctgggctcaagtgatctgtccaactcagcctcccaaagtgctggtattacaggcatgagccaccgcatccggctgacccctttttttttttttttttttttttgagacaaagtttccctcttgtcgcccaggctggagtgcagtggcacgatctcagcttactgcaacctctgcctcccgggtttaagcgattctcctccctcagcttcctgaatcgctaggactgcaggtgtgtaccaccatgcctggctaattttgtgtttttagtagaggtggggtttcaccatgttggctaggctggtctcaaactcctgacctcaggtgatctgaccccctcggcctcccaaagtgctgagattacagatgtgagccaccacgcctggctgacccatatgtttatagaagtttaataaaatgaacttcctaagagatgtgttgccagaaaagaaaaattattttaaattttacatcgagatctacaatctgtttggaattgacttttttttttaaacaaattatatataattatgggatgcacagtgatgttatgatttgtatatacagtgtggaactattgaatcaagttaactaacatatcccactccttaaatatttattatttttcttcctgtctaactgcaactttgtaccctttgctcagtatctctccattgtctgccaccctccagtgactggtaaccacattctaccctgcttctgtgagtttgattgttttatttatttatttatttattcaattttaattttttttttttgagacagagtctcactttgtcgcccaggctggagtgcagtggcaccatcttgactcactgcaacctccgcctcctgggttcaagtgattctcctgcctcagcctcccgaatagctgggattacaggcatacgccaccacgcctggctaatttgtgaatgtttagtagagacggggtttcaccatgttggccaggctggtctcaaactcctgtcctcaggtggtccacctgcctcggcctcccaaagtgctggaactgcaggcataagccaccacgcccagcagttcgattgttttagatttcacatagaagtaagatcacatggccaggtgcggtggctcacacctataatctcagcactttgggaggtcgaggtaggaggctcacttgagtccaggagttcgagaccagcctgggcaacatggtgaaaccccatctctacaaaaatataagaattagccgggtgtggtggcactgcctgtggtcccagctattcagcaggctgagtgggagaatcgcttgagcctgggaggtagaggttgcaatgagccgagatggcaccaccgcactccagcctgggtgacagagtgagactctgtctcaaaaaagaagtgagatcatgcagtatttgtctgtctgagcctggcgtatttcacttagcataaggtcctccaagttcatcggtgttgttgcaaatgacagaatttcttttttcagactgattattattacattgtttatatatatatgtgtcacatttcctttgtccattcatctgttgatggacatggctttattccataacttggctattgtgaatagtgctgcagtgaacatgggagtgcacatgtctctttgacatactgatttcaagttcttaagatatagattcacaagtgggattgctgaatatggaattgatttgtgtgggtgaggcgggcatccagataacatttttgtccaaatggatgcccagttgacctagtgccattgattgaaaaggtcatcctctccccactgcactgcagcgtcaccactggcatggatccaatgacctgtgttgtgtgtggttctgcttctggttaagccagatgctctgcccttccatgaatgcgtgctgccttaattactataatttgtcaagcattttgtgacacaaaatacacaacgcaatgatgttttgtgtaaaggtttggtatgattttccttttatggtttttgttatttacatttcattttctatctttcttgcttttatatactttttggctttttttttttttttttttcagatggagtctcgctctgttgcccaggctggagtgctggagtgcagtggcacaatctcggctcactgcaagctccacctcccgggttcacgccattctcctgcctcagcctcccaagtagctgggattacaggcgcccgccaccatatctggctaattttttgcatttttagtagagacggggtttcaccgtgttagccaggatggtctcgatctcctgacctcatgatctgcccgtctcagcctcccaaagtgctgggattacaggtgtgagccaccgcgcccagcccctacttcttgtttttcaatgttgtatccagtgaccttgctaaatttgcttattctaacagttggcccctagcatcttgattttctaggtatattgtgttgtctgtgtgtaatgtcagtttttaaatttcttctttcctaatcgttatgccttttgtttctttttcttgcctcattatacttggaatagaagtagtattagcaggcattttggtcttgttcctgaaggtaaccattttggtttccattgtgtggtcccgtcacatttgtttcattctgcaggtgctttttggttccttctcagcaggtagtgccccagcagcagggctcactacaaccctgggactcctcagggactcctgggtctgtgagccatacttggttgagcaggctgaacacaccagtatccatcctgtctcaccctcaagtcctcatctaggacatcattcctcttgtcatggtgggtggagccagttcaagtgggaggacaggaggcaggtgtggttggaggaagcagcctgaacctgcctccctgacattccacaggtgaacccagatactggctacatcaactatgaccagctggaggagaacgcacgcctcttccacccgaagctgatcatcgcaggtgatgcgcggggcggaaagtcaccttgttcaccagtagcctggtgcctcttacagaatgaggatggaaagatgttcgcaccctgttgagcccactgctagtttctgccctggataactgagtttctggggtctacatatattagtttctttcaggatacagatgtgtgtttgctgctttttgtgctatgtagattaagatgtgagactgttctcagagaagcatctagaaatgtcaggccctgactgcgctggcaatagtagttggggccatctcaaccaccaagacgttgaagagttagagtggttgcctttagcacagaggtgctttttgagggcattctccatttttgctctgagactttaagggaagaaatctctgggctttcagatctgcacatctagaggccactgtgaagccaactcagctggccggtggacatctctgatgcagctgtgtcacctttcctgtctcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggtgagctcccgaatgttgggtacagatgggtaccatggtttacatttctcctgtgggggttcagattcagttgagggagctgggaaaaactctgacctgggatccttggaaaatattaagatcccagtcccttaaagagctgcttaggaaggagcagtgacaggctttacagaaaggattcccggccaggtgaggtggctcgcgcctgtaatcccagcactttgggaggccgaagcgggcagatcacgaggtcaggagatcaagaccatcctggctaacacggtgaaaccccgtctctactaaaaacacgaaaaattagccgagtgtggtggtgggcacctgtagtcccagctactcaggaggcgaaggcaggagaatggcgtgagcctgggaggtggagcttgcagtgagctgagattgtgccactgtactccagcctgggcgacagagcgagatgccgtctcaaaaaaaaaaaaagaaagaaagaaaggaatccccagaaggagactgtcagccacagctcctgcttcacttttgtgcatccaggtcctaggaacataggagggggatcagcaaccactatgtgttaggatggcgccggttgctgaactcgagaggcaggtgtttgaatgaaaggagggtgcatggctggctgggggccactgggaggcctcacaaggctgcattattctggtgaacttacagtgatccatcatgtttctcaaagagaaagactcatagtagtcaaactagaagacatggatgtataaacattaatatcattttagtgaaggtttttctttccattacctcataacctacccctaggcactccccttattttcgaattcccatacctgggaaagcctgttagtggtcaggtcatcatttagcctgtggtgagacctgatgcgccaactttgcatcagcagagacaccagccctctggtgactacattactcttttttttttttttttttttttttttttttagtatttattgatcattcttgggtgtttctcgtggagggggatttggcagggtcataggacaatagtggagggaaggtcagcagataaacaagtgaacaagggtctctggttttcctaggcagaggaccctgcggctttccgcagtgtttgtgtccctgggtacttgagattagggagtggtgatgactcttaatgagcatgccgccttcaagcatctgtttaacaaagcacatcttgcaccacccttaatccatttaaccctgagtggacacagcacatgtttcagagagcacggggttgggggtaaggttatagattaacagaagaatttttcttagtacagaacaaaatggaatctcctatgtctacttctttctacacagacacagcaacaatctgatttctctatcttttccccacatttcccccttttctattcgacaaaaccgccatcgtcatcatggcctgttctcaatgagctgttgggtacacctcccagacggggtggcggctgggcagaggggctcctcacttcccagaaggggcggccgggcagaggggctcctcacttcccagaaggggcggccgggcagaggcgcccccccacctcctggaaggggtgacggccaggcgggggctgccccccacctccctcccggacggggcggctggctgggcgggggctgcccccaacctgccggacagggcagctgccgggcagagatgctcctcacttcccagacggggcgactgccaggcggaggggctcctcacttctcagatggggcagccgggcagagaccctcctcacctcccagacggggttgcagccgggcagaggtgctcctcacatcccagacggggcggcggggcagaggcgctccccacatctcagatgatgggcggccgggcagagacgctcctcacttcctagacgggatggcggccgggaagaggcgctcctcacttcccagactgggcagccaggcagaggggctcctcacatcccagatgatgagcggccaggcagagacgctcctcacttcccagacggggtggcggccaggcagaggctgcaatctcggcactttgggaggccaaggcaggcggctgggaggtggaggttgtagcgagccgagatcacaccactgcactccagcctgggcaacattgagcactgagtgaacgagactccgtctgcaatcccggcacctcgggaggccgaggctggcagatgactcgcggttaggagctggagaccagcccggccaacacagcaaaaccccgtctccaccaaaaaaatacgaaaaccagtcaggcgtggcggcacgtgcctgcaatcccaggcactcggcaggctgaggcaggagaatcaggcagggaggttgcagtgagccgagatggcggcagtacagtccagcttcggctcggcatcagagggagaccgtggaaagggagagggagaccgtggggagagggagggggagggggagggagagggagagggctgttcgactacattactcttacccgaggcagggtcttcttgcccagcccctggctgggactagacacagccacatgccccctcagcttctcagcaccccgttgcctctgtgctcctccaaggaccgtttttagctgtgctgatgtttctgaggcaggtagccattcccacccgcccaggagacatttggttttttcccccactgtgtgttgatgtgatttatttcacccagtgctgagggactccggagccagcctatcagagcaagtactagctctgccgcacacccgctgtatgactttagggctagctgtgcagcctctctgttcctcatttcctcacctctagagtggggactataataatagtacctgtccctttggactgctgttttgaggattaaatgaatttatgtaaagtgattagagcagttcttggctcactagaagctctagatagatgttaccgattatgactgaatagtagctattattgatggttaactttttctcagaaaggaaccttattcttcatattagccacatgagcgttgtctctttcaatgcatcttggagactctttaaattttatttttggggacagggtctcactctgtcactcaggctgcagtgcagtggtgcaatcaaagctcactgcaacttcaacttcccgggcccaagcaatcctcctacctcaccctcccacgtagctgggaccacaggtatgcgccaccatgcctggctaatttttaaatttttctgtggacatgggttctctctttgttgctcatgctggtcttgaactcctgggttcaagtgatcctcccacctctgcctcccaaagtgctgggattacatggactttttttttccccggagatggagttttgctcttgtcgcccaggctggagtgcagtggtgcaatctcggctcgctacaacctccacctcccgggttcaacgcattctcctgcttcagcctcctgagtagctggaattacagatgcccgccaccatgcccagctaatttttgtattattagtagagacagggtttcactatgttgacccagctggtcttgaactcctgaccttaattgatccacctgcctcagcctcccaaagtgctgggattacacgcatgaaccaccacgcccagccacatggacatttctttaaggaaagatgtccagggcaaattcttgaattcttggttacaatgttagtggagggaaatttctgtcctttttttttctttttttctttttgagacagaatgtcactctgtcacccaggctggagtgcactggcgcgatcttggctcactgcaacctctgcctcccgggttcaagcgattcttctgcctcagcctcccaagtagctgggactacaggtgcacaccaccacgcccggctaatttttgtatttttagtagagacggggtttcaccatgttggccagactagtcccaaactcctgacctcgtgatccgcccgccttggcctcccaaagtgctgggattacaggtgtgagccaccgcgtccagcctgtcctttcatttttaaggccttgttctagttgtgttaagaagagatgccatcagaggaggcaggtggacaggtgaggtgctgaaaccagtattccagccagagtcatccatgatgtgttggtttccaaaaaataaagatactggtctgccctcaggaggcaagggtcccctctgctccgctgtgttacaaatcagttctccatgccaggataaaggccaggcttgtgcttgattcttccctggccagtctgggtttgagcctaaaaagaaaaagaggggacagcccctatgatcccactgtgatgtttttcttcctccaggagtgaaaagtgtggatcccaagactggcaaagagattctgtacaacctggagtctcttatcaattctgctgtgttccctggcctgcagggaggtccccacaaccacgccattgctggtaaaacatcatctgcctctgctcatcctgtagcccctaattcccatcccacctgtcctccaaaatcgtgtgccaggacttccacgctggggaaaaagctggagggctgtctctgtgcaggagatgctaacacagagtagggcatggttgagactggcctaaggtagggacagtagggaatggcatccactccacgtgtacggccacccagaggcaaacctgtgggtcaggccgagttttgtaaagtacatggcaccctcttagggaaggaatctgacagttaggagagggcaaagcacaggtgagagagattggggtccagaccctgcaggatgagtccccttgcccttgatgggcctggcctgtggcagtggaggaccctgtgtctgatcctcacaccctgcaccagtgccacgccagtgactcctgagtcagattccatgcctgcccagcaggttctcattgacttgctctttgtctctttgtacaagtagcttaggacatttgtgatgactcaagagttatcccgctgccttcatggaacaaggacattggtagcactcattcccgctaaggggctcaggatgaaggtgtagcttctcaggagacgcacaagcacttctagagaggaacctggggacagcagcgattgggagatattaggcataaggggtggaaggagctggggtcccgggtgtgttctcatgttctcccatcacacctacacacttggcacccacagctgctttaactctgggatgcagggatcaccccatccccagctgctctggacgccctttccagttgttttcacaagtattgattggaggctctgtgcgggatgcaggcccgtgggttctccttatcctccattctctgtgtcccttgaagcagccctcaggattgaatgtgagataccagataagtctgaatggtgcagggtaggacgaaggctgcacctcctacctgcgctctgaccttagagagctgcataatctggcatcagagcatcggctcttaggcctgctaagtaatcgttttcacacatcaagattaaaaaggatgtaaaatccatcttgcttaacagctttggtatggtaatgttagcacagaacttccatgcttagggaaaggttacctcaacagcagttcctcagagagaagcatatcagctgggcgcggtggctcatgcctataatcccagcactttgggaggctgaggtgggtgggtcacttgagcccaggagtttgagaccagcctggccaacatgaagaaagcccgtctcttaccaaaaacataaaaaattagccaggcgtggccaggcgcagtggctcacgcctgtagtcccagcactttgggaggccgagatggacagatcacttgaggtcaggagttccagaacagcctggccaacatacagtgaaaccctgtctctactaaaaaatacaaaaattagctggatgtggtggcacgtgcctgtagtcccagctacttgggaagctgaggcaggagaattgcttgaacccgggaggcggaggttgcagtgagccgagattgcaccactgcactccagcctcagcgacagagcgagactccatctctcaaaaaaaattagccaggtgtggtaggatgcacctgtagtcccacctactcgggagactgagatgggaggatcatctgagccctgaacatcaaggctgcagtgaactgtgatcacgccactgtactccagcctgggcaatgggagtgagaccctgtctcaaaaaatataaaaataaaaaatttttttagctgggcatggtgctcatgcctgtaatcccagcacttggggaggccaaggcaggcggatcacttgaggtcaggagttcaagaccagcctggccaatatagtgaaaccctgtctctactaaaaataccaacaaaaattagctggacatggtggcatgtgcctgtagtcccagctgttcgggatgccgaagcagaagaatcacttgaacctgggaggcagaggttgcagtgaaccgagatcacaccactgcactccagcctgggcaacaagagtgaaactccatctcaaaaaaaataaaaataataaataataaaaaatttttaaaaatatatcattttggaggaaaagataatccaacgcaaaagcaaggggtgacattgaaaagcaaggaagcttgagtaaaaacaggaatgttgtttgactcatcatctgtgtatgattctatcctagcctcctgacccattgtctcttcttgtccaggggttgctgtggcactgaagcaagctatgactctggaatttaaagtttatcaacaccaggtggtggccaactgcagggctctgtctgaggccctgacggagctgggctacaaaatagtcacaggtagagacacagatggtgttcagcaggcctgttcttgtggttgtattaaggcttgcttctcagtttgtgcaaccaggatgtggcccaggctctgctgctgcagctgcaatgatgggcccaccttgggaggaggtcagcctcgcctccaactggaaagcctccccctgcctcagaccagccagccgcccccttgggtgagccacagatgatgggaatagtggttgccattggtcaccagcataaggactgcttgtcctcagaacagctttgcaggaggatgacctgaggctcaactgagaggttgggctgtagtggtcacacacctggtaggtggcaccaggactgtgtggtgatgccttgcactgtgccaggggagtgtcttctctcaccccgctgagctgggggtgcaggggctctcccctcccagtttcctgcatattcctggggagttggcttgctttaggcatgtttgcttggatctgtacattctggagctgatgggctgtgaatgagatggacttcccaggtcagggccccactctggggtgccatccacctcacagtcactgcagctttccacggagaacgcatttttttggcaggcagcatactcagtcctccggaggaagggcgactttatacctagtcccacaagactgccgattgtgctagcagtggtgtggtccaggaatatgggtcctgctgtgtgtagacctgagtgcccactctctgcaccgtgtcctttgccctttacagggattacaggccctctgatctaaggattggggagggattacaggcctcctggtctaaggagtggggctcccacccaatcctgcatgtgcggcagtgcctgggaaggccgggccagtgctgtctcctcagcagtaccagccgtaccctcttttatgttctacttcacttactttctgttctcccttcatcctccatgtcttcaaataataaagctcaagaagtcctcgtgcagactgtgaacttcagggtgctttagctcaggagtccccaacctccgggccacggactagtactggtttgtggtctgttaggaacctggccgcacagcaggaagtgagctgggccgagagcattgccacctgagctccgcctcctgtcagatcagtggcagcattagattctcagaggagctgaacgctggtttgaactgcacatgtgagggatctaggttgggcctagacactttcaagaaactatcttttttttccttctgattatacctgcatccttatgagaatctaatgcccgatgatctgaggtggaagtttcatcccaaaaccatcccccgatgccatccgtgaaaaaactgtcttccacataaccagttcctggtgccaaaaaggttggggaccactgctttaggtccctgtttcttaaacttcaatgtgcacaccacccctggggctgttggtgcaatgcagattctgaccaggccttgggtgatgctggtctgggagccacccttggagttgtgagggtttaggccatagtccctgtcaccatgggcatctcatggcatgggcctgccctctccctggtgactgtgtcattgtcactctgccatctgaggacccgatgcacatggctgagacagataatgcttgcaaatgccctctttggtgcctggtgctatgagaagcactatgtccagtatcttacttaaacttcatgacagccctgtgaattattggtctttttgttacaaatgggcatctgaggtttcacaatgttgagctgcctgcctaaagccacacggcaagtgggtgggcacagctggggggctgcaaagccaagctggagccctagctcacccgcatcttgaaagggatccccgcaacacagctcagaagcagaggccccagtgctgtcagcacccaaggcactaccccagcttaatgaaggttcaaagtggaaggatcctcctgtatgacctcgggccaggtccagaaaactctgttagccttgctgttgtcaccttaccactttgataataccatcagcctcacaggatccgggaaaaacctaccacaggctacagtgtctggcacctaatgtgctctgtgaacatgccccttaccccccaaagtaaattgaactgctgcccaatattcatgctgccttcaggggagcctttaccatcaatgttagggaattgcccaagcaacttgtcagagaaaacaagccaggagcagcctgaggaagctgtcccttccccatgggagtgtcaggccctctgctgtatgatcagttacccctttcaaaagtgctctgtccttcctttcacattcttaggcacgggcatctctcgtggggattagaatcccaggccatgtggtgggggtgctcaccttcctgacctcatctgctttgactgccttcatcctcgccttcgtttctcagagattccttcacggcatagaattcgcctgcatttctacatgtccaactttgtttccaggtggttctgacaaccatttgatccttgtggatctccgttccaaaggcacagatggtggaagggctgagaaggtgctagaagcctgttctattgcctgcaacaagaacacctgtccaggtgagaatcatccttgccttctccttcactcctctcccatctgcatttcttctggccaaagttgtagctgatgaatatattggctccggggacagacctcacataaaaactgtagtgggggctgggcacggtggctcacgcctgtaatcccggcactttgggaggccgaggcaggcggatcacttgaggtcaggaattcgagaccagcctggccaaaatggtgaaatcctgtctctactaaaaatagaagaattagctgggcatggtggtgcatgcccgtaatcccagctacttggaaggctgaggcagaagagtcgcttgaacccgggaggcagaggttgcagtgagtggagattgtaccactgcactccagccttagcaacagaatgagactctgtctaaaaaaaaaaaaactgggccaggtgcagtggttcacacctgtaatcccagcactttgggaggccgaggtgggtggatcacgaggtcaggagattgagaaggctaacgcggtgaaaccctgtctctactaaaaatgctgtggtggcacacaccacggtcccagctactcaggaggctgaggcagaagaattgcttgaacccaggaggcagaggctgcattgagccgagactgcgccactgcactccagcttaggcgacagtgagactccgtctcaaaaaaacaaaaacaaaaacaaaaaatggagcgggggcagggaccataccttggctgtctcttggctgtgcctttgtacttggccctgaccctgccagggagcaaaaagactgatgtagagctgttggaggtggtacattcatcagatgagggaggtcagggcctccggaatccagaggctgcatttctctgtgggttgttaacaaaatattgatgacgcatctcagacccagacagatgttaccctcatttttaggagcaaggggcacatcagaccactttgtgtactagtaattaagtcagagtggccaaacgtggttgtgcctccttgtgccttgggttctactttagtttctgaatcagttgtactccttgctagggacagccagtatcctcaggccagttctcttttgcccacatgtccctttttaaatgcaccaccatcacagtggtgacaatgtgacttagggacagagccccgtttatcttgtaggtgacagaagcgctctgcggcccagtggactgcggctggggaccccagcactgacgtcccgtggacttttggaaaaagacttccaaaaagtagcccactttattcacagaggtaaggataaaagtttggaagttgccacatcttattgtgtgtatttagtttctgattgtgatgagtagctgagaccctgccactgaaagacaattctgcaccaaggctgagtgttggggtgggagacagcaaaaaacacatgtaaatcaccttgtctgagagggttataaatttgggctgcccaggacatctgtccaagggtgggtgcatctcagagtaattgaggtaagcatggagaccttgtgccctgccacactccccagctgggggacattctgacatttgtgcctcggcccccagccattgtaccccctttggtgtgtagtgtggggtgactcatttgtgtcttgtggcacagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 714 - DNA, 2857 bp, Homo sapiens
ctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggcgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcggcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaatagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgtctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaacgctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccatccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcacagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaacgtttatatttataaaccctcttttttttttttttaattttattgagacagagtcttgctctgtcacccaggct

SEQ ID NO: 715 - DNA, 4219 bp, Homo sapiens
atgaagaccagggggttcagctttccaagacaaaggcaagtcctgtttctttttcttttctggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcactcgccagtgtttcggcacaaagagatggtcttaaaaatatcagaaaatacagctgaagggacagcatttagactagaaagagcacaggatccagatgaaggtcataacagtatccaaaactacacgatcagctccaactcttttttccatattaaaattagtggcagtgatgaaggcatgatatatccagagctagtgttggacaaagcactggatcgggaggagcaggaagagctcagcttaaccctcacagcgctggatggtgggtctccatccaggtctgggacctccactatacgcattgtggtcttggatgtcaatgacaatgccccacagtttgcccaggctctgtatgagacccaggctccagaaaacagtccagtagggtcccttattgttaaagtgtctgcaggagatgcagactcaggagtcaatgcagaagtatcctattcattttttgatgcttctgaagatattttaacaacgtttcaaatcaatcctttttctggggaaatctttctcagagaattgcttgattatgagttagtaaattcttacaaaataaatatacaggcaatggacggcggaggcctttctgcaagatgtacagttttgataaaagtattagattccaatgacaatcctcctgaactgatcatatcatcactttccaactctgttgctgaaaactctcctgggatagtattggctgtttttaagattaaagacagagactccggagaaaatggaaagacatttgctatgttcaagataatctgcctttttttctgaaaccgtctgttgacaatttttacatcctaatgactgaaggtgcactggacagagagagcaaagctgagtacaacatcaccatcaccgtcactgacttggggacacccaggctgaaaaccgagcacagcataaccctgcaggtctccgacgtcaatgacaacgcccccgccttcacccaaacctcctacaccctgttcgtccgggagaacaacagccccgccctgcacatcggcagtgtcagcgccacagacagagactcaggcaccaacgcccaggtcacctactcgctgctgccgccccaggacccacacctgcccctcgcctccctggtctccatcaacgcggacaatggccacctgtttgccctcaggtcgctggactacgaggccctgcaggctttcgacttccgcgtgggcgcctcagaccgcggctccccggctttgagcagcgaggcgctggtgcgcgtactggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctggtggtgcttgtcaaggacaatggcgagcctcctcgctcggccaccgccacgctgcacgtgctcctggtggacggcttctcccagccctacctgcctctcccggaggcggccccggcccaggcccaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgagcggcaccgggaccctgttccagagctaccagtacgaggtgtgtctgactggaggttcagagaccggcgagttcaagttcttgaagccgattaccccccacctcccgccccataggggtgggaaagaaatagaggaaaattctactctccccaatagctttggatttaattattgaaaggaacccacttaataaagacatttacttctttaatatattcttgttggctaactaaattgtgtatgcccaccacaaagaaggtactattttttgtttgattcatcttcaactttgcgtattatgcttaacttcacaagttaactttttcttattttgtatcctgatgaggcatttcttactagaatcccataagtgaaatataatatttttcaaagttgatatcatttaaaaatttttggtcgttttaaatgtctttattgactttaaattcattgcctctacattattcattagttcttcttttcctaaaactttttacttgttaaaatagtctgctgcatgtaatatgtgcttttactatttgatatttcttctatttttcttttgaaaccggtgttcttattggtttgccatccttgttcattacaactgttttttgtttgtttgtttgttttttggtttgtttgttttttttttttttgagacggagtctcgctctgtcgcccaggctggagtgcagtggcgcgatctcagctcactgcaacctccgcctcccaggttcaagcgattctcctgcctcagcctccagagtatctgggactacagttgcatgtcaccacgttcggctaatttttgtattttcagtagagacgggtttcatcatggtggccaggatggtctatctcttgacctcgtgatccaccccactcagcctcccaaattgctgggatttacaggcatgagccaccgcacccagcctacaataattttcttaaactttaccttttattttaaagttctagtttcccggcattgatagttccctatttgaaatataatgtttctcttgtaagtgatatgataaataaacccctaattagccttagaagaaaaaccactgcaagatattaagcgtgtgtaaatgggctttagtctggaaaccaaaaaaaaaaaaaaaatttagtcattctataggatcatgtgaaaatatttaatttgctccttttaattctgtataaacaaatcagaggttcctgaggttcctgttaaatttttaatggctaatagcccagtgccatccagttgaaaaaacaacagcaatcacaaagtagaggtttatattgtgcggcttttatattcagctattagagtgttattggtagtgtctagccttttcctccacgacattccttgacttaatccatttgggcctattatagacaaaatagagcttctttctagatataaggtctttgaggcagggctcagtggctcattcctgtaatcccagcactttgggaggccaaggcgggcagatcaccttaggtcacgagtttgagaccagcctgaccaacgttaagtaaccccgtctttactaaaaatacaaaattagccaggcatggtggcacatgcttgtaatcccagctactcgggaggctgaggcaggagaatcgcttgaacccaggaggtggaagttgctttgagccgagattgcaccattgtactccagcctgggcaataagagcaaaactccatcaaaataaaataaaataaaatataaaataacttaaaaagaactttgaataaaattctatgaaaaaagacactagaatgctgttcttaattttaatagtgttaagataggtgttagtgtggtctgttctttacctccctttatttggtgcagagaagttagatcctgctaaatttcaattaagaggggaccttaaaataaggatcaatctcttatttaaccctgtaagttactttaaagctaatacaagaaaaacaaagacaagtgaaagtaaggaaacagaaattgc

SEQ ID NO: 716 - DNA, 39645 bp, Homo sapiens
atcgctagctgggggcggggccggaagctctttccccgcgactgcgccacgtctgaggcggctgtggccgcgtcggtgtccgcgtcgaggagccggggcagggcacgatggcggactgggctcggggtgagcgcgggagagcggagccgttgggggcagggccgggccgaaaccgacgccgctgcctgtagagccgcgtgcgcctgcctctggcccagctggggtgacctcggccgagaggaccctgtcaggggggcggattcggatccttccgggtccgagcagggccgggtttcggccggcactgccgttaggaccgaaggcgcgcgtggcggcccagcagctccagcgaggggtcgcgcagcagcggggtctccccactccccgccgccccctgtgagatcgttctgcatgggttcggggtgagcgggagtcggcattcgacaggtcccgaggccaggccctaggagtagaggctgtgctccgctggtgtccaagcaggactcttactttggcctcggtggccccatttcccctcctggagcccgtgttcttgtctgcaaagtgggatattgatgcctgtctctgtgaggtgttatgatgattaaaggaatttataaatatgaagtggctggaaggacgctggcatcccttcctgacactgaagctagggaggaggtggttctcacgcacctgatgtgacagaacttccttatcccctggcccagcctgtcacaggccaggcctctgcgagcactctgccctgggtgttgcaggaagccccatgcgggatgcagaccaaggatcccgctcctggtcgacctcagctcccgtctcggggaaattgggaactttgctcagccattttctgtgcggtaaagggccttcccaatgttctgtcctggttccttgccacctcttcaggacctagctcaaaggtcgtctctgcaggagcctttctgctgccttgctgggtacttttcccaagtcttttctatgctcttagcagagtttactctttttctataagaatgggctccacatacacagatggtgacctccctggatgcaagtgtcacatcatactagcaccccagggctgggtccagtttttgctacacagtctcagaaggtgctggttggaccgaacccattgtgggtgcttgcccatccccaccttgatgtgtacacaggacatgtgttcacatgacaggcccttacacacatcgtcctttatgcagcctgtctcatgtgcaagattcacctgctggaaccttggttagggccccctagatttctgactcacccagatgtggttggagtgagaggggtcaggggccgtgctcaccgatggatgcaacccttcagcccctctcttttctcagctcagagcccgggcgctgtggaagagattctagaccgggagaacaagcgaatggctgacagcctggcctccaaagtcaccaggctcaaatcggtcagtggtggtctgtcctcttacctccacctggtgcctttggggaatggggatcagagggaaggcagagggcccagaggagtttcaggcagttttccatcctcatccaattcgtggctgtgctcacctgcatgaggccccagctgacacctggacctttctgtctgctgcagccccactgtgtctggcagagttgttggcagggtttatctggtctggggagggtgagtgctgtattatgtgtctgctctggcccaaccctgccctctctgtctgctgaacagctcgccctggacatcgatagggatgcagaggatcagaaccggtacctggatggcatggtaagggcccacggtgtgcgtgtatcagtgccctgccctagcactacctgctgcagagcctgcagtgtctccttcagcactggtgcgggtgggtggtcaaatcaccacttctgtgtgatcttgctgggattcctcccttaggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaatgataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctggtgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatatgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagaactaatcatatggtctctgtcgtcctcatttccttgggatttgagggaattttgtttggagctcaccctggtccacaggctggccatgagcactggtgctgtaaaccctgtcccttccctcattcaccccgtggctggccatgagcacaggtgctgtaaaccctgccccttccctcattcaccccatcagggttgactttgggcagagcagccacagactcacctgaaaggggcctgcctctccacacctgtgggtatttctcgtcaggtgggacgagagactgaggaaagaagacacagagacaaagtatagagaaagaacagtgggcccaggggaccggcacactaagcgtgggaggacccgcactggtgccggtctccgggttccctcagtatttattgatgattattttcactatcttggcaaggggagtgcagcaggagaacagggagaacggtgatggtggggagaaggtcagaaggaaaacgtgagtaaaggaatctgtgtcataaataagttcaagggaaggtactgtgcccggatgtgcacgtaggctagatttaggtttctctttacccaaacattttagtatagcaaagagtaacagagcagtatcatcgctagcatatttcgcctctagccacagggtggttttctcctatcttagaatagaacgaataatcgaataatcggctttacaccaagacattccgttcccagggacatgcgggaaacagagggcttcctcttatctcagctgcaaagaggccttcctcttttacgaatcctcctcagcacagaccctttacggttgtcgggctgggggacggtcaggtctttcccttcccacgaggccgtatctcaggctgtctcagttgggggaaaccttggacaatacccaggcttcctcggacagaggtccctgcagctttccgcagtgcattgtgtccctggttaatagagaatggagaatggtgatgacttttaccaagcatactgtctgcaaacatattgttaagaaggcacaccctgcatagccctaaatcccttaaaccttgatttaatacagcacatgtttccgtgagcacaggattagggctaacgttacaggttaacagcatctcaaagcagaacaatttttctttgtacagatcaagatggagtttcttttgtcttccttttctaggtaggcacagtaacagtctgatctttgccccacactcacccacttcctgctgtgttacccttccctgcccaagttcctgaaacgcagatggggatcctgatagcatcaccacttagggaataagtgagttggccgggcgcggtggctcatgcctgtaatctcaacactttgggaagtcaaggtgagtgaatcacaaggtcaggagttcgagaccatcctgaccaacatggtgaaaccccgtctctactaaaaatacaaaaattagctgggtgtggtggcacgtgcctataatcccagctactcaggaggctgaggcagcagaattgcttgaacctggcagacggaggttgcagcgagctgagattgtgccattgcactccagcctgggcgacagagcgagactctgtctcagaaaaaaaaagaaaaaaaagagagtaaacatgaagtgcttcgaatacacagcctggcacgatcacagcgaagtgaaggtcagcagttgtactgtgctttatacaggtgcaggtgatggtcctaccagtgtgtctgttgaggtcacccgtcctaaagtgacctccctgaaagcctgagttgaaatccagactccacttcttgaggcctggccttggactcttgggcagcctctggaaatcctcctcttcaggcccagcggataccccaccttccctgtccatgtcttccttgtactccctgtatgacccattgatgtgtaacaggtcaccctaaaacttcacctaaaatagcaatgatttatcatgtctcattgaatttgagacggggcacgcttcagggttggctgtctttgctctacagtgtcgaggcctcactgggagatgtggtcctggggctgccttcacttgaaggctcactcacaggtccagaggtcagtgctggtgagtggagggcctggccgggctgactgcctgtggccgggctgacgactgcctgtggccgggccgactgcctgggatggtgcattcagtctcgccatggttgagcttcctcacaacatgatggctggtgctggagcaaacatggacacgtggcagaagggtgggggtggggtgggctctggtgtccaggcggaagctgtttccttggtatgttgtgtgcgtggcctcaggagcctggtggcatcacttctgccatacctcattactcaggacacccacaggctatagtccagattcaagggaagggacccagcattgctcagaggtgatgagcacaggtgtggccatctttgggttcaaggcagaaagcatcaggagggacagtgtggagcagggtgtctgaggtactcaggccctaccatctctccccacacagaccctgggccctcccatctcaccaagctgaccctgggccctagaaggcaggatgggaccccttgtgggcaagtgctgacagcctacgggggctcctttctggaaatgcttgatccttccaccaagacaaacccttattaatgcaatctgatttattaataatttgggcacagcagaaaacaagattaaaaaatggtaaaatagcatagaaaaaaagtaactgattacaattgcccaaacaagcgtgctctgccctgcagggccaggctggcccagcccagctggtgaagacagcctcgagctctgtggcccggcggatcttgtgtagatgccgggtgtgatggggcacagcagggctggcgttattccacatcaaccagcaggggagtcatgtaatcagagtgtttgatgccgaaggtgacaactggggcgcagggcttggtcagggtcacctgggagaggaggggctatgataggaaccagcacccctgcccccacctgcaggtctctgccctggctggggctgggctgctgtccttcctgaacctggggccaaggtggccagaagctatgctcccaggtttgaacacagagcactcagcagtagtagctgtcacagtgtctagggaaaagggcagggtctctgcttccatgtccctgaagggttacctgtgggcctagtgctggaaatgtacagggtcctcagggtgcaggtgcctcccatccccaccccacccctccaccccttcttggctgtgtccttccatagcctgaccctgtttcccctcgtctgtgtcccagcccccctccctgctctttcctacacatccctctgggccaggaccctgccccaccctgacccctctgagctgtgctcttcctggaccttctcagggctgtgggcgcctggtcctggcttgagggtcttgtcccctgggggctccacacgggcagccatggtgtactgcggagccttgaacttggtcacccgcacatcagtttggcggtaggctgcgggacctggggtctgagaggtaaaggaggctcagaccaactcggcctacccagggcgtgtggccctagaggacagggagcaaactcaggctctgagtcaacagggtcagctacaagttggtgcccgtgcatcaaggtccccttctgtcttctgtcacactgtggagatcacaccccactgcttgtggggtacctcatgtgggggtcacttcctccatttcagcctcacgctggcaatggcatccccagtgtgtgccagtcctgggaacatcgctgagcgtgtgtgagagaggctgttgctgccctgttggacctgagggcctggggctggcaaaatcaacatggacgagggctgttgggtgccatgatgctgcttccccatctcaggcccctcaagctctcaggcatgtgccacccaggggctttgcactggctgtttctgaaaccaggaccctcctcccccaaatagctcatggtttattttttcctcctcctcttctttccatgctaccctatctaagattgcctctctctctccagacagtgcttcctaaaccccatctcttgtcctcagcacggtccatgctggggccagggcgtctcccttctggcctgttgcctgcccctcctcaccactgcagtgtaaccccagcacgtggcaggtgcccagagggtgaagggctgagggggctgaggggcattggcaaggcagggccgaactggtgggtcctgggttccgggggagggttcagatggttgggggtgattctctgttctcagttggggtggcccttgccttgtgtaggtcgtcgctgaagccgcccagcttgctgcggcccttgatggaaaaggagggctgggaggccttgccgacggtattgggccccattaccatgggcagcatgtacgcagcggggcctgcagggtggacgtggagcctcaggccggaacagggcccactgctccttccctggggctctcccccaactctggagatcagccgtcgggctgccccatgtcacacaccccacccaggatccccaggtccatttggctgaggatggttggggctgctgcggacctggggtgctgtccactcggaatgcctttgtccgggcagagatggagtggctgggtgctgagtcgaacacgtacttggtggatttctctggaaagtagtcacctggacaaggagccaagggggctgctgggacaagcaggtgggtatgcagcccagtttgggggctcaaggaggactccccaacattctaggcgtggggcctctgggctccaacacaggtggtgaccaagtcgggtcagggggtgtccaggatggaaatgctgacttcagggctggtgagacaaaggctatttttgagcagggagagtggggtctgacgtcggcctggcagagaaaggtccaggtcggagctggactcttgggccagagtcttctctgcccaggcacgatggtgacccctcaagagagaaagatgggacgggaggggccaggatggctgagctctcccacacccttgctgacatgaggttaggggcacccagcagggaggggcaggcctgaggctgcgcagggcaggagcctgagacagggtcactaacctggaccaggagtcagcatggtcttggtttggtagcgccccaggatggagtaggcagggccaaggtccttgccagtcctcagtatcttggggtttacattgtaacggggccctggggagcagttctctgccaggagcatgggggccccacggaagctgtaggccggtgcacgcagcttggtgggcgtgtgcttcatgaagcctgtggacgcaatgggccctgagcagcccggagcctgacctgcccttctccccgctgggagtcagggattgagccccaggcccttcccgggacccccacctgcccgcctggctcctgaccctctcccacagtctctcaggctcttacctgttgttggtggaatcaggtacttgggtccagggctgctgtagagggccatgatgggtccccgggggcgatggggcctccaggtacccatccatacctcctccgtcatggccagctctgtccgtaagtgagagggttaccaggtgctgggaggcccggccctgtcccatgccggcccctgatgtccccgaccctgctcttgctgacactgaagggtaagacctgcggaacctgctgcagcatcagtggggatctccagctgggagccaggagtcagggacagtaggagctttctgcatgggtctgtgagctcctcaccagcttaactgtaacccagagttgctgtccatgctggcccttaactcaccactgttctcggctctaagggagccctgggccggtttctcctacttggagtggtcaaagatggggaacttcttgattgaggctgagctgaggggcagggagggggccgcctgggagggaactataacttcttcagtgcagggacagcactcagagcagcctagagacccatcctcatcagagactgtcctttcccccctggccttggtgccagggagttcccgcaaaaggagcatggagagaaaggccttcctctctcctcatgggcttacagaattggggagaggtcccccactctaaactctagaatgtggctctgtgggatgacaggttctagattctgtctatgtgaccaagacaatggcttctgcctttgatcccctcaccagatctcaccaccaggtccccccaacaggacacccctataagtccccctgaccatgttcccctcaccatgttcccctcaccaggtcctcctcaccaggtcccctcaccaaggctccccacccatgtcctcctcaccaggtcccctcaccaggtcccctcaccaaggtcccccccatgtcccctcaccaggtcccctcaccaaggtcccccccatgtcccctcaccaggtcccctcaccaaggtcccccccatgtcccctcaccaggtcccctcaccaaggtcccccccatgtcccctcaccaggtcctcctcaccaaggtcccccccatgtcccctcaccaggtcccctcaccaaggtcccccccatgtcctcctcaccaggtcccctcaccaaggtccccctcatgtcccctcaccaggtcccctcaccaaggtcccccccatgtcccctcaccaggtcctcctcaccaaggtcccccccatgtcccctcaccaggtcccctcaccaaggtccccccctatgtcccctcaccaggtcccctcaccaggtcccctcaccaaggtcccccccatgtcccctcaccaggtcccctcaccaaggtcccccccatgtcctcctcaccaggtcccctcaccaaggtcccccccatgtcccctcaccaggtccgctcaccaaggtccccctatgtcccctcaccaggtcccctcaccaaggtcccccccatgtcccctcaccaggtcctcctcaccaggtttccctaagttccctcaccagaccacccctcaccaggccccctcaccatgtttctttcaccaggtcccctcaaccaggcacccacccatgaagtccccctcactgggtcccctcaccaggtcccctgtaaccaagtcctccagggccccctccctagggctccctcagccaaatggaaatccaggcagataccatgtaggcaggtgggacagagcacagagccgacagcaccgcatggcccccttgccaggctcagacaggacagaggtgtggagaggagggccggggcagtgaagtgtcagggctcagcacccagggtggccaaggatggggcggttccactcagctgtgcccccagaagagaccatagattgggcagctgaaatgctggaaggttctggctgtgggagagtctgggatccagggtcaggatcagggtctgtgctggttgtggtgggtgtgagtcagtgtgggcgctggggctgccctggctgacctcagaggctgctcacctgcggctcccaacccccttggacatgggtgtacctttttcttggccttgtcaggggtcctcttggggctcgacaccagctttcagatgctgagcacccccgccctgacctagcccatgggcgacatggggtctgtgtccacccagtcctggacacttcctctttctggggctcccacctcataccgctgcctctgccgcccgtctccctccggacgccccctccagacgccccctccggacgaccacgcagtgttgtctggctctgtgctctgtccacctgcctacgtggcgtctgcctggatttccattttgggtcttgcctgtggtgtgcctgctcctgtgtggaccctgtgtgtacctctgtggggactttcacacgtgtgttccttgagtgggatcctctgtatgtgggtctgtgtgtgtggctgtggccctgtgttcctgatgtccccatttgtgtgtacctctgtggggactttcacacgtgtgttccttgagtgggatcctctgtatgtgggtctgtgtgtgtggctgtggccctgtgttcctgatgtccccatttgtgtgtccctctgtgggggactttcgcacgtgtgctccttgagtaggatcctctgtatgtgggtctgtgtgtgtggctgtggccctgtgttcctgatgtccccatttgtgtgtccctctgtggggactttcgcacgtgtgctccttgagtgggatcctctgtatgtgggtctgtgtgtgtggctgtggccccgagtgtgttcctgatgtccccatttgtgtgcccctctgtgggggcagagacaggagcctgagctgcggaagaggctttattgattaaacggtttgaggatacatttccatgtgggaggtggtagtgggcgttgtgtccacggctgcttgtgtggcaggtcctatggctgagccatgtctgaggtccacttaggcaccgtcctgactgcccagcacttgcacctggaaggcagacacatgtggactaagagggctgtgctcaataagtggagagccacagctccatcaggcaagcaaggccctcagtgggggggggtctggcatattgctgcctatctcctcccagcagctgggaggtgtgtgtgcacatgtgatggtgtgcacacatgtatgtgtgtgcatatcccagtgtgagcatgtgggtgtgaacgtgtttatacatgtgtgcacgcagtgtacatttcatgtctgcacctgtgtttggatctctgtgtatgttcacatgtgtgcatggaggagtatcccacagactggggaggaggtctatggagtctgggggctgctcggtggacaggaggtctggggtgtccacctgagctggctgatgcgggtgcaatgtctgtgggtggtggatgtctgtgggtggggtaggctgtgtgggtgctgtgttgggtggtcttggtaaggctgcagatctttagaaaatggggtgcccgccgccctcataccagcagcttgaccagctccgccttgtgcattggctgcaggccatctatacaggacttgagttcagtcattgctgccttggcatcttcgttgacattgtacttgcccaaggtcccctcatagagctcctctggggtccccaccagtagtgtttgcaggaagtccatgaaaaactcatcgttgtcctcccctgtggccatccctgcatcacgagcgagatgatgccaggacaggacagggtgactctggtgcaaccacagccctggacctgccccagggctccaacctccatggtctccagaccttccccttcaatgcccacctctcctccccagggcttcctccacaacacctccaactccaccttgcccgaagacccctccacatcccccttaatcttagctgctccaatttccactcagcattccctgggatcaccagggaaggaaagttaagctcctggtgtgggggaaatttcccctgatgagaggctattatgaccagaggcttgaagggtcaggtcaggctggactgggctggggtaggagacactgggctggtgttgggtcagctgggctttgtccttggttggggtggagtagggtgggcgcgggttctgcagggtccttgcccacttctgtgacagaagcaggtggagtgttcactgcagaggcccgatgccaggattttaccttctcaggtaccccccactcccccccacccctgaatgttctggaaaccccagtggcacagactcacggcagatgcagaacagggtgagggccaccagcaggagggcacggctccccttcatgccagcagtctcaggagctgcctccagccagaatcccgggattttatgcctcaccggacagcacctctcctagagggcggaccggacctgcccattaggacccggcagccagcttagatgaggtttgttcacatccctggcccccagtgggtgccaagcagcaacaggcatggagtggctgtgtgacaggtggttggcaagcggctttagggtgtgtgagagagagaacaggtgtgttaggagggaacactggtgagaggccatgccaactgatcggtgaagaaggcagtgggtcctggccaccaagggcctctagtcatgcctgcccttgaggccgagagtggtgggatctggggttggtcccacgcctttcttttaaggtgcgaatccctcctcttatcagtgtgctgtgtgatctgggtctgcatctgggggtctccaatcaggcaggggccccttactactcagatggggtggccgagtaggggaagggggtgcaggctgcacgagtggacacagctgtaggactacctgggggctgtggatctatggggtggggagaagcccagtgacagtgcctagaagagagaaggtggcctgagagggtctgaggaacatagagctggccatgttggggccaggtctcagcaggaagtgaggaatgggacaggcttgaggtacatcttccatcagtagccaggatagcaaggagggcttggggttgctatcctggggttcaaccccccaggttgaaggccctgggggagatggtcccaggacatattacaatggacacaggaggttgggacacctggagtcaccaaacaaaaccatgccaagagagaccatgagtaggggtgtcccagtccagccctctgactgagctgcattgttcaaatccaaagggcccctgctgccacctagtggctgatggcatccacatggccctgggccacacgcgtttagggtctctgtgaagaccaagatccttgttacattgaacgactcctaaatgagcagagatttccacctattcgaaacaatcacataaaatcccatcctggaaaaagcctgggggatggcactaaggctagggatagggtgggatgaagattatagttacagtaaggggtttagggttagggatcaacgttggttaggagtcagggatacagtagggtcaccggtaagggttaggggttaggggtaggggttagggttagggttagggttaggggttaggggttagggttagggttagggttagggttaggggttaggggttagggttagggttaggttttggggtggcgtattttggtcttatacgctgtgttccactggcaatgaaaagagttcttgtttttccttcagcaatttgtcatttttaaaagagtttagcaattctaacagatatagaccagctgtgctatctcattgtggttttcaattgtaaccacattgtggtttcaatgtgtttacttgccatctgtagatcttctttggtgaggtgtctgttcagatgtgtgtgcatttttagttgggctgtttaacttattgtttagttttaataattttttatatattttgaagacaaattctttctcagatgtgtattttgcaaatattttcttcaatatgtggcttgtctttttgttctcttaacaaggtctcttccagagtataaactttaaatattaagaaatccacactgtcacttcttttgtgtatatctaccttttgtgtcatttgttaaaattcattaccaaacccaaaggcagatagcttttcttctattgtttcttctagaaattgtatagttttgcatttttagtgtaaggatgattttgagtgattatttgtgtaagttgtaaagttttcgtctatatccatatcatttcttatggtttccaattaatcgttccctcactatttttgggaaagacacaggatagtgggctttgttagagtagataggtagctagacatgaacaggagggggcctcctggaaaagggaaagtctgggaaggctcacctggagggaccaccaaaaattcacatattagtagcatctctagtgctggagtggatgggcacttgtcaattgtgggtaggagggaaaagaggtacctatgcagaaagaaacaccctagaactcctctgaagatgccccaatcattcactctgcaataaaaatgtcagaatattgctagctacatgctgataaggccaaaggggacattcttaagagaaacctggcaccataagtacagattagggcagagaaggacattcaaaagaggcaggcgcagtaggtacaaacgtgatcgctgtcagtgtgcctgggatggcgggaaggaggctggtgccagagtggattcgtattgatcaccacacatgtacctcaaccaacagtgaggaggtcccacaagcctaagtggggcaagttggggagctaaggcagtagcaggaaaaccagacaaagaaaacaggtggagacttgagacagaggcaggaatgtgaagaaatccaaaataaaattccctgcacaggactcttaggctgttttaatgcacgctcagcccactcctccctatttttctacaataaactctttacactgtgtttcttttcaatgaagttatctgccatctttgtattgcctcttggtgaaaatgtttcttccaagttaaacaagaactgggacatcagctctccccaataatagctccgtttcagtttgaatttacagaactgatggggcttaataactggcgctctgactttagtggtgcaggaggccgtcacaccgggaccaagagtgccctgcctagtccccatctgcccgcaggtggcgtgctgccacgacaccgacagcaatagggtccggcagtgtccccagctgccagcagggggcgtacgacgactacactgtgagcaagagggccctgcagtgtcctcagctgccagcaggcggcgtacgggcaccacaccatgagcaagaggaccatgcagtgccctggttgccagcaggggtcgtgctgccactacactgtgagcaagaggatcctgtcgtgcccccagcggccagaagagggcgtgccccgactacactgcaagcaagagggcctggcagtgtccccatctgccagcaggcgggcgtgctgccactacactgtgagcaagagggccctgcaacgtccctagctgcctgcaggcggcgtgccgccactatattgcgagcaagagagccctgcagtgccccggcgccagcagggggcgctggccaccactgtaagcaagagggccctgcagttgccctagtcgctagcagggggcgcactgggacagcaccgcgggcaagcgggtcctgtagtgcccggctgcaagcagggggcgcccgagcccggctttttggattactgaggttcaacccgtctctgcgccgcgcccccgaggacgtgcgtctctgcgcctacaacgctccacccccgcgctctcgtcccggtggcgcgtgactctgcgtctgcaccacccacctccccccaaacccacagcctaacgacgtgcgtctctgcgcctgcgccgcgcctccccccgccccccaggggacgcgccactgtgcgccggcgcccgcgcgccgcgcctctgtgcgcctgcgccggcgcgccgcgtctctgtcaatttagaaagcttattttgccaagattaaggacacgaccatgacacagcctcaggaggtcctgacgacgtgtgtccaaggtggccagggtagagcttgcttttgtacattttagggatacatgagacgtgtaagatgtacagtcatttggcccagtaaggcgggacaactggaagcaggaagtgggggtgcttccaggtcagaagtaggttagagacaaaaggttgcattcttttgaatccttcatcagccttccactgaatacacaatttagtctggctcaatgaatctgcatttttacataaataatagggcagaggaagcaatcagatatgcatctgtctcaggtgagggatgactttgagtgctgtctgtcctttgtccaaaaggaaattctttgtgggcaaattgtgagtgaggtatgtagctttttatctttgtagctatcttagttaggaatagaatgagggcaggtttgcctgacatagctcccagcttgacttttcccttggcttagtgatttgggggtcctgagatttattttcctttcatggtatcagaacagagaaaaggtaatgcgttgagccatgagcttatgacaagatggctaggaaggaatttttcagctccatttttatgtcatgggaccaccatcatatgtatgcaatgcacgagtgtaaaatcacatttagttaagtcagcttacactaagctatggacccagatggtcctggggcctttttccactgggagatctttaaggacctttcttagcttttctatgctaattggtatattcatagttgccttatttcagggcccattttgttaatgtgtatttttactaggaaatcacccattttttctaggtttccagtttgatgcaattatttgacttttaatttctcctctgtttttagttttgtacataattttcctatctacttttgcactcttttttccatcaacaatatttttaaaatatactttttagctttttttgaagaattgttatgtttgacaattttttatgacctaatcatgaccgtaaatgatttttaattaatttcagcttaatgtcttttgtagggcacaactgttaaaatacagaattacaacaaatgtgggtttgcagatcttaattggcttttttttgtggttctagaatcaggcagcagtccagaccaaaaatggttcagaatgatctgccacacaacatgtgcgggttatatttatagccagaggaaaaaagtgacatacagaaaacagaagtgaggtatagaggtggctggattggttacagacctggttacagcccggatttgccttcttggaacttgttttgaacagctggctgccggccattgactgacactcggctgatgtgattggctgaaccgccgctatttgttaccatgatacattcccaagtcagattttcagtttgtttctatactaaattaggttgcgattcttcttgttcttcttcttttttcttttttgaggcggagtctcgctctgtcgcccaggctggagtgcagtggcgcgatctcagctcacagcaagctccgcctcccaggttcacgccattctcctgtcccggcctcccgagtagctgggactgcaggctgccgccaccaagcccggctaatttttttgtattttttttttttagtagagactgggtttcaccttgtaagccatgatggtctcgatttcctgacctcatgagccacccgtctcggcctcccaaagtgctgggattacaggcgtgagccacggcgcccggccgcgactctttacaaggactcctcgggaggcttccagagcccaaatgttgtttgatgtaagaattcctcccttttggtcagcctctcaattttgagatattgatcaaaactttgggcattggtgtcactctttgttgtcgttgtaaattgagttattaggacttatttgctttcagtgtggcattttcaagttttatttggtctcagtgccctctgggcaatagcagaacactgtgttgtgtaaggcggaaatagagcaatagaaaataacaactgatttgttaatatcagattacttcaagttacttgttttggtaagaattaaagcagaggggacttctttatgctgactcaggtagactggaatctcttcagggaaaaagggagctcttttgggatctatctacttccttagagtttcagcttcgttgtgtgtcattcagcgtgagtgtctccattctgattttgcctgctcagtgtggcctagtgcgggagtggtgaccgaaacaatgacctcccgtagtttgttccacagttctccccttttggttgggttcctgcctaggtgagggtgtgactaaaaccttagggcattagcggtattctcagtaactatcattttaggtttccggtcttagggcattagcactattctcagtaactatcattttagggttccggtcttagggcattagcactattctcagtgactatcattttagggttccggtcttaggacattagcggtattctcagtaactatcattttagggttccggtcttagggcattagcggtattctcagtaactatcattttagggttccggtcttagggcattagcggtattctcagtaactatcattttagggttccggtcttagggcattagcactattctcagtaactatcattttagggttccggtcttagggcattagcggtattctcagtaactatcattttagggttccggtcttagggcattagcggtattctcagtaactatcattttagggttccagtcttagggcattagcagtattctcagtgactatcattttagggttccggtcttagggcattagcactattctcagtaactatcattttagggttctggtcttagggcattagcagtattctcagtgactatcattttaggtttccggtcttacggcattagcggtattctcagtaactatcattttagggttccggtgttagggcattagcactattctcagtaactatcattttagggttccggtcttagggcattagcagtattctcagtaactaccattttagggttccggtcttagggcattagcactattctcagtaactatcattttagggttccggtcttagggcattagcagtattctcagtaactatcattttaggtttccggtctcaacacatcatttaagaagtcagtaaagctttcttctactgtgacagcatatttaatactgagaaagaaaagaaaatttttatcttgcgaatgtgagcttcctctaaattatcaggtccagagaggcgtgggaatgaggcagcagtcacgtcccatttccctcttagctaagtaatcatatcttgaagctgcttgctatgtagactagactgactgtcatcagctatagattaacctaagagtgtctttgaatattttttccagtggcaaatatttgcttctgttgtatcgtagctgaaaggaatgctgggaaacaaaataaagacaagcattcattagaataagtgatccagtcacaatgaatcaatttgaacttttttttttttcacaaagtcatactttgaaaacttccagccgtaaattgaaatagtctccaaaatgtgaatttttttccctggttctaagatgaccagctttcttagagagtgaactacaccataagaaaaatgatatgaccatgtttacacatatatgttatcttaacataaaacatgtaaaaggggcatttctttgaaagtatatattagtctgtataatttactttgcagtatcatgaatgctcttatttttaaaagtaggagtagttactgtcaattactaatttttagtacaaataatttagcagatatctgaaaaaattacaatttttaaatagaggttttattttaaattagttttagattcatacagaaattgggaagaaaatgcagatttcccatgtagacgcaacctagtttcccctctttttaacatatcaacatgtatcagataggtttaacatctttttttttttttttttccagaccaggtttttttttttttcaaccaggctggagtgcagtggcgtgatctcggctcactgcaacctccgcctcccaggttcaagcgattctcctgcctcagcctcctgagtagctggtattacaggcgcctgccatcatgcccggctaatttttgtatttttagtagagatgaggtttcaccacgttggccaggctggtctcgaactcctgatctcaggtgatctgcccgcctcagcctcccaaagtgctgggattacaggcatgagccaccactcctgaccaacatcttacatcatttcttgtcatacttaatgactggatattactatattattaaataagctcacatcttatttggtttcccttagttctgcctttttctctcccaggatcctatctaggatcccataggacatttagtcatcatgtcaggctcttcttggctgtgacagtctctcagactttacttctgaggacctggaacagtgttaggaggattggtcaggtattgtgtagaatgtcctccattgtggtttacttggggtttttctcataatcagcctgggtttaggggtttgggggaagcagagcagatgtgtagtgtgtccacaaaaagagtcaaagactgtaaaatatttgaagagatgtattctgagccaaatatgagtgaccatggcccttgacacagccctcaggagaccctgagaacatgtgcccaaagtcgttggggtgcaggttggttctatacattttagggagataggagacatcaatcaagtgtatttaagatatatattggttcggtccagaaaggtgggacaacccaatggattagggttggggggtggggcttccaggttataggtacatttaaaatttttctgattggcagtttgttgaaagacttactatcaatagaaaggagtgtctgggttatgataaggggttatggaggccaaggttttatcatggagatgaagcttccaggtagcaggcttcagagagaatagattgtaaatgtttcttatcagatttaaggttgtgttgatgttaaatgctgattggcttttcctgaattccaaaagggaggagggcataatgaggcatgtctgaccacctctttcccatcatagcctgaaccagtcttccaggttaactttggtgtcccctggtggagaggtggttgtgggaaagatctttgaattttatttttggtttgcaagtgctagtctagtcacttcatgctctcaagatgtgttatcaccattaatgttaacttttatcacttggttgaggcagtgttttcaggtttttcactgtgaagttacttttttcccatgtctatattgtatgtatgcttttggaggaagtcatcatgcagagctcatacttaaaggagtggggagttagccccacctccttgatggctgtctatatcaggtatttggaattcttctgtgtaagagatttctattcagtccatttgcatatctgtttaatcatttatttataccagtatgggtccacagatagttactttaatcttttggttgttatctaattgtacagtattttgttgctctttgttcatacctgtggccattggtagctctttccactggctccttttacataatttcatgttttttttttataatttatttctgttacttcaaaagtaccctggctcatatattttctgtcccagtcctagtttcagctatttcttctaatagccctgatttcttttgttagagaatggtatgaaaaacttacatctggccactaaatgtggtcattgcatcatgacacttagagctgacagtgcaaagaaatatatgtgtgtcttctaacttatatgtacccacttaattataaaggtttctatgtggaaccatctatgtatatgttaagctaaatgtgagtttatacttacgttgtatatatatattctgactcattatgacagagatcattctaggcttccctattttttatctgtaacttctcgctgtaatagtgaggaacctggctcctactatctgccatttatttcatcccctgtaccattgggaacaaggaattcattcttgatcaagattccaggttgggacttaataagaaatatatgtttggtctgtgtctgcagttcctggtacagagcttctaaaactattataatttcctgaacagtaggggtgctaggagcatcttgtgttctaatatttggtctttggccctggttcctgacgcagagttcctaaatctcttggaatctcctgtataataggaatggcttctgttctaataaggacactctgtgggttcctggatggtttcaggatggggatggtcaccagaaagaccaagccatgataagaaggttctgacttttagcttaacatgcaatcctttgagggtgtgaagggactggaaattgagttaataatccgtcatgtctacatgatgaagcttccataaaaattcctaaaatatggaatttggtaagttccagatcaaggctgacagatttgatgtctagtgagggctcatctatcatagatagtgccttctagcatgtcgtgacatggcagaatggggaaacgggctcctagatgcttttataagggcactggtttcattcatgaggacagcactctcatgatccgatcacctctcggttacctctgaataccatccctttggggattacatttcaaaataggaatttggggtgggggtgtacacacattgagaccataataactagtaaacataagtaagtatttcctagttccataagccatcatagcaaattgtcaaacctgaagagggggtgtaggaatgcctagtttctagccaagtcatatagaagtttgggtaaactggggattcacaacttgtgattggcatctgaggttgtggacagtctggtgttactaagcccttaacctgtagggtgtatactaactccaggtaatcagtgtcacagttgaattacaggatacccaattgttttccagagagttggaatattggttggtatgggaaacaccccccaccccccacaatttgctgttaaaagtggagtgttgatagtatagaggaaaatcatggttatttttctttttacagatatagtagtttcaaaattaactattatccctatgggaaataactttataaaatagagtccactgttcgtgtatatagtacgttttgtttttagtctatggattctactcatttccagctcagcacctttggcccaccacttgcaacatacattggtaatacagttagattcttggttgcactctgtattttgtccttatatacttccacatcctaaataatttaatttgtgtagcttgtgatttgttctttgtgcattaaaattctgtgggttttatcaaatgcatagtgtcagatatccactactgaagtagcatacagaatacttcaaatccccaccccagacagtcactgatctgactatcatctctttggttgtgctttttccagaatgttatatgaatggagtcatataatgtatagcatcttcatactgccaccgtttacttagcaacatagatgcaagattcattcatttgttttcatggattgacagttcattcctttctgttggtgaatggtattccattgcatggttgtacttcaaattgattatgcattcagctattgaagaacgttctgattacttcaagttttggccatgatgagtagagtggctcgtatataattacatgctagtttttgtttgaacataatttttcaaagcagctgtctaaacatacacaatttaggggtgcatttgttggattgtaaggtaagacttgtttatctttgggaaaaactgtcaaactatttcccaaagtggctgtacccattcatgcattctgccattaatgaatggccgtacctattgttcttcaacctccaattgttactgttgagcttttttaagagtcccacagttgtactaggtgtgcagtgatatctcagcattattttaatttgcagtctcctaatgagatatattgagcatccttttgtgtgattatgtgctatctgtatattttcttttttttcttttttcttttttttttattgagatagagtctcattctgtcactcaggctggagtgcagtggtgtgatcctgggtcactgcaacctccacctccgatgttcaagcaattctcttgcatcagcctcccaagtagctgggattacaggcactcaccaccatgcctggctaatttttttgtatttttagtagagagggggtatcactatgttggccaggctgatctcaaattcctgacctcaggtgactcacccacctcagcctcccaaagtgctggggttataggcatgagccaccacacctggcctgctatctatatattttatttggctggatgtctgttcagatatttacccagttttatgtgggtttttagttttcttagtgttcgtttgaagagttctttgtgtattttcaatacagtttttaaaatcatgtttgtattttgtaaatatcttctcacagtgtgtcttgtctttttgttctctgaatagggtttttcatagtagaaaatttagttttataaagtctgttctcagtattttcgcgaattggcacttgatgctgtgtgttaaaactcaacaccagatcgaatgtctcttaggttttcttttagattatttatagttttgcatttgaagttgtagtctctggactattttgagtacgtttttgtgttttaatttgtgtatagagtcatttcattctatatggcttccaaataattcttccatcaccatttatgggaaggttatggatatactggcctttatttcggtttgaatttccaaaattatgacactgaataaactgaatattgaattttataggtatttcaggacagccaggagggggcgcacatccgccgagaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattggtgagtaaaaagctcctgtccacggccctgagtgccaaggagtgagtctttagagtagtcagcagaggaagaaattcatctagaaaaataaagcccccaaatctcactgtttggactacaccctaatatcattgtcaacgtccaagacacagtggctgctaatatatattcttacagtggcctctaatataataatcacactgtgccctacattactatgatatccacaccgtgtcctaacacctatataatattcacaccatgcgctaacactgatgtaatccacaacatcgcttccaatactaatgtaataaaatccacaccatgccctatcactgatctactccacaccatcgcttctaatactaatataataatatccacaccatgccctaagactaatgtaatatctgcaccattccccaacaccaatacaatatccacaccattccctaacactaatctaaacatccataccatgccctaacactaatatattgacacaatggcctctaatactaataaatataataatatctactacgtggactctgttgacattgagacttttttaagggttttacagctttggctgaactatagcctctgtaatggattttgatgatgtgtctgctttcctggcatggtactgacatggttgttttaaaaagtaacttattttccaataatgtcatatttctaggcaacttccagtagtagtacaaagtacaacttgtttcttcccttagattccccaacagttattgctgtaccagatttgcagtgtcccacaaaatactccggtatattgtactgaaagcatggacactctcccaggtaactaccacataacccctagatcaggaaatcagcattgttcctacatgataattcggtccacaaactcacttcacttttacctcatgccacacttgggagtataatgtgttttttttttttttcattacgatccagttttcttttcctggaactgttccccagactttcctgcatatttatgacctggacacatttaaagagcatacaggtttttgtttgaacagttgttttcaggtctttggggtatatacctaggaatggaatcattgactcatatggtaaatctatttgtaacttcatgaggaaacatcaaattattttacacgtaggctgcaccatttcatattgtcacaagcagtgtttaagagttcaagtttctgcacatctttgtcaacacttgttattttttagtataactattcttgtgtgagttaagggttatctctttatggttttaattatggtaatgatgttaagcatcttttcatgtgcttgttggtgaagtgtgtattaaagtcttttgtcaatttttagattgggttgtctttgctatggagttgtaaaagttctttatacattctggataacagacactgatgaagtatctaatgtgcagacattttcttccattttataggttgttggaacgtaataagagttaatgtgtggtctctgctgcagtgtcctgaaacagagcgctaagccttgggaatgtacgaagtaatgtgtgtttcgtatgctaatgaaatgattgatggctgggggcacctggacagcctcagtggggctggctgccaagggaagcaaccttgtcatgagagaatttgaaatttcttcccccgtcccgtctctgtgaaggggagaggtgctgatggttgagttgatcacctatggccacagacgtaaccaatctgcctgtgtaataaaggacagggttgggagagcatctgtgttgctctcccaacacaggagatactgggaggatcatatctggcgagggcatgggaggcctgcattccttccatatacctcaccttgtgcatctcttcatctggcttttcatttgtagtgtttaaaagatccttggtaatgagtcaggaatagtaagtacactgctttcatgggttgtgtaatgtgatgtagcaaattgctgaacccaataagggtgttgtgggagcctccaatctgtagcaaagtcagacagaaggtaacctgggaacctactgtttgtggttggcatcttaagtggttacagtcttgtaactgagtacccatattttcttaaagaagaaatgaattagttttaccattttgctgttcctgcatttagctctttaggaatgcaattataagctttactgtctctccaccagacacttcctatactgcaaacttttccaactgtgtgattacttgtaagttccagggaccaaaccttgaaacaaactggcacttccatatctctcccccaccaggagattggcagcagacaacagtcaatttacaacctggctctgcccgtggtggtgctagcaagaccacctaatggagaaaacatcagagcatgtcccatagaccccgcacctcctcacctcatcccctgcatgccattctggcaagtccgaaggccccgctttctgcccagaaagtggaagcgcttcccttaaggcaagagcctgtatgttcccttcagctaagctctggcataaagtcactttctttttaccatccttgtgtttgtcatttaaatttgcaagcgacaaggggcatggcgtgtattcctaggactgagcccttagcctgtggggtctgatgctttctccatttactgtcacaattggattgcactgtaggacacgcagctggtacccaagatttggtctgtgtggggaaaaaacccatgtatctggtaacagaagtgttctgtgttgagtgttgagagtatactataagacagttgtttttcctattataacattttgtctttcaacttttttcttcatgtcttctgagacataaaagttgtgaattttgaggaaataaattgatttatttttccttttgtggtctgtgcttttggtgtcagatgtaggaaactattgctgcgtgtaaggtcatgaatgcttaactgtacgttttcttccagagtttttagttttcacctgttttggtctttgatccattgtaagttaattttttatgtggtatgaggtaaggatacaatttcatttccctttatgtggatagcaagttgccttacatcacttgttgaggacaggattctttccccaatttactggtaatggaccttgtctaaaatcagttgagcatagaggtattgttttctgtctggactcccaattcaattcagttgatctttctgtttattcctgtgcaaggatcccactgtttttattactgttcctttgtaataaaatttgaaattgggatgtgatcaggatcagcttatccacttctgtcccaaggcctttgggatttttgtaggaataacatcgaatccacggattgctttgtgtactttgggaaacttaacaatgtggtctacaaatccacaaataagatacatttttacatttactggaagtttaatttccttaagtaatgtcttataatttccctcatctaagtcttgtcgtttcattccatttattcctaagtataatattgctattggtattgtttaaggtagaattttcataatttggtgtagagattattcattcctagcatatacatataaaatggaatgtttggccaggcacccaggctcatacctataacccaagcaggttgagaggctgaggaagggttagggttagggttagggttggggttggggttggggttaggcttagggcttagggcttagggctagggctagggctagagttagggttgggttagggttgggttagggtagggttagggttaggggttaggggttagggtttgggttcgggttatggttagggttcgggttcgggttcgggtttagggttcaggtttatggttcgggttagggttcaggttagggttctggttgggtttagtgttagggtttagggtttgggtttgggttagggcttaggggttagggttaggggtgagggtgagggtgaggatgaaggttaagggttagggttagtggttagggttagggttaagggttaagggtcagggttaggggtttgggtcaagggttagggtcaagggttagggttaggggttaagagttaggggttagggattatggtttgggtgaggggtgaggggtgagggtgagggttagggttagcgttttagggttatggttcgggttaagggttagggttaggggttaggggttaagggttagggttagggttagggtcagggtaagggtaagggtaaggattagggttaggattagggtaagggttagggttagggttttagggttagggttttagggttaggattaggggttagggttagggttagggttagggttagcgttagcgttagggttagggttagtgttaggggttaggggttagggttaggattaggggctagggttagggttgggttagggttagggttagggttagggttagggttagcgttagggttagggttagtgttaggggttaggggttagggttaggattaggggctagggttagggttgggttagggttagggttgggttagggttagggtttgggttaggattaggggttaggggttagggttaggattaggggctagggttagggttagggttagggttagggttaggattagggttagggttagggttagcgttagcgttagggttagggttagtgttaggggttagggttaggattaggggctagggttagggttgggttagggttagggttgggttagggttagggtttgggttaggattaggggttaggggttagggttaggagtagggttagggttagggttagggtagggttaggtttagggttagggttagggttgggttagggttagggtttgggttaggattaggggttaggggttagggttaggattaggggttagggttagggtactgtaaataatttcacattattactaataataaattagtatttgtattacactattacataatgtaaaggctattaagacatgtttgtcttcaaagaatggccttggtttctgtgggcagtgcctcctcatggaagggtaatgcattcctgctaaatcatggactaaaccggcttccaggagctacaggctgcagcagcagcttctcctctacgtccttcactgcctcaaactgttgttgactttgaaagcgtctttcagtctagttttatcaacagagctagtatttcatgaggttctactacataccaggttccagaaagctaaatgccttttgtttgttattattctctaaatacaaatcacaactcctcattactcacacaacaaaatttagctgcgggagattgagtgactttcccagggtcacatagctactaagagcagagtcgtgtttagattcatgtgggaatattgaacacagaaatgaaccagtggaaacatcctgtgttccaaaagcctactcaagccatttgttcttattttaaggaaaatctttatgctaattttaaactccaaatacttacgaatggcagagatctacagatttgattctgatgtaagaaatgatggtcaccagctggttactgctaccaccccacaaccccgagcatactggacgaatgtctaagccttgtggttagtggggacaatgctggtggagtctgaagttgtcatgcagtgactcatgcaagcttaggcagatttggtgatatatgacacagagatgcaaagaaatgttgtagctgacacacacaggctggctctgggagatgcagaaggagcacgtcacccaaaatagagccagacagacatccttaaggaaggagcaaaggggctgcatcttaaagaatgtagaaaggatttgtcatgagagatggggcaggaagttcttgagaggcagagggagagcatgagaatgttgggaagggaggagagattcttgcacatctgggaagctgacaatccatcagcatggccagaaggaaaataaggaggaggagcagaaatagatgaggctggatatagaagcagggctgaagctgtgtcaattgtggtaaagagttgtgattctatccagaacgcaataggtagcattctaaacagagatcttttaaaacaagagtcagcaagtattttctgcaaggggctaaatgttaaatattttaagttttccaagccatatggtctctctctcaatgactcagctcttccattataccatgaaagtagccagagacattatgtaacacatgtattggctgtgtcccattacaactttacttacaaacgcagactgtgtcagacatggtccatgcatggtagtttgccacactctgttttagaaagctcaggtttatgatgtgatggagaatgcccacaagagctcttgttttaaacggtagagtgaacatacactggaattctatcctgcttgacacaagctcttgatagcgaaaggtagaaaagatagatggtaaatagatagatagatgatagataaagaaaatacatagctgttccagaaaacagaaatggataacttcatgaaccaaaagcagagtaatatactttagaaaggaagcaggccggaaaacccacagttgcaaaacaaatagaatttccaactgcctcttgtagccccttcctggaagtagtcacagcccggggtgttcaacttcttcctctgttttttgtttgtttgttgtttgcttttctgtggggtttttgttgttgttgtttgcttttaaaaaaaaaattccctttccctgcttttttgtcacagcagcctttgtcacttcaaacaccgcaagtgttctttaaaaaaaattatatcaacctttcaattaaaatgcaacatgtctgaaagttggtatctggagaggtgagttggacaaaggagcccttgttactgcacgttttcattcttcaaatttcaccttgcacgcagtaacagacagtgcacaaagccacttccttatggacggaaattctgaaatccttttatgcctggcctttccatccttcaacttcccctctcccacgctgtgaatgattgtattggacatttttgttttaatgtcagtgacaggggaacacaggtagctctaatatagctgtgacccagatgcttctgtttctagcatgtatttattttgtagcaaacatttacatccatgatgtttcactgtcttttgaaaataattaggcaatatctcatctgaggtaggatgtttctaggggttgtgttctgagggaggaaaactaatctgttctctttccactgcattctaggaacagtaagaggaccttgtgcatgaataatttgtttccacactacagagtgggtaataagcagattagtaaaaacaattctgcttcacttcaataacagcctcctccaactcattttttctcaacaaacttatttttccagcagaagaatcccagacttcttagagaacccagtgactttttgcaccttaaatctgtgaaatccttatgttttcttctgccgtatccatagttcaaacaaagatgaggcaaagctagacgcattcctgaaggaacccaagaaattcctctctttctttctctggaatgaaatgaattctctagaccaccagttctaaccttcaaaaaccaaacctgtttgtgagatctccttcaaatactactgtagaccccagtgtttattcattaaattttttaaatatttgttttatttggaatccatgtatttgtaattttagtgtttgtattaatatcagggagaaatgtttaaatctgtcttatgccatatgtgcctctggcttattgcccaattaattgtagtctcaggctaaactttggtttctgtctttaatttttgtcagaagaaatataactgatctcaaaacatctgcttttattgtaggggcttgtgctgccgtctccattcttctctcttttcttgcaatctgggtggaagttctttaatatgaacatttcaaccaccttcattctaccatgtccactatcagcacattcaaactgatccagccaaggctgtcatcttaggccagggattttttaggaatctattttgctgtgatgcggctggcacccctttgactcactgtatcaccccagggttcttttcatttcagaagcccaagagggcagaaaaagaagtaggtgagcaattaaacactctgagtcaggagcgtctccccttgcgttaagcaatgttgtagaacatcgatgttctacatcgatgttggcgaccttggtaccattttgtccacttgattggaaaagccagtcaataatttcaggtcactgttggccttagaagaagagcccaaaggcaacaagcaaaggcgctggtgtccagtcgccttctagaagcattttcactttcccttaaggtttcccttgatgaacatagaagtactgtatgtagaattgacccagtgctgccctggcaactttgtatattaggccaaatttacatttcttacctttatgagaggcaccctggtaggctagtggagttacacacaaagtctgatctcagctgcactgtccagaaatgcaacacggtccaatcaaataacattctctgagcctgtttctttagctgtgaaagaagaataacatacccatctaaaaaggcagcttattgtatttgattggtcttttattttctatgaaactgtgtttaacacagtaattattttcatttgtgtactacatttgtgttgtgtttttggttttagttttgtttttgaaatggagtcttttttttagtggttttttgttttgttttgttttgttttgtttttgagatggagtctttctattgtcacccaggctagagtgcagtggcgtgatctccgctcactgcaacctccacctcccaggttcaagtggttctcctgcctcagcctcctgagaagctgggattacaggtgcccaccaccatgcccagctaatttttaaaatatatttttagtagagatggggttacaacatgttgcccgggctggtctcaaactactgacgtcaagtgatccacctgccttggcttcccaaagtgctgggattataggcatgagccaccacgcctggcttgttttaaaataagggtttcttggctaggcatggtggctcacacctgtaatcccagcactttgggaggccaaggtcagtggatcacctgaggtcaggagttcgagaccagcctgaccaatatggagaaaccctgtctcaactgaaaatacaaaattagccaggcgtggtggtgcatgcctgtaatcccagctactcaggaggctgaggaaggagaattgcttgaacccagggggcagagattgcagtgagctgagatcgcaccattgcactccagcctgggcaacgagcaaaactctgtctcaaaataaaaaaaagatttcttaaaatgatattttcagtattttatagatgatgtgtaagcagcaagcttaataggatgttacccgacactttgcgagactggcagctgatttgatccagatgcctctaattcttttttctttttctttttctgttttttttttttttttgacagagccttgctccgtcccccatgctggagtgcagtggcacgatctcggctcactgcaacctccacctcccgggttcaagcgattctcctgcctcaggctcccgagtagctgggattacaggcgcgcgccaccatgcccagctaattttttgtatttttggtagagacggcatttcaccatgttggccaggctggtctcgaactcctgaccttaggtgatctgcctgcctcggcttcccaaagtgttaggattacaggcgtcagccactgtgcctggcccagatgtctctaattctaacatgagatgtattgcaggatcatagcagagtgagttgctgatgtatccagaaggaaacgagcatggaacactcacgacagctgtcctgagaagtgtgtgtgtgctgtgcttgaatatctcactgctcatttatacacaggctttctggtgactgagttaacagtatctgtttcataaataatgtagccctctttctttctttctctctctctctctcttttttttttttttttttttttttgagacagggtcttgctctgctacccaggctggagtgcaatggtgcagtctcagctcactgcaacttcaccatgcctggctaattttttcttttttttttttttgagacggagtttcgctgtttttgcccaggctggagtgcaatggcacaatctcggctcaccacaatctttgccttttgggttcaagggattctcctgcctcagcctcccgagtagctgggattacaggcatgtgccaccacacccggctaatgttgtagttttagtagagacggggtttccctatgttggttaggctggtctcaaactcctgacctcaggtgatctacccgcctcggcctctcaaagtgctgggatcacaggcatgagccatcactcctggcctaatttttgtatttttagtagagagagggtttcactctgttggccaggctggtctcgaattcctgacctcaagttatctgcctgcctcggcctcccaaactgttggagttacaggcgtgaaccaccatgcctggccagctctatttctttaagcctacatgttttgcacttgttaaaagtatttgaacatacaattactcagcttcccttgtttacgcgtgaattttgtagaatcttaaatattttttccaatctaagctttattttatcccgtttcttctatatttgtataactttaggcggctatcttcattgaaagttttttctcaaaagccttaagatagaacatagttcttggcagcaatttgaaagttatttgaggagaaggggagacttacaatgatgattcaaatgaaggaaactaaaaagtaatgaagcaaggcagaggaaaaagcagtactcacttgagcacatcccaaaagaataacatttcaaatgtaactagaaaaaagtatgctgaagttcgcaatacagaaataattattaataagatagctttaaagccctgctcagcttttgaatgttgggaattgacccagaggtggctgtaacctaagatggttccttcagtaatgaccattttttctttttcaagatgatgattattccccaccttctaagagacaaagaccaacgagccaccacagccaccagtcccagaacccgccaatgctggggaacggaaaatgagggagttcaactctggtaagttctcagcgaaatccatgaccttttcctttatcttctggactctcagtgtgattgatgaaagttaccacatgctctgcagggggaaatggtttagcatgtgttactacatcttaatcacatctttgtaaagccaggagcattttacaagtcacgttacagacattgtttaaacatagtctgtatttaccaaagtataggacattgtatcatctcatattaattagttagttggctcaaaattagtgctaatgacttagtaattcagtgatttctgttagctttaaaacctttatttcagaactatttcacctcttggttttcatttttgcggtgtgtcactgcctgccggctgctaatttattaactcccagtgaatcatgtcctgtgaagggactgaatattagtggcaatttatgttgatgatttgtattttgaatagtttgaatacatagaacattaagcttgtatacattttgaaaatagtattttaatattctactgtgtcatagttacaatgattggatatatgttgaatttatatgtactttgagttgttctatgtttatggtctttagcattctaacgtgcaattgtatatctgttaagtcttttttttttcgagattagactgatttattgaggcgtctgtttgatgccacattaagtggcccaggctttgtgtagggttgaggttaaagcaggaagaagggtggtgagaggcggggcaccagggttaggttggaatacctgggggtgctctgaggctccccaagtttccctggtcttggccggctgtgctgctggcctgggcatctgatgggcttgcaagggtggtccaggggctagggcagggactttggagtgacgccgttggctttgaatccagactcctacacttggtagctgtgaactctccatgcctcagggacctgcagaactgagctctgtctgagccaggttccatccaggcactgcgcatccatccagaggggcactgcctcaggctgctcgctgttcactgccttctcaagcagacccttgtctccttctaggccctcacaatccagtggaggagacgaaactcatctgcctctgtccctctgggcacgcctcgtgccaggtgcatctgtggacaggggccatgctcctgggc

SEQ ID NO: 717 - DNA, 17269 bp, Homo sapiens
gacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcagcgcgggcacccccgcggcccctcccctgggcgcgcgcgcgacctgggtgccatggcggcagcggcggtgacaggccagcggcctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtgaggacctccctgccccgccgcgctccaggccctgcacggctgagcccgagaggaccggcgctcagcccgggtccccacgctgcccccggcgctgctctgcgtcggtcccgcgcgctcccactcactcgcctgctgtcgctctccgggccggggcgacttggcccttcttgggcagcgcggtctggcgccccagctgcccgctgtgcgccttttccttaggtggggcacgagcgtaaggtccagctggtcaccgacagggatcacttcatccgaaccctcagcctcaagccgctgctcttcggtaagtccgccagatactcctgggaagggccaggggctgcggtttggtggccaccttgaggctcgttgtgaccacgtgacctctattttgaaaatggctgcttcagagcagcccttccagaggattaccaaagtgaaggaccttccccgtcctcgaaatagggtaacactccctcttatcccaactccctgcagtccattcttccatcacagggctggcagggtgagcctgaggctggtgtctaaacgtttcattgcacctgtcttccgtgccaccattaattctgtcaccttctagaactgggaggaaggtgggagactgataaccagctttctgccgacctcaggacctctggggaaaatcccactgccgaagtgggccttgtggtctgatgagaagcaggccgtccaaatgtagataaactggtacccccccagcctcctccactggagtaccagtcagaggctcagcttttgctgccagcactctgagattcttcttaaggtgaagtctttgttcagccatcatgggcaaagctttctagggtgactccagttggagccacaacatagctcatcgtttctgagctctagttatgtgcttgccttcatatgattatttcatttaattcctgcaacccctctgtgaagtgggtgtagatcctactcaggccagtgagggggaaagttagggacagagagctgctgtggcttggccaggctgacacggttacttcagtggtgaagctaggattagaacccacatagcctgcctctaaggcctatgcagtaaagccacagtgcgagctgtgaagaccccagagtccttcaaagaccaccagtgtcaactgggtggggacccctagtcccatggacattgtccagggtgtttgtgtagcccagccctgggtacctggcctccgtgacaaacatatttgcaaacccagggccattcctgcctgccgggggatggaatgggttaggagctggggccaaagtagaacatctgagcacaagtcattacctccaaggcagagggtcctggttggggattatgcctagacctgtcagaatgatgtcatatgcatgctgtttgtagggaaatagattatgctgtcagtcctgttgtgggagaggcacccaaagctggttgttgttattattactattactattgagtaacgttgaagtctgtgccaggcactattttaggtgccaggaacacagcattgaactaaatataaacaatgaaacaaaaccctgaagctgacattcaaatgaagaggaaacagacaataaacaaacaaataaatatatacattggtgtgtcagatggtgatatgtgattgcaaacaagtaaggcagattttttttcttttttcttttttgccaacataaaatagcagacagggccgggcgtggtggctcatgtctataatcccagcactttgggaggctgaggcaggcagatcacttcaggtcaggaatttgaggccagcctgaccaacatggtgaaatctcatctctactaaaaatacaaaaattagccgggtgtggtggtgtacacctgtaatcccagctgttcaagaggctgaggcatgagaattacttgaacccaggaggcagaggttgcagtgagccaagatcgcaccactgcattccagcctgggcaacagagagagacccctatctcaaagaaaaaaaaaaatagcagacagtaaggcagaagttcagctgggattagaactctttttttttttttttttttttagactaagtttctctcttgttgtccaggctggaatgcaatggtatgatctcagctcactgcaacctccgccttccgggttcaagtgattctcctgcctcagcctcccaagtagctgggattacaggcatgcgccaccacatccggctaattttttgcatttttagtagagacgggctttcaccgtgttagccaggatggtctcaatctcatgacctcaggtgatctgccctcctcagcctcccaaagtgctgggattacaggtgtgaaccaccatgcctggctggaacccttaataaggtagccaaggtggacctgcctgaaaaaaatatttgagcaaggctgggcgcggtggctcacgcctgtaatcccagaactttgggaggtcgaggcgggtggatcacctgaggtcaggttgttcgggaccagcctgaccaacatgggggaaccccgtctactaaaaatacaacattagcagggcgttgtggcacatgcctgtaatcccagctacttgggaggctgaggcaggagaatcgcttgaacccaggaggcaggggttgtggtgagccaagattgtgccattgcatccagcctgggtaacaagaatgaaactccatctcaaaaaaaaaaaaaaaaaatctgagcaacgacttgtgggaagtatgggataaagccagatgactgtcaggaaagaggggtccaggaaggaactaatactcaccccattactactacactactaacgactactatgaacagacacatctgaggaggcactgttttctctcagcagccttcctgggatctgtatatatctaattcatattgatgttaggttaagtaagccatgaagccaaagtctccctaataaacagcttgtcctataaagcagagaatgagccgggcttggtggttcatgcttctaatcccagcactttgggaggctgaggcgggtggatcacttgaggtcaggagttcgaaaccagcctgaccaacatggtgaaaccccgtctctactaaaaatacaaaaattagctgggcatggtggtggatgcctgtaatcccagctattcgggaggctgaggcaggagaattgcttgaacccgggaggcagaggttgcagtgagccaagatcgtgccactgtactccagcctgggtgacagtgagactccatcacaaaaaaaaaaaaaaaaaaaaagcatagaatgagaaacccagatctaaagtcaccaagggcaaattatgaaaagcagaagagatttgacaaaaggtaaactggttctggttaagccatcagatggatctctgtttctgcagatgaacttcaaaaggcataaccaagagattgcaatcaatgattacaggaagtccagatgtgtgagagggaagagggtggtcatggtggggcagttcctgaatactgtggtattggatgactacaaagaaggatgcctcatccccagcaggagcagtgtctgtcttctgggcctgcctgtccctctgtccattggtctgctacccagttattctaaatgggcaagcagggcccaagaagagtggacctgctatagattctgccccctctgccatgctgttcttggatctaaacctgtgacctgccagcttcagggacccaagatacctgggatcgaagagtggatgctaaagatgtgagctggggcaagggaactggggtccaccccaaggtgcctccatctctgtagaagggaaccctagcacttctcaaggaagaccccgtgcagcccccagtctctccttgagaaatatttcctgtttcccacccttgtttctaaagacacttggcaactgggacctgggccacaaaaggcccacgcttgagctcctggcaaatacttccatgactggtaggtcattttcccttggtagggaaataaaggatttggaatattgggtgtcagctgagggcaccatcctgttcagaacagaagtgctccatttctgaaccattgccacctctctggggacattgctttcttacatgtggcccacttctcccgctgtcctaccccaccccacactgattctgtcatagcagatcagatctcatggctctctctttttgttttgttttgttttgttttgtttttgttttgagatggagtttcacttttgttgccccggctggagtgcaatggtaccatctcggctcactgcaacctccgcctcccgggttcaagtgattctcctgcctcaaccttccaaacagccggaactacaggcacccgccaccacacctggctaattttttgtatttttagtagagatggggtttcaccatgttggccaggctggtctcaaactcctgacctcaggtgacccacccaccttggcctcccaaagtgctgggattacagacatgagccaccgtgcccagccgctcatcactctcttaaatgtctccaacattttccatttcacttctaagtctcatttgatgcctaaaagccctctcgcctcttagactcatctcctgcccccacccccgactccatttactccctgctgatcctcagacaccacaagctcactactgcctcagggcctttgtatgtactattccctcactaaaaggcttagacctggctcttcccacagagcgtgccttcagctccagcaggcctctgctcacacatcccatcctcagagacctcttgtcctcaaacccatcttaaaaggttcccaggcaccctgttgcatcagcctgctgggttttgttctcaaatgcttaggactgctggaaactattttccgtatttatttgtgtcatttgtacctctgcccacaaaggtgagctgcatatgtaagaggactgatttgtctcagctgtgtgtccaatggccagagttgtatctcctgctgatttttttttttcttttgagatggagtctcgctctgttgcccaggctggagtgcagtggtgtgatctcggctcactgcaacctccgcctcctgggctcaagccattctcctcctgcctgagcctcctgagtagctgaaattacaggcgcctgccaccatgcccagctaatttttgtatttttaccagaggcagcgtttcaccatgttggccaggctggtctcgaactcctgacctcaagtaatccgcctgcctcagcctcccaaagtgctgggattacaggcataagcctccgtgcccagcctcccgctaattcttggctggctggaggagttcactgggtgctctcagcccagtccagcatctgcctgctggcttagagcatcctccacgtatccttctgacttggcaccctcttcaaaggcagcagggggtactaccagtggccagcaagagttttaatccatttttcttaacaatttgaggtaaatgagtaattgccaccagtatacaaaacaatttattttaaaatcatgactgctttatcttaggatttctaaatgtattctttttcagcttaagaaaacaattaggcagctacatcagaccatagtcctcctcatgacaaacactggaggcccaaaagtagagaaacaattttagtgtgcgtatcagttcaaggttgttgttttgttttgttttgttttttgagacggaatctcgctctatggccaggctggagtgcagtgtggtgcgatcttggcccactgcaacctccgcctcccgggttcaagcaattctcctgcctcagcctcccatgtagctgggactacaggtgcgtaccatctcgactcactgcaacctccgcttcctgggttcaagtgattctcctgccttagcgttccgaatagctggaaatacaggcacccgccaccacgcccagctaatttttgtatttttagtagagatggggtttcaccatgttggctaggatggtctcaatctcttgacctcgtgatccgcctgcctcagcctcccgaagtgctgggattacaggtgtgagccactgcgcctggctagttcgagtttttaaggaatttagctcaggctgctgcattgccacacacacccctgctctttcataggcctgctgcttggcaaagctacggaccggtaaaggttaatcaggtataattaagtctgtccggggttcgacaaacagcatcttgtccaaggtgagcatagcccaaggctatgtgcctgcccggagactcagcttggggttccgaggcatgtgggcagtagtagcaggccactagccaggctgtcatcctaggcctgggaaggacagaaggtggttttccctacccagcatagacagctgcctgggagcctgtctgtcctcttggccagacagaggactacctgctcaaaaagcagttcctagctgtgtccatggaaagtgtacttccaccctgtttgagacttgtgcctctctggattctggtttgtaaatctccttggggggcggcagaaagagggttgtatgtgtttccatggaagcacacacaatttgcatggccactgcagaggccatggctacaaagtcccaggctctccctggcggggttagcccctattcttggcactggtgagggtgccaatggcgcacagccagtcgaaaattttggtggccctggctccaggcataggccgtggttaccaacagccagcaggcctccatcttcccactcaacacataggtccctgtgtgccttcctcgaaaaagattgtacacacatgtgacatccagctgcagccagcgttgcagggtgggctccagctctgcagggggcagtggtcctgtcttcagcacctctagtctggagtacaggttgcagtcccaggggccagaggaagtactgttggtcctggagaacctgaccttcactgctgagtgggaacagaggggccggtgaggagatgggcctctaggagtcctccctaaacccccaagagtgtttagtccatcagtcccctccacctagtagactaaacccttttgtctgatgctctgcccttagaatcagtctgccaccttccttagcagaatttttggtttcattttgttgttttagcaatgtcctatgcttgtaaaggaattttttctttttgttccaaccaggcatagcatttggatattccctcttacactgcctcagccccgagccaggagctgcaatggaggcacttggaaggggtgtgtaaagctacaggcccaggactcatcaaagtcactggtgcagagagtgtccagaacctccttggaggagcctgcatcctgcaactcgcagtccctgcagctggcatgcagcgctgggaagaggggcaaggcgaggcactggccagtgtggttgggggtggagtgaggagggggtggagggggctgatccctccacttttcccccttttttaccctttttgagacggatgcctgctgtaggtgacattgagtacagtttacctgatccctgtatgatttgaatgatttgaaaggggtggggccgagcaaggtggagaccagccatgtgcagactcacatgggcggtccaggcgggagccgttgttggccacagcagtgatacagagatcatggcccaaggggaagcgtccacaatgcaggatggctggccaggggtagctgtagcaggccatgatgggctcgcagctggcctgcatggcctcgcacaggctgtaggaggggtagatgaccctttgggggaaagggtcgggggctgcaccgccacaggctgagcacccagatcagctggaacctctccatgttcctacccctgtctcgtggcctggaactctctggttgctgggcaacgacactggtcgcctagcaacagccccgtagcctggctttcccacttgccccacatctcagccctcagctctgcctcttcactcccgccctcccactcaggtgccttgccagctttccagtgcacctctccctccggctctgtggacatccattgtctgcaagaggtggcctgcaccttgggcctttactctccatcttaaagtgaggaaacagggccctccctcttgtcctgaaaggccttcggggcaccgcagccagggctggggttggcaaacagttcaagggcttgatcctgagttctgctgacatggccacccagaggctcttgggagaaaccattgttcacaggataggttaggctggggaagaggaaacagccttgggatctctggactctctgggagaaaaggccaccagaagggcctctgctccatctcttgccagggtctctttggacagacatagcttccacgcctcattggagaggaggttccagcccgcctgcccccaacccccagcctgaagcgacttgtccacctgccctatcttgacattcaagagcccttgaccaccattgatggtctcctgcctaagggcacctggttccctctgtctggaacactctaacaaaacgatccattttcctctctgtgcctgtcagcgcccagccctgataggtgctcaggtgctcagcaaggattactgaagacctgagccaccagagcagggccctgagggagccctccagggccctgcacctggaagcccctgtcctacctgtcaaggcatacaggggtaaatagcagaggaagaggcgggcatcggggtggcactcccaggcaagcaggagcagccagctgaccaactgctggatggcctcagctgctgtgatgtggtccagcaagttgggcagacgcatctgtgtagccaatgtcgtggcatagggccatggcttggggaatgggcatgcacctcatgcagccccagggagcccctgaccctgctgtcatcccacagcatcaccagtgtcaccagcagccacagcccctgctccatcactgccttctgtgccttggccttaatgaactgaggttgagggttttatagggctgttcctgcacccagggagccaacagaggagatcctgcaggggtttgcacagctccgaggtgcccggacccacctggtgaggccccaacatgctgactgggctgtttgtttttgattagcacacagcaggggactgtagaggctggaggcacctccactgggcttgcagattactggcacctaataaactgaagaaacctgggcctgtgttttcttttctttttctggcttcctttttctttctttttaaattttgtgtgttaagcaatcaagaggtgactctgttgatttgcaatttgatctaatccattgttccacagggctgtctccccttggatcacaccctttctgggtttgctggggtcacgggatcatgcaggccaagagtgggggcctttgtcctatcctcagtgttatcacatcagggtcacctgctcctagtagctgaatctggtcatgagcatggtttctggaacacagcaggctgggtggccagtggcaaggcactgatttctctgtgcttgggtttcctcttagataggaaggttgaattaatggggcctggcctcctagggtaagtataaggattaaggagttgatgtgtatgaagtgcttaggacagtgccttgggcagagtctgtgctacctaagtattttctgctgtaattactattaaaaaccactccaggccaggtgtggtggcatatgcttataatcccagcacttttgagcccgaggtggaaggatagcttgaacccaggaaattgagaccagcctgggcaatatagggagactccatctctacaaaaaataaaaaaataaaaaaagctccaaccctggtgctgagtgaccattttccttcctcttggcaatgactggaactttgtgctggaagtgtaactgagagaagcggcaggccactccgcaggtagcagtgctgcccttcctccagtcagctcctctgcgtgcttcttgtcctccagtgaagaccgctctcccaggaacaagggaaggaagcagggcccatgctcctgctctggaagtgtctggggctaccagaatgtgggctccctagatgtgaggctcaggttctagctccaccaagccacctaccagctgtgcctggtgtgcaggcagccagccactgaagccaagccccaggcctgactgatctttactcaggggtgtagaggcatagagtaggcactaagtgaacatttgtaccagggaaggaatcaaggaagcaaaggacacctgggacatcttttcagagaccagtatctgcccaaaacctgagtaaccctcactgatcttccagcactgggcaactcagccctggtcagatggccagcacccatctttgcaggaaattggaggggaaggcccttggactggcctgaaacattggatgtcttgtgctgtttttatttgaataatgctgaaaagttaaaatgaaagcaagaagcagccaccatctccccactttaaatatttatacccagtaaaaagtagcaatcaagcctctgcccttcaggatcactctctagccttcagtcccaacccaaagatgggtcagcccatatccaggttagctctggctcacctcccagggctctcctggaaaatgtgtgctctcatcatcaagagaggtcccacatttccaacgccagccagcctttgcaggacaactcaatcttgacaagtcagaatcaaggggtctgtaaaatcctccatcctccagacctggtggccactgagggacatgcagtaccccaggaaccctgaagggaggaaggtactgggtgcaccagcgccctggctcagtccttggcctcacccacctcctcttctggcagaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttggaatcctgggacctgagtaggctcagggtgggagtgcccagaatcacctttctggtggccaggtcacttgtccagcccaggcctggtcccaaaagtcagatactacccagacctgcctgggcatgcccagacccaggaggtcccctttccctctggagagctcttggctaccctgggaacctcagaagatggcaggagaatccacctgggggtgatggcatttatcaccatagttttggagggatgcacctctgtagcctgcattccttgctctcatggctgggggccccacagaactcatggtggatggggtggcagctctgaggtggccagcagcctgcctctctctctgcataactctcacacactctacagccaggctggagggccaagcttctgagagaagtctggcagggtggtggtgcggggcactgcccacacagaacaccccactgagcctggtctttctgagggatctggtggtcatgccctaaccaggtctccccctggtgcctgttctcccttaacacccaggacttggctttccccatctcacccggagtatctgagtgggacacaggcctgtccttcactctgcttccaaccaacagtgctctccatgaaggccacggggccttagtccgggaatgcaaatggcctacgcctcttgacccccagcccccggccttctcctcagatgctctgtacctttctacctgcactcactttggcccaatgggctctgccctgtgtcctcatccatgccctcacctgaacactttgctccacaacaagcactgggccatctgttctctgctggctctccatcactggggtcacccactgagggaccctcttatgctttaggttctggcccagactcgcctgggaaatggatggtggatgactccagagagcattcaggagatgtacgccgcgatcaaggctgaccctgatggtgacggtgagctcacacctctgcacagtcctatccccgtgagcctcctgcccactcccaggtgcacaattttgaaaacttgggcccttcccccacagccaggcagcctctctgcacccctttatagtggccagagatggggaggtgaagatccagccttgctttttacccctgggaagtaggcaggcagccaggccccccgttccccttggtgatggtctcgagggcagttcttggagacccttttgataacatcaggcagagttgagagcctggggacaggaagtagggctgctagttggcagagaacagagtgggtggagcaggagcaaggcgacagtgaggccagctagagcttggctgtttaccctgctccatccatctctccagccagacacgaggtccaccccagcagacagcttccctggtctaagtgagatctcccttgccttcctcttgtccacctggagtcatgccgaagcgcctaaaatggtagtgctgctacctgtgctaactgctggggaggggtgggcagggaagctgtcatgcaagtggtgccccctctggtaataactctcaggaggtttctgaggtgtggtcatcaccctcatgcccaaattctggaccaagagaggaagatacagcagttagaaaggacttggaacagtggctttgcggctggtgaaccagagtgaagaatctggccgtgacctgtggctggatggctgccacactgctataggccccagaacagaggtggtgacagtctcacagcccttgaatgtcccccaccctcagaggaatctgggccaaagagtggaaggtgatgtccttgggtcagccagaataacatggagcaaagataccaactactcttccagaaccccaagagggtagaacccctgcttaatggtttgagcagggacagtggagaatgttctcatgagagggggtggcctgactttcgttgctaaggtgggctggtaacgcagtaggcagggctggcgaagtaggttccacccaggatgaaacctggggtcatgaggaactccccgggggctggccctgcttgcaccctggcgtatgtatgtaaggccctggatgaggcccagcactgcctgctctctcctcaccctccacaggccggagagtggccaccactctatatagccaggctggaaggccagggtcctggccatatggctcaagcttcctttggagaaccttctctggccactctaatagggggtgggcctctttcttcttagggccaaattagggcttaaactgagaaaaggaactgctctgggtcttcctgtaaggcctgatgtgacagaaaccaggttcatctgacccaaaagtccaggtgggggacaagtgtacaaggcccctcagtgcctgaggtcaggggctgctgctgcctttggggtaggtagggaagtgcagcctgccactgttgcctcccaatatgggcttggtgggcattgatggtgggtgccctgtgcaggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagaggtgagcacctgaagctgttctcactggagcagggggagaagactgggcagggcctccacagaagtccttgtctggggccaagaggacagaatggattaacccatttgggattaagttccatttgttagaccaggattgggacccactgaaagacaggcaattaacaaaggcaaattagccctccttgcaggcacacaatgggcaactggggttagatagagattgagcacttctttctgattagataaatgacctcttatctttgaccccttatctgaccccgtcacagcaggaaaagggtttttaaataaacaactttcttccagggaggaggacctcaggactccccgccccctttatttagtggaaatgtcaacatttccacatagcaggtgtctctgtctttggcatctgagggagaaggatcatcatgagtaaccccctcctgctcttacagggccagtctgagatggcttaagggacttccaggggaggtgggtaggggcaaagcttgtggcaggcctagggtccaccttggccagctccttcagatcaccaccttgcctggggctgcccagccaaatgcctgctgcccaccagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggttagtgatgccctcacctctccccacaagttgtttacccaatggctggaaaggggtggctactggtcatcgtgaccactggagtcaacacagactgatgtacccacagacaccaaaacttgccccctgagttctgaagcaaggggcaaggctgggcccctagcttgtcctgcccattcctccaggtgttgatcttgattccacttagagaagctgaagctgtgcctccctcccctgtcaagccagttctttcctcttcaggtggctgttctggcccagccccttcccatccccaaggagcccttcagcgcgccctgttgcttctgctagcctacctttccctgccaggcccttgctcagggccatggcatttaactaagtgcacctgtgatcttggccaaaaaaccattgcaactcacagtaagagactgggtttcggggaaggaggggctagggacattttggcactggcctgccctattgtctcccatcctagtctgtcctggtccctggcaacaggaacctgggcagcttatcctgcccacaggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatggtaagggtcaactgggctattactcttgtgggctggcaggggcttagacaagtgaagtacacacctctccaggtctaaggatgtgggcccaaattattccttgggcatatctggttggtttccctttggtcacccttggctggcctggccatagagtggggacaggttgaacaccccaccaccctgctgcccacagagtctgattcaggatgacgtggacctccgtgacacacggaggcactgtgacaagggaaacctgcgtgtcaagccccaacagggcacagcagtcttctggtacaactacctgcctgatgggcaaggtgagggcctatggccaggcctggggggggtgccctgagtacagcttccctttacccagcccccgtctgccacaatggagggctgtttctggctgctttccaaatagttttctgctcctggtgcctcccaaaggccatccttagtgactttagcagactgccccaggacctgtactgcttattgggttatatccatccctatcattccctgatgccccagccttcctactccctggggcttgggacacatgtcccttgctaacccaggatgggaagggatatggacaggcccaacagcaagaaagctggtttcagagggccagtagtgttgactatacattagtgggctgagatgaggagcctccaaggaagctttaggtctgggtgtttgctacacaaggaatgcatagctggacccaccttggtcatgctcttggtgcctatgaggccaagctctggccagcccagcctaggatctcacgtcaccctcctcttctaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggcccgacaaactccgggtcggcgaaacagag

SEQ ID NO: 718 - DNA, 7439 bp, Homo sapiens
gcttgcgcgttagagatcgctgtccgctcttcctattggttcgtttttaggagctcggggaatacgaaatatccagccaataggagcagagatgccggaaccgggcttgtgtgcctctgctgaggtgatctggcgcagagcggaggaggtgcttggcgcttctcaggctcctcctctccccttgcggcctttctaacgttggccctgctcttgtggcctcccgcagaatgtggatgacgcccaaaagaagcaagatggaagtcgacgaggctctagttttccggcccgagtggacccagcgttatttggtggtggagcctccggagggcgatggggccctgtgcctggtctgtcgccgcctcatcgtagctacccgcgaacgcgacgtcaggcgccactacgaggctgagcacgaatactacgagcggtatgtggcggacggcgagcgcgcggccctggtggagcgtctgcgtcagggcgacttgcccgtggcctccttcactcctgaagagagagctgctcgtgcaggcctcgggctctgccgcctcttggccttgaagggtcgcggctggggtgagggggactttgtataccagtgcatggaggtgttgctgagagaggtactgcccgagcatgtaagcgtcctgcaaggcgttgacttatctccagatatcacaaggcagaggatcctgagcattgacaggaatctacgcaaccagctttttaaccgagccagggactttaaagcctattctcttgccttggacgaccaggcttttgtggcctatgagaactacctcctggtctttatccgcggtgtaggccctgagttggaggtgcaagaagatcttctgaccataatcaacctgactcatcatttcagtgttggtgcgctcatgtcggcaatcctagagtccctgcagacagcagggcttagcttgcagagaatggttggactgaccacgacccatactttgaggatgattggtgagaactcaggactcgtctcatacatgagagaaaaggccgtaagccccaactgttggaatgtcattcattattcaggatttcttcacttggaactgttgagctcctatgatgtagatgttaatcagatcataaataccatatccgaatggatagttttgattaagaccagaggcgttaggcgacctgaatttcagactttactaacggaatctgaatcagagcatggtgaaagggttaatggacgatgtctgaacaattggcttaggagagggaaaactttaaaactaatattctctctaagaaaagaaatggaagcgttcttggtttcagtaggggcaacaacagtccacttctcagacaaacaatggctttgtgactttggcttcttggtggacattatggaacaccttcgagaactcagtgaagaattacgagttagtaaagtctttgctgctgctgcctttgaccatatttgtactttcgaagttaagctgaatttatttcaaagacatattgaggaaaaaaatctaacagactttcctgccctcagagaagttgttgatgagctaaaacagcaaaataaggaagatgaaaaaatatttgatcctgataggtatcaaatggtgatctgtcgtctccaaaaagaatttgagagacattttaaggacctcaggttcattaaaaaggacttagaacttttttcaaatccatttaactttaaacctgaatatgcacctatttcagtgagggtggagctaacaaaacttcaggcaaacactaatctttggaatgaatacagaatcaaagacttggggcagttttatgctggattgtctgctgaatcctacccaattatcaaaggggttgcctgtaaggtggcatccttgtttgatagtaaccaaatctgtgaaaaggctttttcatatttgactcgaaaccaacacactttgagtcagccattaacagatgagcatctccaagccctgtttcgggttgccacaactgaaatggagcccggttgggatgaccttgtgagagaaagaaatgaatctaatccataaggctttgtagtacaagattgaaaaactcaacaagaatttaattctaaaagcaaaaattggtttgagttttcaagtttactaatttggattgtgagaaagtaccaagtaccagccgtccaaactgatcacaattaaaattctgacagttgccttttttttcatctcaaatggcagcatgggactgaaacatgagaatgccaccttttttaaaacttagtttagtgacaaagtcattgtcttttatgatatagttaattttaaagagatttagtattaatgtgagttgaatttgcagtctgttttttaggtgttctgaagataaatgccaaaaatttcagctcttattttaatggagtgttaaaattctgattcatatagtcttaaattatcaactccttaaatgtgcttttgaaccaatttgcagaagctcacatagcaagttcataagtttccaaaaaggaagcccatacataacagtggaggtgttttgtctaaccatcaaaatgtttgagacttttttttaaacatttctgagttcgaaggtaatactgacagatttcttccctcttccctccccatcacccacctcagtgataacacattactgatagaggaagtcattagaatcatttttaagtttcagatataggagacttcatgcaatttggagataagactaattattgggggttttccttggattttttttttaataactgggggctattttatcagcttgcctattaaaggactatggtaagtatagaatcttaatggttgccagttagtaattctttttttttttttttttactgtagacacaagtttggccctatcaaaaacgatgaggaaaaaagattgcactccaggattaggaggtgtgagatattttagcttttttgtcttatctgcgtgggtattgctgctttattttaaaaaatcctgcctaaagtaaacactttgttttaaaatgatacagtatcagattttgttagatgctagaaatggatttattctaaaatttggaactgtcgtacacattctatatgtaagatagcacacaagtagaaatatttaaaagcagtcttattcacagattgcagtaattctgtatttctactaagataatctgctttgtgccaaaacagtaatttccaaacttctgttcaccatgaaaaggcaatcttaaagttcattatgtaaaactaattataaacaggacccaatttatattcatagatcctctcaagtattatacaatttaaaaactcttgttccaaagtcctgtcttaactattgaaacaccttaatctgtggttactaatccagcaaattcaaggaaccaggctatgactaagaatttaggtggaattgatgtctgggcaattaaaataaatggcataagagcttaaaaaccaaagttgtgccagtggctttcaactagaggcagtaacctgtcattccagaggatgctgagaaatgtgtaggggcacttttttggttgtcatatttactaggggcttctgttggcatttaagcctaaagacactcacccctgcagtgcatgggacagcctggcacaatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcaccatagcacttgtaaatcaggaattaataattgaatcagatttaagggctctgtcctgttatacatatttaaggcagaaaaaaagttacatgtcgattaggtacttatcaagaatggtcaagctgagattttggttaatagagtaagcttacatatctagagaaacaacatagtggaaaaccgaaaaaaaaaaacagaaaaatctaccggtaatttcccaatagctttgaatattcacagcagagctttattacttgagagaaagactggaagacctgaaagccacttctgctttctaaccccagttccttaaatattgaaatcttgtacattttgtgaaattccagtatgttttgcttaaggtgttaataaaattagtttgcatcatgtagtcattgagtgagggggagatataagccaaggattttaaattgacccttagctatagagaatttgctataagctagtcttgtttgtaaaaaaaaaaaaaaaaaaagaaaaagaaaaaagtgtattttactgttttctgtattaagtaattctgtaactgcatggcagtctttttttttttaaataaatatagttgttactggtcctgttgtagcagtgaatatagttaaaatacgtacattaaaaaaaaaattattaggtccttaccagttactgtcctatagctcattcctactagttttcttgacagatttgtattcccagtgtcccgtattgccactcaaattgctctactatgctaagtccttgttaatagtcttaccctccttgaaacacttgaacacttgatgactttagctttgaggagataccatctccaggtgtgctttcttagtctttgcaggcacctcttcccttcaatatctgttcttcgtatttttaaaaaaatttgttttagactgccttgttctgtgtcagctcgctagctgatctcatttccttccatggtttccttaccatttatatgcaaatgactgtcagattcatatctcctttctagatcttccctaattgatgtatctaattgctaacaaatgctctttgctgtctcaggcactacatgtcattgatcttgcccccaatcctgctcctcctctcatgtttcctctttgactaaatggcattaccactaccaaccattcatttgtcctttttaccaattctccaatgctgccattttaattcaggccatcaacctacctaaattatagcaacagcctccttattagtctccctgttttttatttttattcctttctacactacaaccaaattgctccaaaagacttactgatcatgtcactgcattgctttcaccattgctcttagggtacaatacaaatttatcttcatctttaaggtctcagtatgccacttcatctaggaaaccttcattgatgccctctagattaggtgcccttactatccattccctatacaccctgttctttcccagacatacacttggcacactttattgttactgcttattgatcactgctagactgtaagctttgtaagggcagggaccatataagccttgttcactgttatatctctagtgcttagcacaatgcctggcatttcaataaatgtttggacaaacgaatatttgtgtagtgttttacaatttttgaagctctttcacagtcttatttgaccttcacagtcattctgccttagactgtccattgggtaacttttatccacatattactaattgaaaaatgaagacaagttctttgtaactagggacctcgttgtattctcagaatttagtgtagtgcttagcatgtgacttaaatatgtattatgtgactgttaaacaaattgtggttttctctgttgtatgaaaggagagaaggataacaaattgcggttttccctggtaaacacagtaagtagtaaactcaggattcaaaaccaaatatacacaccaaatccactatgtaatattaagtttgcatatccatgtatagaatcttatttttttttaccctttgtaaacagtgtcatatatatatatatattttttttttttttttaaatttccaaaggaacctacatatagagggaaaagattagacaactacttagtgaactaaaacaatatgtttttactaaatgttacatttagtattggaaaaagataatgccgcctaagagttaataatcatttttccttttgtaggcatcaacactaggagaaaatggcatgctatttacttgctactttcctttacagatgatttttggctcttctgggatttaaaagtaagtaaatttaacaaagtagaagactgactcagcccttctggtcactatatattcagttcacttgtttttacacctgcagaatgtccttatcacccaaagggagatgacccaaaagtgacatctagttaatgtatacttctaaagtttgctgtattcctttgccttcttgttcccatgcctctctgaacttaatttctgggtaactgaggcttttcaggcttaggtgggaaagccacacccttagtctgtttccttaagccattttgaccaatttatgggattaactagtataatcttagttggagttttagtctgaggcatattaagtcattcagagatcttaacagtaggtgtcatagtcatccagtgatttggtgcttgctgcaaaactggcttttttttttttttttttttttgaggcggggtctcactttgtcacccaggctggagtgcagaggtacaatctcagctcaatgcaatctctgccttcctggctcaagcaattctcccactgcagcctcctaagtagctgggaatacaggtatacacgagtacacccagctaatttttgtatttttatgtggagacagggtcttgctgtattccccaggctagtctcgaattcctggactcaagcagtccgcccgcctcgggctcccaaaatgttggtgttatacgtgtgagcctctgcacccggcggcaaaactggcttttaatcaaccttttggctaaaggatttctctttttatttatttgtaaaaggatttcccatttttatctttctttttgatattaaaatgttgcctcatcctacccagtaagtacttgaatttgaattctcttccttttcatttttgcctgcaaactgaccagtcttttctgagttcatctcttctgtacgttttgtcaagtgcagtgaacagcaactacaaaatattttgtttttctgtctttttctttagtaaagggtagatgatctgcctttcaggttatctcaaggggcagtttcacctttccataatataaattacccttgtgtaagttatttcttccatcttctgatagcaatttcctgaatgcctgccagctaaccattaagccagtgttcagtattttagcattttaaaaaacaagggaccaatttctgtgtcagcatgggctagcttgccattgaataacaaaggcaaaatctcactgtctcacacaacttttctattgcaacttgcctagggactttggtttagatcataggttggccatgatcaaactatggtccatgggcaaaatctgtctagctccttatttatctaaataaagttttactggaatata

SEQ ID NO: 719 - DNA, 11667 bp, Homo sapiens
gcaactggggaagctgggaggtaggcgcggggcggtcggctgcggtggcggcgtttggatgattgtctctcggcggcggagtcggtgagcggcccggcggggcgcggggtgcggagcgggggcggctgtgcgtgcgagagtggcaggtgaggccgggcctggaggctgcacccggggcgggggtctggccgtggatcccgcccggccgcgccgagggcatacctcttcgccccccgggcgtctggggcagagaatctggaaaattcccggtttcttctggctttatcttttcacccaattatgcgaataaagcgtacttattagagacaattagataagtggaagaaaagtgaaagtagccaccgtccggaaatcttagtctccaggtctcctgacattgaaaacatctggcatagacttctccctttttcttgtcttatttcacttcctggcacctgtcgccgtctaacatagcatgtatttgtttattggttatcttcccataagccccttgccagggcagtgctttctgtttgctttattaactgctgttaccttagtgtatgggaaatagtaggtgctcctagaaggtgtttgttaaattaatgaaagaaggaatatctaaactgggagacaagaagaattgacagtttttaatgtcttttttttttttttaaatagcccattgccaagttaagaatgtaagagtgaccttgagcctggaacatttccttgcagagttagagccctcacagcctgtgctgctgcatttaatgccttgtgtctttcagtgtttcaggcttcatgtgtactcctttgttgtgtttaatctcttaagtcagtggccttcattcattctctcagccttctgtatttcacaccccataggagtggggagggtggattgagatctttcttccttactaagtggggtgtgtgcatcacaccagccctatagctgtggagtggatctgctgggtgtgggggctctttgcattgcaggaggctggatcttgttccctgtttctccttttgctgtaagtatacgctgtacctcttggggcctgatgtggttggtatctgtcctcagcgacctcaaatcatgtgctatcccttccttggatggccttttaatcttggcagcacagcctggccacctggtgaatagtggaacagtcatggtgatgcataaggatctagtatgttccttttaggtgctgtatggtatttcatcctataaaaatgctacttttatttagccatattgatggacaagtaggttaaatccagtattatgttattacagagaatattttagtaaatacctgtgtaaatgtctgaatacccgtgcaagtgtttttcagggcagattcttacaagttaaattcctgtagcgtaaggaatatgtctttttagttttactgtggactttcaaactatccttcctgttggctattacatttccacatctattagtggtttgtgtttggtgtttttttcttttgcttttcttttggacagagatttttttcatattgatgtattcaaatatattcactcttttcattttgttgtcttaagaaattcttggttacaccagggttcttagagtctttatggtttttttcttttttttttttgagacagagtctcactctgtgtcacccaggctggagtgcagtggcacaatcttggatcactgcagcctctgcctcctgggttcaagcaattctctgcctcagcctcccgagtatctgagattacaggcgcctgccaccacatctggctttttttttttttaaagtagagatgggatttcaccatcttggttaggttggtcttgaactcctgaccttgtgatccacccaccttggcctcccaaagagctgggattacaggcgtgagccaccgcacccagccttttagctttgttttttaagtttctttattttttgtgtgattttacttactatttttatttgcctagccaattgtcccaacacaattcattgactagtttaatttttcccactgacttgtaatgctactgttaccaactctcaagggaagtcgtttgacttcagtgggtcctttacctgcctggtggtgttcatgccaataaaatgagaccaagtttcgttaagcagtgcagaaactttatttgttgatgaaggaatggagaaggaaaagctcatgctcaaagtaccctcctctgggtgtggtgaagagggatttttaaggtctcttagggcatgtagtggggcagagatcctggaaagaggtggggccctatgggaagaactggagtgtgctcagtctcattcttttttctttctttctttctttttttttcttttgcgatggagttttgctcttgttgcccaggctggagtgcaatggcttgatcttggctcaccgcaacctccgcctcccaggttcaagcagttctcctgtctcagccccccaaatagctgggattacaggcatgtaccacatgcctggctaatttagtatttttaatagagacggggtttctccatgttggtcaggagggtcttgaactcctgacctcaggtgatccacccgccttggcctcccaaagtgctgggattacagacgtgagccaccgcgcctggccagtctcattgtttcttttgtacccagcactatatgtgcctagcaagtgtatttctcccttctaggtggagattttaatatggtaatgaagcaaggattcaggcctgggtagcactgctgagctaagttctcctttgtggttactgatatttagcctttttctctctaagcaagcacagctgctggcacaggttaattttacaggttctggggctctttttaaaagaaggtcttgctgctataagtagacagagagggcctccagggatcataggaatttaatcaacttgagcagtcagccagttttacagccttctgccctgcagcctgtttcttcctaaaccctgtgtggattgcagtcacctagttagttaaaaccagccccaggccgggcgtggtggctcacacctgtaatcccagcactttgggaggctgaggcgggtggatcacaaggtcaggagattgagaccatccttgctaacacggtgaaaccctgtctctactaaaaatacaaaaaaattagccgggcgtggtggcaggcgcctgtagtctcagctactcaggaggctgaggcaggagaatagtgtgaacctgggaggcagagcttgcagtgagccgagattgcgccactgcactccagcctgggcgacagagtgagactctctctcaaaaaaacaaaaacaaaaacaaaaaaaaaccccagctcctgacagaccccagcaacttatagatgaacctgagtgaacttttctcattaccatgctaaagtctccacccggggagtagctatagcttcattaccataacacatgacttatgtgctggcataatgactcactgcgtctgtaccactgggacccctcctatacatgggatgatgtagcctctcgcctctccattgctccataaaattctcctattactttcccttggagagatgctgctttggaaaatactcccagtgtcctccttacttacaccaagtaataaaactcctattgatctaaacttgcattctcacaaacagtcgtttgttactcgccaggtgaatgaacctcattttttttttttaggtaacactgtggtgacactatctctgtcatgcatcaaacttataaaattggctgggcatggtggtgcatgcctgtaatcccagctacttggaaggctgaggctggagaatcacttgaatccaggagacggaggttgcagtgagcagagattgcaccactgcactccagactgggcaacacggcaagactccgtctccatagaaacaaaaaaacaaaacttacatatgtgtataagcctgtgtcaggattctgtacttttccttttatctacagtttgcatatttatatttcttcagtaatatatgctgtttcaagtactacagctttatattaagccttattgtctggtagaacaaaactttccacatctaaaaagttttcttaactattatttttctcattcatttgaattttagagtatgcttatcaagctctatgaaaaattacattgtagttggctgggattttgttgactttgcatgttaatttagaaaaaactgacatcttgaaggagtgttttcccatacaaaatgtatttatatctgttatgtctttaggcagagttttctatttatccactaaggtcttgtacattttttattggctttatttctgagtactttatatttttgttgctattgttttaattcattttctgattggttgctattgtgttggaaagttattgagtatatattgattatatattcaatctcctgaatgtcttatgacgttctgtttttttggttcattctgtttaattttttaggtgatgtttcatatcattcatgcgtatatttgctttgcatctttcttgtctattttctgcatttttttttctggtctaattacattgtctaggattacaatgtttgttcctatttttaattgcaaaggtttttatgtctttaccatttagtgtcacgtctgttggagatttctttcgtctattctgcatgtcagtttaaggatgtctctattcctggattgttaagagtgtgcacaaaaagaagatatagttatttaattttaagagaataccaatactgtaaatagctttatgccaataaatatgaaaagctggatgaatacttggattgtttcttcctttttactattatgtgtaatgctgctatgaacatttgtgtatgagtttttgtatggacatctattttcttttatcttgggtgtatatatatataggagtagaattgctaggtcaattagtaaatgtatgtttaacttcgtgaggaactgtcagactgttttcataagtgtatgcatcaatttacatttccaccagcagtggataaagtttcaatatctccacattctcactgattttttatttatttttttgagacagagtcttgctctgtcccccaggctggaatgcagtggtgtgatcttggcttactgtagcctcgaccttccaggcccaggccatcttcccacatcagcctcctgggtagctgggaccacaggtgcatgccaccaggcccagttaattttttgtattttttgtagagagaggattttgccatgttgcccaggctggccttgaactcctggactcaagcaatccactcaccttggcctcccatgattgcttgttattatcggatttttgttctagccaccttactgggtgtgaagtactatcttattgttcggttaatctgcattccctgatgactatcctgtgtacttattagacattttaatattttctttggagaaatgtcaattcagaccctttggccattttcatttttatttttgagatggagtctcattctgtcactcaggctggagtgtagtggcgcaatctcagctccctgcaacctctgcctcctgggttcaaataattctactgcctcagcctcctgagtagctgggattacaggtgcctgccaccatgcccagctaatttttgtatttttagtagagacgaggtttcgccatgttggcctggctggtctcaaactcctgacctcaggtgatctgcctgcctcagcctcccaaagtgctgggattataggcgtgaaccactgtgccctggccctattttaaaatttgttatttttttctttttattattgagttgtaatatataaagaatataaatatatattctctctatataaagaatatatatatattaaagaatataaatatattatttatatattccagatacaagtctttatcagatacatgatttgccagtgttttcttccagtctgtggatggcttttcactttcttcttcttttcttttatgcacaagaggttttccttttggtaaagtccaatttatttattttttattattttttccttgttttaatatgattttggtgtttacaaatccgttgtcataaaggtataagtcacaaagacttctacacaggtttcttgtaagagttttagagttttagttctttttttttttttttttttttttttttttggacttagagtctcgctttcttacccaggctggagttcaatggcgcgatctcggctcactgcaatctctgcctcccacattcaagcaattttcctgcttcagcctcccaagtagctgggattacaagagcccaccaccatgcccagctaattttttctatttttaatagagacggggctttgccatgttggccaggctggtctcaaattcctgaccacaggtgattcacccacctcggccttccagagtgctgggattacaggcatgagccactgcacccagcaagttttagttcttatatgtaggtctttgattttttagaagttatttttatagatggagtgaggtagagcaccatcttcattattttgcaggtgcatatccagttgtctcagcaccattcattgaaaagatcattctttccactttgaatgatcttggcaccattgtaaaataatgactaaagatatatagtttatttctggactcttaattctaatccattgaactgtatgtctattcttatgacaggaatacaataaattgaagactgttgttctgtaggaagttttgaaattgagaagtttgagtccttcaactttattcctctttttcaagaagaattgtgactgtatggttctcttgagtttccacataaattttaggatcaactttcgacttctaaaaagatgccccctgggaatctgatagggattgtgttgaacctgtagataagttttgggagtatccatgggacttgtgtttgaagaaaagagaggaattaaaatgttttggccagtgtgtgaattcattgacataacttgggaaatccagagaggaaggtagtaagaacatgcattttagacactgaacttgaggtgttgcaggacacccaagtgcaatgtcccataggcaacaggaggcatgtggtaggggtctaggagagaagtaagaactgtgagagcagtattaaagcaatgagagttggtcagattgctgacggaaaaaacaaggaagcactggggcctgagttgcaaggagtgtccataatgagagggcaggagcagacatgaggaaccacaactgtgtggggaaaatcagggctggctggtgctagggaagccatgggagagagagtggccagaatagcttccttgaaaaaggttgaagagagtgagggcttggaggaacacccagttctcagcttgatccgggaccttgtactgtaccctccagggaaaattcacaccactcttgggataatgccttatggaagaggttaagagtcagtgtgtgtggaggtgcctgggttctcttgaatccacttattgggaatatagatcttatgggagccagaagcagggcttgtcccactcatagctttctttcctccctcagctcaatgtacttctccagttcctacccttcctcaagtggggaactcaggagaccaagcaggggcaactgtacttcggatggtcaggccccaggtgagcttggttctttgtgtttttaccaagtccccatgagtctggtccaagaatggctagaggtctcacccccaggactctgccccatctaagactattcctgtggctctcctgcctcattgcttcccctggaggtaatggactctatcttgcactggactttcgaggtgttatctcagctcctctctcccatacttttgcccacgaagaggccataccctgtgccctctgtacccttgatgactctgcccttcagggtgtgaatgttcctgagcaatcggagcttgtcattccaggatactgtggcgtatgaggacctgtctgaggactatactcagaagaaatggaaaggtctcgcactcagtcagagagccctgcactggaacatgatgctggaaaatgaccgtagcatggcttctttgggtaatgattctgtttcctagtcacttagagtctgcatgctgccattctcttttttatattccttttctttttaaactttttactacgaaaatttccaaacggagataagctagagtgaataagagtcagtgtgtatggagctgcctgggtcctcttgaataggaccttctctgcattcagcttgaacaatgatcagcattctcttcacctcattattgattgacataaggtggtttaggtagagtttttttagttgtaaggaatagagagccactcaagttattgtaagtaaggagctgtgagtcataggcttaaaggaatgagaacccagaagaaactgatcgctagaccagactgtgggaagtagggccttgactcagggcagcctgggagcctgaacagcaaaagcaaatgcatgttgatgcctgtgttctggtgtgaatgtaatgcagctgctcgcagtgtatctgttttctctctgcttgtactcctcctgctgcccattttcttcactgtgaatcttttgtccttttcgtagctctttcctaattgtacttcctgttcccttatatttgttgcttgctgtgtctcctaatggcttggcttctctccatgtatcacttcagattccattaccactcgtaattttgccctacttccagttccgaatttccttagagacagattcccattgctatagccattactcatcatctcggttgggcagagctttggcccaggccatggcagaggctgaagactaacctacagataagctgcccttgggtctggtacctggtactggtccaatcacttgcagtccatcatgggatgatgttcaggatcacttgccacagagcatggttgcctaagtgttgctctctgcaaagactggggcagtgcagtttcctggaagggcttcttggcagtgcaggtgctatgattgatgcatatagggcagtagccaactctggaaagggtgggcttaggaatctttcacccagacatcttaaactttccataggctaactgacatgatggctgtagccccaattcagatgtgattgaaaggaacccacattttggtgtttttccatggccatgattactctgccttctcccagattttgtattcagaattccaaaaggcaaatatttacctgatcatttcctttatattctagataatcaaaggcattttaatttatatttcaaatgattgatgtccctgttatcttttctgggagtgcacaactggctcctaccgggccagtgctctgagggccagtggcatccccacttttagaactctgctgtctccttcaatactgctgtccagcttttctcaactgatagcttctccaaatcttgttactgtcctgtcatacaacatctctcctttttgtacgctttcctaatcatacactcatagtagaaatttctcaactcattcccatcttttccttgtctctttcttatatttgacttgaggtatttgccagccttccctctcccaacatcttttctgagaaccatggaaccatataatgtcatggttggaagggaactcaaagtttaccattttgctaaagagacatagtgtgagagtgacttatataagatcacagcatgctttgcaatccagtctcttgctttccagtgacccttctgacttggctgtgctggctcaatatcttttttccaccctcctccactgaccgtcttcttcttccttgtttttctatccctaagatacaattgagcattttgctcttgttctcaatgtgtcatctcatttcttaaccataatgtgactttttttcaggtacattagctctttatgattctgtttcttcaacaggaaaagaaatgagtaaaagttgttgtcttattttttttggcagcaggtaggaacatgatggagagttcagagctgactccgaagcaggaaatttttaaaggatcagagtcatctaatagcacatcagggggactctttggggtggttcctgggggaacagagactggagatgtttgtgaagataccttcaaagagttagaaggacaaccctcaaatgaagaagggagcagactagaaagtgatttcttggaaataatagatgaggataagaaaaaatccacaaaagacagatatgaggaatataaggaagttgaggaacatccacctctgtcttccagtcctgttgaacatgaaggagttttaaagggacagaaatcctatcgatgtgatgaatgtggcaaagctttttattggagttcgcacctcattggtcatcggagaatccacactggagagaaaccctatgagtgtaatgagtgtgggaagaccttcaggcaaacctcccagctcattgttcatctcagaacccacacaggggaaaagccctatgaatgcagtgagtgtggaaaggcctataggcacagctcccatctcattcaacaccagagactccataatggggagaaaccctataaatgtaatgaatgtgcaaaagcttttaatcagagctccaaactcttcgaccaccagagaacccatactggggagaaaccttatgaatgtaaggagtgtggggcggcctttagtcggagtaaaaatcttgttcgacatcagtttctgcacactggtaagaaaccttataagtgtaatgaatgtgggagagcattctgttccaatagaaatctcattgaccatcagagaacccacactggggagaagccttataaatgtaatgaatgtggcaaagccttcagtcggagtaaatgtcttattcgacatcagagcctccacactggggaaaagccatacaaatgtagtgaatgtgggaaagccttcaatcagatctctcaacttgttgaacatgagcgaattcatactggagaaaaaccatttaagtgtagtgagtgtggtaaggcattcggtctgagtaaatgtcttattcggcaccagaggcttcacacaagtgaaaagccctataaatgcaatgagtgtggaaaatccttcaatcaaaactcatacctcattatacaccagagaattcacactggtgagaaaccctatgaatgtaatgagtgtgggaaggtcttcagttataattctagtcttatggtacatcagagaacccatactggggaaaaaccctataaatgcaatagttgtgggaaagcctttagtgacagctcacagcttactgtgcaccagagagtccacactggagagaaaaaccttatgaatgtattgagtgtgggaaagcctttagtcagcgttccacttttaatcaccaccagcgaactcatgctggagagaagccctcaggtctggctcggtcatcttcttaaggcatggttttctgagacagacagcaaagacctttgagttaagctgtctttataagaaggatgttcatcatggtctccttggagaccactaatcacagtggagaccatacctacttgcttttccttgggtcactaaggtgggagagtaggtgcaacttagtctgatccttacttagtaggaaattggggattacatctgtcattaacttgta
